United States Patent 7,368,527 (HADDE71 POLYPEPTIDES) - sequence listing, part 7

SEQ ID NO: 11255 - DNA, 6404 bp, Homo sapiens
  misc_feature (1484)..(1484): n equals a,t,g, or c
ctcaactcaactgagaagataaactggctgctgtgtgctcccacattactctgcctcacacatagtaggtgcttagtacacatctttttttttttagaaattaaactaaatctgagcaactgggtttcttgtagtggagcaaaactctttatgcaaaagtgcctcaaggtgtcttatagaacagaagtgtgtaagtaaagtggggtgtatccctgtcctaacactcttccctttaaagtctatcacagaaagctttgccacagcaatccatggcttgaaagtgggacacctgacagatcgtgttattcagaggagcaagaggatgattctagacactctgggtgctgggttcctgggaaccactacggaagtgtttcacatagccagccaatatagcaaggtaagaagctcaaggtctacattagagataaaacccagtgcatacatatgtgttacatttactctatacttcgttttatagacagcacttgatgtacatagcactgttctatatcatttttataatttcccatgttccattatctgagttttaatagtcatccatattctttactaagtcactgtcttaaaaccatacacagtgaggcacagtggctcatatctgtaatcccagcactaccagaggccaaggtgggcagacggtttgagcctaggaatttgagaccagccttggcaacatggcaaagacccatttctacaaaaacaaaaaacataaaaattagccaggtgtgatagcacacgcctatagtcccagctactcgggaggctgagaggtgggaggatcacttgagcctgagaggttggggttgtagtaagtcaagatcatgccactgcactccagccaaggcaacagagcatgaccttgtcttaaaaacaaacaaacaaataaacagaaaaaaaatatgctaataatatctcacagtttattattattattctctggagaaaagcctggtcaagtactctgagcagagtggggatgtatgtgagagctcctgctctccctagggtgtattagagataaacagttagtccatcttccctggtatttaccccaaggagtaaataagagtaacttcagatgtgcttccttggagcacttccggatcatgatctaggatcaagcaacgacatctcctccccctttcacaggggagagctgtgtattctacaaggatgagaggtattcaatgactagggcttctatctgtggcaaaggttcaagtaagaactatgaataatgcctccaaagatgaagaataactcttgaaatggtgacttggtatactgtactcacactatcactggttgatttgcttttgttccagatctacagttccaacatatccagcactgtttggggtcagccagacatcaggctccctcccacatatgctgcttttgtgaacggtgtggctgtaaggaggttttcacgtcttttcaactattacataatcataatnattttagagtcacgaaatatctcagaaattgcccaaattctatatttcacagatgaaagaactgcaagtcacacagataacgtcgctcggcttaccctctctcctatgtagtaattcagttttcatgtttttacagtaaattgatgcttttcaaacagattgtgtagcagaggaaagaagatggaaggatttagataaaaacaccctaaggtatcccaattcaaaaccttgaatataaatagcaaaaaaatataaaacccatatccagacctaatatcttctgtttttcctgttgtggggccagtttctctcaagtaatgtgttctttattcattcactcattcatccattcaacagatagttattgagaaaggaacaatggccttatagtgtctgtattttctgaaccaaaaatctgtacttctcatctgacagatgatttttatgctttttctgtgtgtcacgggaaatattctacaagatgtaacttggaaacagacatgttgggatttccgagatatttttatgatttatgggtacaatagctcaggagattgaaagttaaagccaacggtgcattccaaagcaatgtcctgaaagcagtgggaaatgcaccagtgacagcaaatagatataaaaatctatttttaaatgaacttctggatattactgttttaatataaagaaaaagaaaatggctaggagaaagaggaataagatcttaaagcagaaaataatgatttttaaaatatatagctgaaaagttaatctgagtttgacagttattgtgctattcttacaacttctctaaaagtttgaaattatttcataataaaaaggtacaaaaacgtatggcctcatatggaataaatgacattaaacttgcagtgcaacttatttaaagggtggaggaggaattgccagccacctgattctgcagctttgtttttaaaagggaatatagatctttccaggggccacagcagagggagctcaggccaccagggcaagacccaagctccttggggctcacaagctgctctccaaggtactcccttcctctggcagaggaacagcatttcccagtgcccggccatgtgattaataatcacagccaggccaggtgtggtggctcacgcctgtaatcctagcactttgggaggctgaggcgggcggataacgaggtcaggagtttgagaccaccctggccaacatagtgaaactccgtctctactaaaaatacaaaaattagccaggtgcggtggtgggcacctgttatcccagctgctccagaggctgaggcaggagaattgcttgaacccaggaggcagaggttgcagtgagccaggatcatgccactgcactccagcctaggtgacagagcaagactctgtctcaaaaaaaaaaaaaaaaaaaaaaaaagaaaaaaaatcacagacatttctcagattttcttttctgagaatcagatcaaaagaatctcacataaaacaaggttattactaaactaagtccttagtggtccaaaagccattgcattaagggaaaatttaaggctttttgttgctgtttgtgtctgtttatacagattcactccatggattttgatgacacgtggcaccctgccacccacccttctggggctgtccttcctgtcctcacagctttagcagaagccctgccaaggagtccaaagttttctggccttgacctgctgctggctttcaatgttggtattgaagtgcaaggccgattactgcatttcgccaaggaggccagtgacatgccaaagaggtatggagagaatttgccccatcaaaaggtagtcacatccccttcatctatcaatcattatctccgtagagctttctgacttagaggccggttcagaggaagatgttaacattagcacaggtagataagtcaatacaccagtcacatacgaaaccctctatccacatttaaagaagtgacttcaagagtgcaacctggaccgtgagattaattgggcctctcgttgcaaggtgattcatgtcattctggcattcatgggtgtactgagtattccttatttcattctcaaagcagaatctattctgagactagctagcgtccctcagactaatgaggacattcagaatatccttactctgactgttcatcctgcagataaaaaatggtcaaatgtcggccacatcatatggctcagtctcagatttatgttgccacttgctccagcctgccaggagagaagtaaattgaaatactaggtagtgaagtttcagtttcttcaaggcccacaattctcacagtgacttagatgagatctcagcaatcaatagctgttgcctttctggcaataattgtaatggtaccatttataaagaactcactatgtgctagcactattgtaaacatgttaatttattcaaagctcctaaaactctaagaggtagatgttattattatcaccattttattttattttttgagatggagtctcgctctgttgccaggctggagtgcagtggtgtaatcttggctcattgcaacctccgcctcctgggttcaagtgattctcctgcctcagcctcccaagtagctgggactacaggcatgcaccaccatgcccagctaatttttgtatttttagtagagacggggtttcgtcatgttggccaggatggtctcgagctcttgaccttgtgatctgcctgcctcagcctcccaaagtgctgggattacaggcgtgagccatcgtgcccggccttattattattatttttattattatatttttttgagacagtctcactctgtcacctaggctggagtgcagcagcatgatctcagctcactgcagcgtctgcctcccaggttcaagggattctcctgcctcagtctcccaagtagctgggactgcaggcacccaccaccacatccggcaaatttttgtatttttagtagagtcagtgttttgccatgttggccaacctagtctcaaactcctgacctcagatgaccctcccaccttggcctcccaaagtcctgggattacaggcatgaaccaccacacctcgcctatcaccattttgtgtaagaaaaactctacagagaagttgaataattttccccagatcatatagctaataaagtaatggagctgagatctgaacccagacagtgtgactccattatcaatgttcttgatgactacgctatcctgcctcctggtggttacggtttgtacatctccaactctgcttctttgcttttcagattccatcccccttccgtggtaggaacgttgggtagtgctgctgctgcatccaagtttttaggacttagctcgacaaagtgccgagaagctctggccattgctgtttcccatgctggggcacccatggccaatgctgccacccagaccaagcccctccacattggcaatgctgccaagcatgggatagaagctgcatttttggcaatgttgggtctccaaggaaacaagcaggtcttggacttggaggcaggatttggggccttttatgccaactattccccaaaagtccttccaagcatagcttcctacagttggctgctggaccagcaggacgtggcctttaagcgttttcctgcacatttatctacccactgggtggcagacgcagctgcatctgtgagaaagcaccttgtagcagagagagccctgcttccaactgactacattaagagaattgtgctcaggataccaaatgtccagtatgtaaacaggccctttccagtttcggagcatgaagcccgtcattcattccagtatgtggcctgtgccatgctgcttgatggtggcatcactgtcccctcattccatgaatgccagatcaacaggccacaggtgagagagctgctcagtaaggtggagctggagtaccctccggacaacttgccaagcttcaacatactgtactgtgaaataagtgtcaccctcaaggatggagccaccttcacagatcgctctgataccttctatgggcactggagaaaaccactgagccaggaggacctagaggaaaagttcagagccaatgcctccaagatgctgtcctgggacacagtggaaagccttataaagatagtcaaaaatctagaagacctagaagactgttctgtgttaactacacttctcaaaggaccctctccaccagaggtagcttcaaactctccagcatgtaataattctatcacaaatctctcctgaggcttaccaacatctaaatgactttgcatttggggagattcaatgatttggtttgtaaagcaagggtctgctgcttggttttcccaggaaaaatgaacaaagatggagagagtccagaaacagaactacatatatctggaaggagccttctcctgaaaattttgcaggacagttccacttacctaaatcaagatgaaacacacacacaaaaatgagtttgtaagcattcacaagggtgaaattcaactcacctgtgatttacttataaaattaatctcttcataggaattatgtgtggacttcatgagcctcaaggttttagagggatgtgaacctgcatgtatattttctgacagtggagagggctctggtgcattgtgtcaccaacagatctcctagaccatggcttattaccaagccctccacagtgcaaggggtgctactggggaatgggtgggtttaaatcctgcctctgccattcactagatgtagccttgagcatgttaccattagccctctgcctcagtttccctatttgtcaagccgaagtaaaaagcagtctggaaaaatcgcattttggctctagaacccatggtcttaagcactgcaatatatcacctttcagtataaaaatatttgaatcagagttgcaataaagaatgaaa

SEQ ID NO: 11256 - DNA, 10642 bp, Homo sapiens
cctgaggagggagttgtggggacctccaatttacagccagttggtcagatgcataggtgatgcttggccttgcacctggggtctgacatgcggatggtcctgtgtgactgagcccttaacctgtggagtctggtgctcactctgcttagggcttctcttgcctttttagtgtccttctaggcggcctttccttcctcttgtcagctcagaaaacttttcttccacttcccttcttctaaaccatcccttacatctactcctttccagccgaccaagagcagaaccacggctggttccactgccaccatgctgtcccacactgtctcctcaggatgtattcagatgtccagccctccccccagtctaggagccccccctttgaggaaagggatgctggcctagtcaactctttcccagcaccaggtacagcatctggcacgttccatctttttcatggactctccccaggcggcctgaccttccctcctctgaaccggtgcatttcttgtctgcatcatgtttgccctaatcagatatcaccttatttcctcttttaaaaaatgctttgtttctctggcaggcttcatcggaatcacaattttcattcatttagtaactgttgttgtttattctatgtatttttgcaggaggcctgaggtgggctgtgttctcctcctatggcagggcttcactctcctcctcctccgttggggcttcgctgtccctgggataagaataacaatgccaaggttttcattcttgaaaggagcaattaagcttctcaccccctcctcattttagatgggaactgtgagggccccatcatttacccagggtccctgttgaggatcttgtcctcattagatgacttcttgtgcagcttccatgcatgattatttattcttgtggcactgagaggtttgtacatatctttaaaccagagcggctgtccaaatgaggaaagtccatcctagaagatagaaagggaaatattaattttgcatgtcctctgctttccctggccacagcaatgaatcctccaatgtacctgactctcccttcgcgaagagcatcccctccatggcagaaatctgaaaatgcccctggggagacacatgcacaagacagtgagtgatgcagccgtttcccacgtatctcacaatgtacttctctggtcttattaggactaaatgagtatctcagtccataatcacagggagaaccaccaccacagaccacatacccggggtcttgaaaataattccatgcatgtgggactttcagaagctctccatgtctgcccagaagggccccacaatatactggggggactttgtatgtggctcagcatggagcaggggcaggattttcagtcccactcactcccttggccaagtgcccttgtgcagtgaacaaactgcacaaccatgctgggcagaagcattttatatcagtccccttcggacttagtctcacaggcatcatttgatgggggatgggagatgaagtggttcttcgttttctagatactttattctataagttggatcacctcaagcaaatgcgtgagtgcagctagccaagttctctatctcacagtcttcatatggctggctgtcgctgatgagtgagtgagctacgaaatcagcttaaagcacaacatgttatttttgaatttgaataaaataggaaaaggcagagtgcattgtgtgaccatggggtaagtaagacactctccctttctccttctcagttttcctgtcataaaaggacaaactactatctaaggtctccgtagttaaaattcttttttgttgttttttttttatttgagacagtttggctcattccccaggctggagtgcaatggtgctatcttggctccctgcaacctgcgcctcctgggctcaagcagttctcctgcctcagcctcccaagtagctgggattacacgcctgcgccaccacacccagctaatttagtatttttagtagagatggggtttcaccatgttggtcaggctggtcacgagctcctaacctcaagtgatcccaaagtgctgtgattacaggcgtgagccatcctgcctggcctttctggttaaaattctgtgaggtttgcataaaaggaatagagtaggggcccaaaaaccagtaagatgagaaaatagtgtttcctcagttctaggatccaggggaaaaaaaaaagaaataaaagagaaaatactgtttcctgccacttaagaggaaggactcacatatcctaccttccatcagccttgaaggagacaagtgccctctctctcacacccggtggccttcccttcccctttcccagagcctccaagaaggcccctggcctggcctgatgcccaccatcagcagcaataggcaccaaaacctttctccttcctatccctccccacctcccgaaagggctggggacagcaggtgtgtccttgttagttccatccagctcagctttggctggggagctaatttcactggagccaggctaagcattagggtaagtatttgtcctgtcttgggcagtttcctcactgaaaaatgagggcagagttctaagccctcctctaattctaaaattctaattaaaacgtcgcgagactagtggtgcatgcctgtaatcccagctactcgggaggctgaggcaggagaatcgcttgaacctgggaagtggaggttgccgtgagccgagatcgtgtcattgcactccagcctggcaacaagagggaaactccgtctcaaaagagaagaaaaaaaaaatcaccagactaatatttaccttgagaatccttcttcatcttcttgtaatgaccttcggtgacaacatatctgttttagaagaaaacgcaattaagattatctatgacaacaaccaccgtctccaaatctgtattgattccttttattcattataagtctcatctacctgatgaggtaacttttttgaagacaggaattgtatgctgtgtaacactgctttgattcttccatagttcagtcatccttgctatcttgcgggggattggttctaggataccgcccccacaccataccagaatctgtggatgctcaatcccttacatataatggtgtaatatttgcttataaccaacacgcatcccccctatactttatttacttagcgacaggattgccctctgttgcttacgctggagtgcagtgtcatcctctgttactcaggatggagtgcggtgtcacgatcacagctcactgtagcctcaacctcctgggctccagtgatccgcccacctcagcctcttgagtagctgagactacaggtgcatactaccacacctggctatttttttttttaatttttaataaagacaaggtctcactatgctgcccaggttggcctcccaatgtgttgggattacaagtgtgagccaccatgcctggccccatgtaatttaagtcatcactaataaaatgtatacatattgtacattgttgacagttgttatattgtactttctgtttgtatttttattggttttttttttcttcaaatattcagcctgatctagttgaatctgaagatgtggacctgctgatgaagagggctgactgtatctaacttagggtcttgcatgcagctggcacttaatacattttattgactgttttagataacattcaacagataattcctaataaaaactcttaaaagtaggagaaaaaggaaacctgagtccttcctctgaagtggcaggaaaaccagcctgggcaacatagcaagaccttgtctctacgaacacattttttaaattagctgcctgcctgtagtcccagccactcaggaagctgaggcaggaggatcccttaagcccaggagtttgatgttacagtgagctaggtcacaccattgctctccagcctgggtgacaacaaggccctgagaagggaaaaaaaaggaaaggaaaggaaaggaaaaaggaaaagggaaaggaaggaaagagtagaagtattggaaaggaagagacaaaactatcattatttgcatattaaatgataaatgttagccaaagaagcctaagagaatcaactaagattttactggaagtaatgagaattcaatacagtggctatctacaaaatcaagaaatcagcacacaaacctcaaatacttttcccatgtaccaccaataactaattagaaaatggaagaaagatcccatttacaatggcaatacaaatgtatgaagaatttaggaacaaaaatacaaagatcttttatctaacaaaagatgtataagatctatatatggaaacactaaagctcttctgaaagacattaacaagaaatgaatacatgacatgagatagcacgttcctagaatgtcgtacagatgtaaattctcaaattaatctacaaatttaacgtaatcctattcaaatcccaagatagtttttggtggtggctgtttttaagacagggcctagctgtgttgcccaggctagagtgcagtggtacgaccacagctcactgcatcctcgacctcccaggctcaagcgatcctcccacttcagcctctgaagtctctcatatggtgtccaagaaatggtgacaaatctcacaaagggactaggctcagcagggctggaatattcagggaaggtgtcaagaagaaagatgaacttgagttggcttttgagagatgcataggactcccacaggcagagtgaaataagggcattttagatggacaaacacacagacaaaagcagaaatgtgggtggtgtgactggggtttggtgaggggctgctgtggctggaatggagggctgccacaataatggaaatggtaaatgaggcaagtaaggttggactggtggcatagcgtcaaggttgccagctttattaaatcactcttccaatatgctagcactggcctgttgggaaaagtaatacatcatgtaatcgaacaaaagacagaggcaagctccaggaatgggcactgtaaacaggacttgtcccagagtagccagatgtaggctttaggtaagttgatgcaagctgagcatctctaatctgagggggaatgtctcacatggtgtccaagaaatggtgacacatctcacagagggtctaggctcaggagggctagagtatgagacgttccccctcaccagtgaacttaaaaatgtggccaaaaatttttgtaaaagatggctactctgtagtgctttaactggacctatttagacaatgccttacacactggaggacgatactgtgtaaatctaataagtctacaagacaatacgtatgtcttttggctctctccttcctctccagggtgatgacaactccgtgagggtggagattatacctctctcatcatttcagcaacaaggaaataaattagtggcagagtaagggtgacttgatgagtacatccaattgttgacatagttttgggtgggagaaattttcgacttcttaaaatagtctagtgggattcacatggtttcaattcacagagatctgaaagcgaggatcctttaaaaatcctgaaatatacactgcagtaaaagaacaaagcatacacctcagccttaaatgactgaagaagtatgtcaagtagcagcaggtgggaaagtggctttggttttcagtttgtgagctctgaatccacacaaagacaggactgcattctgaaaacctgaattaattattgtccttaccacaatgaggcagaaaagtataatcaaaatcgttagtattccagtaacaattaatgccaagatgagtttgtcagtatagccatatcctggaacttcttttttgagctaaaaaaaaaaacacacaaaaaaaaaaccagaatgagagctaactattcaaaaccccagtattccaggtgagtagctgacaggttcttttttatttttttgaaagagggtctcactctgtcacccaggcttgggtaccgtggtgcaatcaccgttcactagactcgacctccctgggctcaggtgatcctcccacctcagccttccaagtagctgggactacaggcacgtgtcatcaacccagctaattttcttattttttgtggagacaggctttcactatgttggccaagctggtctcaaactcctgacttcaagtaatccacccaccttcgcctcccaaagtgctgagattacaggcgtgagctaccacccccggcctacagttcatcttgtgccctaatctatttctctctctacatgagcaaagtgggagatcactgtcatgaccaaagttacatggccaagataagctatggcctgggagtcccagactcttctgtgtgggcactttcctgggatatgctaaatgatgggaaatctgggtctcatgtttctgtgtggtcctcacctcaagcgacttctctttctgttcactctgggcttctgtgctctcattaatgtagttctcaatcttccattggtccgtatcccattctatcttggatgcctttacttcctgctgcccactgagaagcttcatcaggtggcctgtcctggagatgagcttggcacaggtcacttgcacatgggccccagagcagtccatcttcaaggtccggataacatgagcaatgagccttctcacattgttgttggggataagggactgtagctgctgggttagctgaatttcaaactgatcacctggggacgagagcaatgggtaattgaagcttttgggctcgggggacaggtcagtgcccacgttgttgtattcccattttgtctcagtttgtttaacagttggccctaagttgaatgcagtcccagcggaatctgcctcatgaggatgattgtagtttgtgttttcagagatggttccttctggcatgttagtgttttccataaaatcattttcttcaaaggcatttcttgcagttgtgtgttttgtattattgttttctataaaatgttctgaaggagcagatacttccagaaaagggttttcttgaggactcaggtctcctaaggatgaaaaagccccttgtgaaggggaatttatgaggctcttcgctgcagagaatggaagcctgtttgcgagcatcagtctactcagataacttttctttctgacctttggactctttttgactttgggtgttctgtgggtcacgtgggagcgagttttgtgaaagcggtatttttttctggcatgtacgattggtttagacgtcttcgtatttgtaactctagcctttgcactttctaaaatggaaatagcgtgggttaagtctttccatctgtctctcacctgtggtagggcttttgcagggctggaggtagaaggcgcgcccttggagaagggtttcagcacagagactgctgccttatgctcttgggtgaaggaaggcttggtgtagacggcgtttcccgctaacttctcaggcccctgctgtgtgtggggctgttccacctcccttggggctggactcccgagccttttttcttcggcagcgttctccacagatgcctgggcaccctgttccctcctgatgctctgccttcctacctctttgaagtgccttttctggatgctccttgggcccatgaggactctcttcactctctgccggttttggcctacagtttgaatctttgccaggctgtttcctgtggttggcagtttaatgaacggtagtaacagtgatttcacatctaggtttaccgctgagaaataaggcaagatgtaacttagtgtactgataaaatcactctcgtcattggtgtctagctgctcactcccaaagcctgacaagttgatgccactgctgtctgagggctcctctggctcaacaatcagctcagtgcttgtgtagttcttccgggcttgtaacaccttcatgaacgctccttctggattccctaccgatgcttcttcagctgtcaaaaaagaagagactgctttgatcatgaaagatgatgggatgggatgcatcagtccatagctgtacaccccagtcacacagagtaggagtcagcaaacattcgagtgccattcagagaggagaaacacacacccaatcctaaacctatgaaatggcaacaacaaaaggagaaaatacatcttttgaaaacacggccacctacttggaacattccatagtgtgacatagagtaactctgtttaggattatttcgttgatccccagaggccaattgcccagtgctcagtcaaagcccaaggtggaagacaagtgcttccctgatgagctggcctctctgcagactgctccgtaccctgtgctgtcctgcctcagatgcagagagagcacaaggctcctgctctcctcgtcctcggtgcacctgtgttcgtgctaccatcacagctgaatgcaatgaaaggcggtcctctgagaggagcagggtggagatgctaaagtggaggccccgtcccattgctgatagatcctcatctggcatgcgctccaccctccccattctctgctcccacgtatcgtagccccatcacagaagatgcgacatggaaaaacgcactgtgtccaccctagttcttaaatttgggcagggatttggggtgtatgttaagagtttttcaaatttgccagattgtatgcctatgttgttaaatacacaatgaatccctggtatgatagcagtttctggataaacattacttgaggtcctaaaatgcagaagggaaaaagcaacttttgtcagatgcctactttgctttcatttcatctctaatattttggatggggaatcatccaaagcttctgactgcatgaaggtcaggtgtgccagtgtgcagctgggtttcttttctggaattaaaagtactttgggtggtggtgagggtcagaggaagaagtaaagattgtgagaaaggggaagaaacatgggcttggggagaacccagaattggggccagaagacctggcactaggctacagcacttagcacctctgatcttgtttttcctcatctgtaaaaggaggttaacaaagcttttctgcccacttcttggggagaagggaataacataattggtaaaaaaaaaaaaaaaaaaaaaaagttttgaaaaataagcaacactgactttatgtaaccaagcattattaattctccaccccatatcactggtagatacctgtattcaagctatctggacatgaaagcagtcacattttagaagtcatgaagttgatgctaataagcctaatctacagaaacactcttgaaagcccttgagcgtttgttctgtgaacagaaaggtttgagattcggagcaagttcagagttggatggtctaagaatggaaaagccctccattccattagaagagccaggtagcaatttctggttatggaaccagaagctctcaggcttcaaataaaacagcatcacttgtactcttataaaactgtaaaaacagaaagaccaaaaccgtatctacatctgtcctataaggcagagagtacttgagatctcatggatttaaaaccagcttacaaactacattgcactatatgaagaaattatcactgtgggcaaagcatcaagcagagagcacagtatacagtgtgtggatgttaatgttattccctagccttcccattcctttgtcttggtcctttctgcatatggaacagttctattattaaattttgtaatagtaactgagaacctgactttcagcaagggagtagttcggaaattgagggagtttaactctgaatgagtaaataaaaataaagcaattatgtcattagcttaaaattttatcatcattaaaaataaaaagtttaaaaacaaatacttaatgtaacaatttatcaccgcgcaatttggactcacgacaatgtgtggtgtttgtcagacatgcactgttgcaatgcagcttgactgtcttgcagacagcctcaatgctgtttttaaattggcagaggcagcaggccatatggctaggtaagatcctatagatgaaaacagagagcaataaattagcggtaaagcggttacttgagtaggtaaaggaggcagccaacgctaccacaggtgtgggaaaaaggtgtcattgaagcctatggactggacagttgggtaggaaccagaaggccaataggaaggaggacaaaagtgcccaactgaagggtaagcatggcagtgagtatggtatgcctagaataaagatggttgggattagaattgggtgacagtgattagtagtttcagaagtatctcttcccaattcaaaagtctcactttgggctgaaagtacagaggaagaaggtagacttttaagaagtctgaataagcccccaacttctggagtccctttctcaattcctgttgggagtgggaaatattataaattactctgggcattaaaaatagcttagtttaacctggattgcggagttaaaaaataacaaagactgcattggtcaaatctggacaatttgagcattcaaaagaataacaacaataagttaccacatatttaatataaagaagaatccacgaagagtgatattgaaaaagaaagaggaggagttcttcttcaatgaaataatgccagctagtaaatgtagaaggaatgacagaatttttaaaag

SEQ ID NO: 11257 - DNA, 10085 bp, Homo sapiens
cctgaggagggagttgtggggacctccaatttacagccagttggtcagatgcataggtgatgcttggccttgcacctggggtctgacatgcggatggttctgtgtgactgagcccttaacctgtggagtctggtgctcactctgcttagggcttctcttgcctttttaatgtccttctaggcggcctttccttcctcttgtcagctcagaaaacttttcttccacttcccttcttctaaaccatcccttacatctactcctttccagccgaccaagagcagaaccacggctggttccactgccaccatgctgtcccacactgtctcctcaggatgtattcagatgtccagccctccccccagtctaggagccccccctttgaggaaagggatgctggcctagtcaactctttcccagcaccaggtacagcatctggcacgttccatctttttcatggactctccccaggcggcctgaccttccctcctctgaaccggtgcatttcttgtctgcatcatgtttgccctaatcagatatcaccttatttcctcttttaaaaaatgctttgtttctctggcaggcttcatcggaatcacaattttcattcatttagtaactgttgttgtttattctatgtatttttgcaggaggcctgaggtgggctgtgttctcctcctatggcagggcttcactctcctcctcctccgttggggcttcgctgtccctgggataagaataacaatgccaaggttttcattcttgaaaggagcaattaagcttctcaccccctcctcattttagatgggaactgtgagggccccatcatttacccagggtccctgttgaggatcttgtcctcattagatgacttcttgtgcagcttccatgcatgattatttattcttgtggcactgagaggtttgtacagatctttaaaccagagcggctgtccaaatgaggaaagtccatcctagaagatagaaagggaaatattaattttgcatgtcctctgctttccctggccacagcaatgaatcctccaatgtacctgactctcccttcgcgaagagcatcccctccatggcagaaatctgaaaatgcccctggggagacacatgcacaagacagtgagtgatgcagccgtttcccacgtatctgacaatgtacttctctggtcttattaggactaaatgagtatctcagtccataatcacagggagaaccaccaccacagaccacatacccggggtcttgaaaataattccatgcatgtgggactttcagaagctctccatgtctgcccagaagggccccacaatatactggggggactttgtatgtggctcagcatggagcaggggcaggattttcagtcccactcactcccttggccaagtgcccttgtgcagtgaacaaactgcacaaccatgctgggcagaagcattttatatcagtccccttcggacttagtctcacaggcatcatttgatgggggatgggagatgaagtggttcttcgttttctagatactttattctataagttggatcacctcaagcaaatgcgtgagtgcagctagccaagttctctatctcacagtcttcatatggctggctgtcgctgatgagtgagtgagctacgaaatcagcttaaagcacaacatgttatttttgaatttgaataaaataggaaaaggcagagtgcattgtgtgaccatggggtaagtaagacactctccctttctccttctcagttttcctgtcataaaaggacaaactactatctaaggtctccgtagttaaaattcttttttgttgttttttttttatttgagaaagtttggctcattccccaggctggagtgcaatggtgctatcttggctccctgcaacctgcgcctcttgggctcaagcagttctcctgcctcagcctcccaagtagctgggattacacgcctgcgccaccacacccagcgtaatttagtatttttagtagagatggggtttcaccatgttggtcaggctggtcacgagctcctaacctcaagtgatcccaaagtgctgtgattacaggcgtgagccatcctgcctggcctttctggttaaaattctgtgaggtttgcataaaaggaatagagtaggggcccaaaaaccagtaagatgagaaaatagtgtttcctcagttctaggatccaggggaaaaaaaaagaaataaaagagaaaatactgtttcctgccacttaagaggaaggactcacatatcctaccttccatcagccttgaaggagacaagtgccctctcacacccggtggccttcccttcccctttcccagagcctccaagaaggcccctggcctggcctgatgcccaccatcagcagcaataggcaccaaaacctttctccttcctatccctccccacctcccgaaagggctggggacagcaggtgtgtccttgttagttccatccagctcagctttggctggggagctaatttcactggagccaggctaagcattagggtaagtatttgtcctgtcttgggcagtttcctcactgaaaaatgagggcagagttctaagccctcctctaattctaaaattctaattaaaacgtcgcgagactagtggtgcatgcctgtaatcccagctactcgggaggctgaggcaggagaatcgcttgaacctgggaagtggaggttgccgtgagccgagatcgtgtcattgcactccagcctggcaacaagagggaaactccatctcaaaagagaagaaaaaaaaaatcaccagactaatatttaccttgagaatccttcttcatcttcttgtaatgaccttcggtgacaacatatctgttttagaagaaaacgcaattaagattatctatgacaacaaccaccatctccaaatctgtattgattccttttattcattataagtctcatgtacctgatgaggtaacttttttgaagacaggaattgtatgctgtgtaacactgctttgattcttccatagttcagtcatccttgctatcttgcgggggattggttctaggataccgcccccacaccataccagaatctgtggatgctcaatcccttacatataatggtgtaatatttgcttataaccaacacgcatcccccctatactttatttacttagcgacaggattgccctctgttgcttacgctggagtgcagtgtcatcctctgttactcaggatggagtgcggtgtcacgatcacagctcactgtagcctcaacctcctgggctccagtgatccgcccacctcagcctcttgagtagctgagactacaggtgcatactaccacacctggctattttttttttaatttttaataaagacaaggtctcactatgctgcccaggttggcctcccaatgtgttgggattacaagtgtgagccaccatgcctggccccatgtaatttaagtcatcactaataaaatgtatacatattgtacattgttgacagttgttatattgtactttctgtttgtatttttattggtttttttttcttcaaatattcagcctgatctagttgaatctgaagatgtggacctgctgatgaagagggctgactgtatctaacttagggtcttgcatgcagctggcacttaatacattttattgactgttttagataacattcaacagataattcctaataaaaactcttaaaagtaggagaaaaaggaaacctgagtccttcctctgaagtggcaggaaaaccagcctgggcaacatagcaagaccttgtctctacgaacacattttttaaattagctgcctgcctgtagtcccagccactcaggaagctgaggcaggaggatcccttaagcccaggagtttgatgttacagtgagctaggtcacaccattgctctccagcctgggtgacaacaaggccctgagaagggaaaaaaaaggaaaggaaaggaaaggaaaaaggaaaagggaaaggaaggaaagagtagaagtattggaaaggaagagacaaaactatcattatttgcatattaaatgataaatgttagccaaagaagcctaagagaatcaactaagattttactggaagtaatgagaattcaatacagtggctatctacaaaatcaagaaatcagcacacaaacctcaaatacttttcccatgtaccaccaataactaattagaaaatggaagaaagatcccatttacaatggcaatacaaatgtatgaagaatttaggaacaaaaatacaaagatcttttatctaacaaaagatgtataagatctatatatggaaacactaaagctcttctgaaagacattaacaagaaatgaatacatgacatgagatagcacgttcctagaatgtcgtacagatgtaaattctcaaattaatctacaaatttaacgtaatcctattcaaatcccaagatagtttttggtggtggctgtttttaagacagggcctagctgtgttgcccaggctagagtgcagtggtacgaccacagctcactgcatcctcgacctcccaggctcaagcgatcctcccacttcagcctctgaagtctctcatatggtgtccaagaaatggtgacaaatctcacaaagggaccaggctcagcagggctggaatattcagggaaggtgtcaagaagaaagatgaacttgagttggcttttgagagatgcataggactcccacaggcagagtgaaataagggcattttagatggacaaacacacagacaaaagcagaaatgtgggtggtgtgactggggtttggtgaggggctgctgtggctggaatggagggctgccacaataatggaaatggtaaatgaggcaagtaaggttggactggtagcatagcgtcaaggttgccagctttattaaatcactcttccaatatgctagcactggcctgttgggaaaagtaatacatcatgtaatcgaacaaaagacagaggcaagctccaggaatgggcactgtaaacaggacttgtcccagagtagccagatgtaggctttaggtaagttgatgcaagctgagcatctctaatctgagggggaatgtctcacatggtgtccaagaaatggtgacacatctcacagagggtataggctcaggagggctagagtatgagacgttcctcctcaccagtgaacttaaaaatgtggccaaaaatttttgtaaaagatggctactctgtagtgctttaactggacctatttagacaatgccttacacactggaggatgatactgtgtaaatctaataagtctacaagacaatacgtatgtcttttggctctctccttcctctccagggtgatgacaactccgtgagggtggagattatacctctctcatcatttcagcaacaaggaaataaattagtggcagagtaagggtgacttgatgagtacatccaattgttgacatagttttgggtgggagaaattttgctattatatcgacttcttaaaatagtctagtgggattcacttggtttcaattcacagagatctgaaagcgaggatcctttaaaaatcctgaaatatacactgcaataaaagaacaaagcatacacctcagccttaaatgactgaagaagtatgtcaagtagcagcaggtgggaaagtggctttggttttcagtttgtgagctctgaatccacacaaagacaggactgcattctgaaaacctgaattaattattgtccttaccacaatgaggcagaaaagtataatcaaaatcgttagtattccagtaacaattaatgccaagatgagtttgtcagtatagccatatcctggaacttcttttttgagctaaaaaaaaaaacacacaaaaaaaaaaccagaatgagagctaactattcaaaaccccagtattccaggtgagtagctgacaggttcttttttatttttttgaaagagggtctcactctgtcacccaggcttgggtaccgtggtgcaatcaccgttcactagactcgacctccctgggctcaggtgatcctcccacctcagccttccaagtagctgggactacaggcacgtgtcatcaacccagctaattttcttattttttgtggagacaggctttcactatgttggccaagctggtctcaaactcctgacttcaagtaatccacccaccttcgcctcccaaagtgctgagattacaggcgtgagctaccacccccggcctacagttcatcttgtgccctaatctatttctctctctacatgagcaaagtgggagatcactgtcatgaccaaagttacatggccaagataagctatggcctgggagtcccagactcttctgtgtgggcactttcctgggatatgctaaatgatgggaaatctgggtctcatgtttctgtgtggtcctcacctcaagcgacttctctttctgttcactctgggcttctgtgctctcattaatgtagttctcaatcttccattggtccgtatcccattctatcttggatgcctttacttcctgctgcccactgagaagcttcatcaggtggcctgtcctggagatgagcttggcacaggtcacttgcacatgggccccagagcagtccatcttcaaggtccggataacatgagcaatgagccttctcacattgttgttggggataagggactgtagctgctgggttagctgaatttcaaactgatcacctggggacgagagcaatgggtaattgaagcttttgggctcgggggacaggtcagtgcccacgttgttgtattcccattttgtctcagtttgtttaacagttggccctaagttgaatgcagtcccagcggaatctgcctcaggaggatgattgtagtttgtgttttcagagatggttccttctggcatgttagtgttttccataaaatcattttcttcaaaggcatttcttgcagttgtgtgttttgtattattcttctctataaaatgttctgaaagagcagatacttccagaaaagggttttcttgaggactcaggtctcctaaggatgaaaaagccccttgtgaaggggaatttatgaggctcttcgctgcagagaatggaagcctgtttgcgagcatcagtctactcagataacttttctttctgacctttggactctttttgactttggttgttctgtgggtcacgtgggagcgagttttgtgaaagcggtatttttttctggcatgtacgattggtttagacgtcttcgtatttgtaactctagcctttgcactttctaaaatggaaatagcgtgggttaagtctttcgatctgtctctcacctgtggtagggcttttgcagggctggaggtagaaggcgcgcccttggagaagggtttcagcacagagactgctgccttatgctcttgggtgaacgaaggcttggtgtagacggcgtttcccgctaacttctcaggcccctgctgtgtgtggggctgttccacctcccttggggctggactcgtgagccttttttcttcggcagcgttctccacagatgcctgggcaccctgttccctcctgatgctctgccttcctacctctttgaagtgccttttctggatgctccttgggcccatgaggactctcttcactctctgccggttttggcctacagtttgaatctttgccaggctgtttcctgtggttggcagtttaatgaacggtagtaacagtgatttcacatctaggtttaccgctgagaaataaggcaagatgtaacttagtgtactgataaaatcactctcgtcattggtgtctagctgctcactcccaaagcctgacaagttgatgccactgctgtctgagggctcctctggctcaacaatcagctcagtgcttgtgtagttcttccgggcttgtaacaccttcatgaacgctccttctggattccctaccgatgcttcttcagctgtcaaaaaagaagagactgctttgatcatgaaagatgatgggatgggatgcatcagtccatagctgtacaccccagtcacacagagtaggagtcagcaaacattcgagtgccattcagagaggagaaacacacacccaatcctaaacctatgaaatggcaacaacaaaaggagaaaatacatcttttgaaaacacggccacctacttggaacattccatagtgtgacatagagtaactctgtttaggattatttcgttgatccccagaggccaattgcccagtgctcagtcaaagcccaaggtggaagacaagtgcttccctgatgagctggcctctctgcagactgctccgtaccctgtgctgtcctgcctcagatgcagagagagcacaaggctcctgctctcctcgtcctcggtgcacctgtgttcgtgctaccatcacagctgaatgcaatgaaaggcggtcctctgagaggagcagggtggagatgctaaagtggaggccccgtcccattgctgatagatcctcatctggcatgcgctccaccctccccattctctgctcccacgtatcgtagccccatcacagaagatgcgacatggaaaaacgcactgtgtccaccctagttcttaaatttgggcagggatttggggtgtatgttaagagtttttcaaatttgccagattgtatgcctatgttgttaaatacacaatgaatccctggtatgatagcagtttctggataaacattacttgaggtcctaaaatgcagaagggaaaaagcaacttttgtcagatgcctactttgctttcatttcatctctaatattttggatggggaatcatccaaagcttctgactgcatgaaggtcaggtgtgccagtgtgcagctgggtttcttttctggaattaaaagtactttgggtggtggtgagggtcagaggaagaagtaaagattgtgagaaaggggaagaaacatgggcttggggagaacccagaattggggccagaagacctggcactaggctacagcacttagcacctctgatcttgtttttcctcatctgtaaaaggaggttaacaaagcttttctgcccacttcttggggagaagggaataacataattggtaaaaaaaaaaaaaaaaaaaaagttttgaaaaataagcaacactgactttatgtaaccaagcattattaattctccaccccatatcactggtagatacctgtattcaagctatctggacatgaaagcagtcacattttagaagtcatgaagttgatgctaataagcctaatctacagaaacactcttgaaagcccttgagcgtttgttctgtgaacagaaaggtttgagattcggagcaagttcagagttggatggtctaagaatggaaaagccctccattccattagaagagccaggtagcaatttctggttatggaaccagaagctctcaggcttcaaataaaacagcatcacttgtactcttataaaactgtaaaaacagaaagaccaaaaccgtatctacatctgtcctataaggcagagagtacttgagatctcatggatttaaaaccagcttacaaactacattgcactatatgaagaaattatcactgtgggcaaagcatcaagcagagagcacagtatacagtgtgtggatgttaatgttattccctagccttcccattcctttgtcttggtcctttctgcatatggaacagttctattattaaattttgtaatagtaactgagaacctgactttcagcaagggagtagttcggaaattgagggagtttaactctgaatgagtaaataaaaataaagcaattatgtcattagcttaaaattttatcatcattaaaaataaaaagtttaaaaacaaatacttaatgtaacaatttatcaccgcgcaatttggactcacgacaatgtgtggtgtttgtcagacatgcactgttgcaatgcagcttgactgtcttgcagacagcctcaatgctgtttttaaattggcagaggcagcaggccatatggctaggtaagatcctatagatgaaaacagagagcaataaattagcggtaaagcggttacttgagtaggtaaaggaggcagccaacgctaccacagg

SEQ ID NO: 11258 - DNA, 4377 bp, Homo sapiens
tctcaccccctcctcattttagatgggacctgtgagggctccgtcatttacccagggtccctgttgaggatctcgtcctcattagatgacttcttgtgcagcttccatgcgtgattatttactcttgtggcactgagaggtttgtacatatctttaagccagagcggccgtctgaatgaaaaaagtccatcctagaagatagaaagggaaatactaattttgcatgtcctctgccttccctggccacagcaatgaatcctccaatgtacctgactctcccttcgtgaagagcatctcctccgtggcagaaacctgaaaatgcccctggggagacacatgcacaagacagtgagtgatgcagccatttcccacgtatctcacaatgtacttctctggtcttactaggactaaatgagtatctcagtccataatcacagggagaagaaccaccacagaccacatacctggggtcttgaaaataattccatgcatgtgggactttcagaagctctcccatgtctgtccagaagggccccacaatataatggggggactttgtatgtggctcagcatggagcaggggcaggatgttcagtcccactcactcccttggccaagtgcccttgtgcagtgaacaaactgcacaaccatgctgggcggaagcattttatatcagtcccctttggacttagtctcacaggcatcatttgatgggggggtgggagatgaagtggttcttccttttctagatactttattctataagttggatcacctcaagcaaatgtctgagtgcagctagccaagttctctatctcagtcttcatacggctggctgtcgctgatgagtgagtgagctacgaaatcagcttaaagcacaacatgttatttttgaatttgaataaaataggaaaaggcagagtgcattgtgtgaccatggggtaagacactctccctttctccttctcagttttcctgtcataaaaggacaaactactatctaaggtctccgtagttaaaattcttttttgttgttttttttatttgagacagtttggctcattccccaggctggagtgcaatggtgctatcttggctccctgcaacctgtgcctcctgggttcaagcagttctcctgcctcagcctcccaagtagctgggattacaggcctgcgccaccacacccagctaatttagtatttttagtagagatggggtttcaccatgttggtcaggctggtcacgagctcctaacctcaagtgatcccaaagtgctgtgattacaggcgtgagccatcctgcctggcctttctggttaaaattctgtgaggtttgcctaaaaggaatagagtagggacacaaaaaccagtaagatgagaaaatagtgtttcctcagttctaggatccaggggaaaaaataaataaataaaagagaaaatactgtttcctgccacttaagaggaaggactcacatatcctaccttccatcagccttgaaggagacaagtgccctctctctcacacccggtggccttcccttcccctttcccagagcctccaagaaggcccctggcctgcctgatgcccaccatcagcagcaataggcaccaaaacctttctccttcctatccctccccacctcccgaaagggctggggacagcaggtgtgtccttgttagttccatccagctcagctttggctggggagctaatttcactggagccaggctaagcattagggtaagtaagtatttgtcctgtcttgggcagtttcctcactgaaaaatgagggcagagttctaagccctcctctaattctaaaattctaattaaaacgtcgcgagactagtggtggtgcatgcctgtaatcccagctactcgggaggctgaggcaggagaatcgcttgaacctggtaagtggaggttgccgtgagccgagatcgcgtcattgcactccagcctggcaacaagagggaaactccgtctgaaaagaaaagaaaaaaaaaaatcaccagactaatatttaccttgagaatccttcttcatcttcttgtaatgacttcggtgacaacacatctgttttagaagaaaacgcaattaagattatctatgacaacaaccaccatctccaaatctgtattgattcattttattcattataagtctcatctacctgatgaggtaacttttttgaagacaggaattgcatactgtgtaacactgctttgattcttccatagttcagtcatccttgctatcttgcgggggattggttctaggataccgcccccacaccataccagaatctgtggatgctcaatcccttacacataatggtgtagtatttgcttataaccaacacgcatcccccctatactttatttacttagcgacaggattgccctctgttgcttacgctggagtgcagtgtcatcctctgttactcaggatggagtgcggtgtcatgatcacagctcactgtagcctcaacctcctgggctccagtgatccgcccacctcagcctcttgagtagctgagactacaggtgcatactaccacacctggctatttttttttttaatttttaataaagacaaggtctcactatgctgcccaggttggcctcccaatgtgttgggattacaagtgtgagccaccatgcctggccccatgtaatttaagtcatcactaataaaatgtatacatattgtacagtggtgacagttgttatattgtactttctgtttgtatttttattgtttttttttcttcaaatattcagcctgatctagttgaatctgaagatgtggacctgctgatgaagagggctgactgtatctaacttagggtcttgcatgcagctggcacttaatacattttattgactgttttagataacattcaacagataattcctaataaaaactcttaaaagtaggagaaaaaggaaacctgagtccttcctctgaagtggcaggaaaactagcctgggcaacatagcaagaccttgtctctacaaacacattttttaaattagctgcctgcctgtagtcccagccactcaggaagctgaggcaggaggatcccttaagcccaggagtttgatgttacagtgagctaggtcacaccattgctctccagcctgggtgacaacaaggccctgagaagggaaaaaaaaggaaaggaaaggaaaggaaaaaggaaaagggaaaggaaggaaagagtagaagtattggaaaggaagagacaaaactatcattatttgcatattaaatgaaaaatgttagccaaagaagcctaagagaatcaactaagattttactggaagtaatgagaattcaatacagtggctatctacaaaatcaagaaatcagcacacaaacctcaaatacttttcccatgtaccaccaataactaattagaaaatggaagaaagatcccatttacaatggcaatacaaatgtatgaagaatttaggaacaaaaatacaaagatcttttatctaataaaagatgtgtaagatctatatatggaaacactaaagctcttctgaaagacattaacaagaaatgaatacatgacatgagatagcacgttcctagaatgttctacagatgtaaattctcaaattaatctacaaatttaacataatcctattcaaatcccaagatagtttttggtggtggttgtttttaagacagggcctcgctgtgttgcccaggctagagtgcagtggtacgaccacagcttactgcattctcgacctcccaggctcaagcgatcctcccacttcagcctctgaagtctctcatatggtgtccaagaaatggtgacaaatctcacaaagggactaggctcagcagggctggaatattcagggaaggtgtcaagaagaaagatgaacttgagttggcttttgagagatgcataggactcccacaggcagagtgaaataagggcattttagatggacaaacacacagacaaaagcagaaatgtgggtggtgtgactggggtatggtgaggggctgctgtggctggaatggagggctgccacaataatggaaatggtaaatgaggcaaataaggttggactggtggcatagcgtcaaggttgccagctttattaaatcactcttccaatatgctagcactggcctgttgggaaaactaatatatcatgtaatcgaacaaaagacaaacagaggcaagctccagtaattgtcactgtaaacaggacttgccccacagtagccagatgtaggctttagataagttgatgcaggctgagcatctctattctgagggggaatgtctcacgtgctctccaacaaatcctgacacctctcacaaacgctctaggctcccgagggcta

SEQ ID NO: 11259 - DNA, 1562 bp, Homo sapiens
ttttattttgtcacccaggctgaaatacagtggcaaaattatacctcaatgcagcctcaacccccctgggctcaagggatcctccaaattcagcctcctgagtagctgggagtataggcttgcaccaccatgcccagctaattttttttttttttttgtacttttgtattttcagtagtgacagagtttccccatgttgctcaggctggtgtagaactcctgggctcaagcaatcctcccacctcggccttccaaagtgctgggattacaagtgggagccactgtagccagcaaaataattacaatggagagacctggaagatcaccttagtcaagtgatcaaacttagtattacaggccatctgcggttacgaggcaggaaggatacatcacctatgcagtatttttcccaaaaatgcttaacttgaatttcatcatgaggaaacagacaaatctggattgtgggacaatttacaagacaactatctttgactcttaaaaaatgccagtgtcatgaaagatcaaagaaagtagaggcatgttttagattaaaggaaatgaagacatgacatgcagtgcctgatctttgattggattctgtactattctttcatctttctggcttgtttgaattttttccaatacgtaaatttgggcaaaagaggtgaccgagacaattgattaatttattgttgtggcttattgggggcactttcagagagataaaaacaatccctgtaactgaagtaaaaggttaatcttaggcagtatagcatggtcattaagaatacagattccatagccagactatgcttcaatctcagctctgctaataatgtgaatttgggcaaattgtttaatctctgttccttggccttgtcattataatagtacctacctctaatgaattttgaggatcaaatgaatcaatacctgaaaaatgcctggtgcacagtgagtgctcaataagagttaactataattattgtgttgcagaggttgtggggggccttttctgagtcctccaaaaggatggctttattggggccatattaagactatgaaaacagaagagggtttcatggatacaagaagtctgtgagttgggggtacaatgtatagagttttagattaaaactgcatccaataagttggcctgagacatctttcaaacctataaaggaacaatcacaagtgactagtagtattcctttgggtccagtggaagcctctgatcttcatatggaatggacccggaaccgtaacccagcattttgttgtatagcaaccttacctctgccacaaaggtgtttcttttgtttattttgaggccgggtctcgctctgttacacaggctgagtgcagtggtgcaatcttggctcactgcagcctctgtctcctgtgctcaagtgatcctcccacctcagcctcctgagtacctagaactacaggtgtgtgccaccacacctggctaatttttgtatattttgtagaaatggggtttcaccatgttgtccaggctggtctcgaactcctgggcacaagcaaccctctctctttgg

SEQ ID NO: 11260 - DNA, 992 bp, Homo sapiens
taattgcctatatacaacccttttttgtttgaaatatctagagtaatttctgttttcctatctggggtagtgtaacataagaagaaatatatatttggtctctgcccccagttcctaacacaaagctcctaaaacccttggaaattcctgaatgatggcggtgctaagagcattgtcctttgttaatttatcatttttcttttctcctaggtgttttttcctttttaaacttttcttttaggttagggggtacatatgcacgttcgttatatagctaaacttgtgtcatgggggtttgttgtacagattatttcatcacccaggtaccaagcctagtacccaatagttttttctgctcctctccctcctcccaccctccaccctcaggtagggcccagtgtctgttgtttatgagttctcatcattttgctcccacttaaaagaacatacagtatttggttttctgttcctgtcttagtttgctgaggataatggcctctagctccatctgtgttcctgcaaaagacatgatctcgctgttttttatggttgcacatcttttgttctaacatttggtccttaaacctggttcctgacacagagctcctaaatcccttggaattttctgggtgatagaagcgtcctttgttctcatgaggtgactcttggtgggctccttatttggggactggtcaccaaaaagacctatggttggaagcgttgtgctgtcagccccattccccatcctctggcgtggggagtagagctggagctcaatcatgcctacgtgataaagcctccagaaaactccttaaaagacaggacttggagagcttccgggttggcgaacacatccatgttccaggagagtggtgcaccccaactccacaaggacccttccaaacctcaccctgtgtatctcttcaactggcttcatcatttgtgtcctttaaaatatcctttgtaataaatcagcactagtaagaaaactg

SEQ ID NO: 11261 - DNA, 261 bp, Homo sapiens
gcatggcagtgagtatggtatgcctagaataaagatggttgggattagaattgggtgacagtgattagtagtttcagaagtatctcttcccaattcaaaagtctcactttgggctgaaagtacagaggaagaaggtagacttttaagaagtctgaataagcccccaacttctggagtccctttctcaattcctgttgggagtgggaaatattataaattactctgggcattaaaaatagtttaacctggattgcggagtta

SEQ ID NO: 11262 - DNA, 2269 bp, Homo sapiens
ggccgggcatggtggtgggtgcctgtaatcccagctattcgggaggctgaggcaggagaatcacttgaacctggaaggcagaggttgcagtcaaccgagatcacgctgctgcactccagcctgggtgacagagactgtctccaaaaacaaacaaacaaacaaaacacaaaaaaaaccccaaaacccaaaacaagccaggcgcggtagctcgcacctgtaatctcagccctttgggaggccagggcgggtggattacctgaggtcaggagttcgagaccagcctgaccaacatggtgaaaccccatctctactaaaaatacaaaaattagccgggcatggtggtgcatgcctgtaaccccagctactagggaggctgaggcaggagacttgcttgaacccaggaggcggaggatgcagtgagctgagatcgtgccattgcattccagactgagcaacaagagcaaaactccaccttaaaagaaaaaaaaaaagaaaaaaaaacaaacaaaactcctgaatttccctgtggataccttttctctggcagcctttttcaatgagggctaagttttctccaatactatatggcctgcagaccgctcagctttcattccagtgaaaacattccagaaaaaactctgaatcaatcccaggtgtttctccaatcagctcaggatgattgtgtgttacctgctgcccagccagtgacacctctccaggcctctgacttagctaggtctccaccatgtgactccaccatagactccccaccttcttcttttgcaaagcctcagacacccaaacacctaccaaaagtgggtagggcaccaggacactccaagtgtaagtggggctctccagcacacctggatgtggaggtgtgatgcagagtggtggctgctcgtgacactcatttcacccctttctgtgcaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtggtaaagtagcctgaaagccagtggtgcaaccccatccccacaaccttcaccacctctagcacctccagtgataagcactaattgcctatatacaacccttttttgtttgaaatatctagagtaatttctgttttcctatctggggtagtgtaacataagaagaaatatatatttggtctctgaccccagttcctaacacaaagctcctaaaacccttggaaattcctgaatgatggcggtgctaagagcattgtcctttgttaatttatcatttttcttttctcctaggtgttttttcctttttaaactttccttttaggttagggggtacatatgcacgttcgttatatagctaaacttgtgtcatgggggtttgttgtacagattatttcatcacccaggtaccaagcctagtacccaatagttttttctgctcctctccctcctcccaccctccaccctcaggtagggcccagtgtctgttgtttatgagttctcatcattttgctcccacttaaaagaacatacagtatttggttttctgttcctgtcttagtttgctgaggataatggcctctagctccatctgtgttcctgcaaaagacatgatctcgctgttttttatggttgcacatcttttgttctaacatttggtccttaaacctggttcctgacacagagctcctaaatcccttggaattttctgggtgatagaagcgtcctttgttctcatgaggtgactcttggtgggctccttatttggggactggtcaccaaaaagacctatggttggaagcgttgtgctgtcagccccattccccatcctctggcgtggggagtagagctggagctcaatcatgcctacgtgataaagcctccagaaaactccttaaaagacaggacttggagagcttccgggttggcgaacacatccatgttccaggagagtggtgcaccccaactccacaaggacccttccaaacctcaccctgtgtatctcttcaactggcttcatcatttgtgtcctttaaaatatcctttgtaataaatcagcactagtaagaaaactg

SEQ ID NO: 11263 - DNA, 2736 bp, Homo sapiens
gccaccatgcccggcctagattaaaaatttgaagacatattctctactatgagccaatgaaattactcattttgtttctatcccatttgctgtcccttgcttttggaattttgtgtcttagtgtgactgtgattctttctctccttttgtctttcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactgtatcccagcgggttgccctttaaaaaccccccgtgtggtcctccctggaaggtgttacgtgtggctcgggcacaggaggcgtgtcaccctgtgcagtgcacacactggctcctctgtctttgcgagagcttggtttctattcctggtgcacgtcggatcgtccacgggttagttccagtgccacccatggcagtaggcgtggtgaggcgcacagacacggtgtggggttcaccctgacgtggttcagcagagggtcgtgacatagcgtagaccagggatgcttaggtgaggaggtggaacccacaaaatcccattgcttttcacactgcagggctgccccgttatttcctttgcaggttggtgtgcgtgcgtgtgtgcgtgcgtgcctgatacacatggagccgggctgcttcacacatctggtgaggtcgttagaaggtcagataaagaagagggcggagcttgctaaccaagctgttagaagaaataatgggagagaacattccttcatttcaggaggacacagagcaggctaggtctgccgcgaagactcctatagagagaagagtattcttaaactagattctgatggacgcaacaccagttgcataatggttatgacaatcagtgcccgggtttttgaccaggcatttcatggtcacccccacgctaatggaaagtttctggatcttattttgttatagtgagtgatttgtagttttcagaacggaggccaggccaaacgtattccaaatgaaaagagaataggtgtcaaatgctaaaccttttatcttcgtgttggcactgttgccatccccgccctctcccgacatccccgcccttgaccagcatctctggccttgcccagcattgtctatgtattggcactcttgccatccccgccctttcccagcagagtctcactgtgtcaccccggctggagtgcagtggcgagatcttggctcactgcagactcactgcaacatccacctcccgggttccagtgattctcctgcttcagcctcctgggtagctgggattacaggcacgcgccaccacacctggctaatttttgtatttttagtagtcacagggtttcaccatgttggccaggctggtcttaaactcctgacttcaggtgatccaccctcctcgtcctcccaaagtgctgggattacaggcgtgagccaccatgctcagccctactcttgtattttttttttttttttttttttgagatggagtcagagtctcaccctgttgcccaaggtggagtgtagcggcttgatctcagctcactgcaacctccccctcccaagttcaagcgattctctgcctcagcctcccgaatagctgggattacaggcatccgctgtcatgcctggctaatttttgtatttttagtagagacgggggtttcaccatcttgaccaaactggtcttgaactcttgacctcgtgatccagctgcctcggcctctcagagtgttgggattacaggcgtgagccaccatgcctggcctcttggaatatttaataagctaaaaaattcttatacacaggtagattaattaggtagccaggagtggcccctgaaagtatgtctggcaaaacctagaactgcatcctagccatcactgtaccttctgccctccctgctgtctcctctgccagttacagttaaaaggttgtgggtgaggacgctgggcagagtcccaggcgtctgctgtcagctccccagcccggcctgcctgccgagccatctgggcgtcccacggtggagagtgtggtgcttgtgacgcggtggtgctgggagccatcctggtggcagatgtgggctctcactgcaagtcagtgtaagtccccagggactgtcagcagcacgtcctgctgcccctctctctgcagaagccctggtaacctgcgtttggaaaaatctctaaggatttctgaggagctgtcaggccatgtccttgtccaccctgtgtggggcacggcttcgacatggctctgctcccgtcgtgggctgagaaggagcaggtggggctgtgccttggaaaggaggccctcccgacatgcctttgtgcgaggtccctgtccatgctgtctccatcccggagccttacggcgatgggtggccacagagcctattccaagagtctggtttagggctgggtcttcccatcttcacctctgagtcttaggcgatgcgtgaccacgcagccccttccaggagtctggtttagggctgggtcttcccatcttcacctctgagtcttaggcggtgcatgaccacgcagccccttcccggagtctggtttagggctgcgtgctcaagagtctggtttggggctgggtcttcccatcgccctggaggaggcttttgtctcatctcatgattcacattaaactctgtgccatgaagcttagcctga

SEQ ID NO: 11264 - DNA, 277 bp, Homo sapiens
ctgtcgcccaggctggagtgcagtggtgctatctctgctcactgcaagctccgcctcccgggttcacgccattctcctgcctcagcctcccgagtagctgggactacaggtgcccgccaccgcgcccggctaattttttgtatttttagtagagacgggttttcaccgtgttagccaggatggtcttgatctcctgccttcatgatccgcctgccttcatgatccgcctgccttcatgatccgcctgccttggcctcccaaagtgctgggattacag

SEQ ID NO: 11265 - DNA, 5060 bp, Homo sapiens
ccgggattcgccctccggggagcgattggtcctcgggaggggcggggaggtggacgcgggtaccggcggtcgtcgggtcggcagcctttggtcagttggcagcggcaagcgcgctgcggttccggtggcgccatgtcgttctgcagcttcttcgggggcgaggttttccagaatcactttgaacctggttggtcctgcggcctctcgctgggagggcagcgcggcggggggcgcgcattagcgggggcgccgccgtcgtccgggggtgatgtctctcccaagccgggaatgggggcgaatgtggctgccggggagaagcgaacaggggtcaaaaggactgcggaggagtggggagcctgggggcgaggagagtggggtacccgaggagagggggccttggggctcaccgtcctggagggggcaggcctcgagtgtgaacgtgccgtttcgggggtgggtctaagggatcgggatacgtgggggtggtaccccttccctaccccctacactccaaagtgatggcgctgggggaattcgggttagggtcggggcttcggagaggccaggttcttgtccagggccagctcctgtggccggggcgccccttcgcgggtcatcccgcaggtgttaccctggcccttcccattcccccgagtccgggatctctgggaggagtctggcaagcatagaatgtccccttcagatcctaatgtgccggcccaggtgcctccccacctgcccagggactccaaattggggaaccaggagtgccaccaggcacctgccaacagcccgtgaagtttgaccaggcaggcaggatggggtggtttggggcatggccagccctccacactggccctgatgaatcccttctgggctgggctcgcctggtagtggactaatttggtaaaaacacatccacaggcaagtctgagtgcactggtctccttgggcggatctgctgggtggcacccctgtagcgggttgggctgtgacacaggaccatcccggcaaagcctcccccagcaagactctctggctttagatcccagttgtcctcaggctgctctgccaagccagaaactccacttccacagcagctgctggcttctctttgcttttttctccagttcctggaaaaggctgggtagtttacagtctccaggggaggctgtccccaggtgatgggtgagaggtgactcagcacccctggaggttcctgttttcagtccttaaaacagttctgcaagtcagttttgcaactttcccaccccctccactccaaagggatcctttgtgggtaggctgaaatctgttgtccccagccctctttcttcctgggctcctgtgtggcctggaggccttttctctgggactgttctcttcctgcctggagagcagagcagtgcctgggtatccagcttagggcctcgttgggcagcagggaggaccacttgagaaaggagagggaccaggtggttgggccacatcagggcccctgccctctatgttcctgggggaactaggggggcgagggggagctccgtgtcctcattggactacccaggttccttcacgctgcacacacttgtagctgagtgtctgcatcaccaagcaaagatggaaatgttaggatatgccccgtcacggggctatgagaagaatcaaggagataattgtgaaaggtgactcccctggtctctggcacatctactaaacgtgagctcagcacagcgcctcccgtggcgggtgcctggggaaggagcacagcctaccctcggaacgggggcagcgctgtctttgcctgggttggtggatttgggagcttgaccccggaaaggcgggagctgatgactccacatttgcctctccttccaccacaggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggtgagaggccacaggggtgggggagggacgggggcggccagggagagcagagagccagtcccaccttcctccctctgcttgccccacagctccaggggcttagaggcgtctattccaggcctgttgcctctgccagggagctgccaccccaggctatcgggagagcctggccttctggtgcaaatgtgggaaacaggacaggtttcctgtacgggctccaggacaaaggtcaacctcttatgtcggcggtcagcttgggaaataggcgtgtgggaagaaacaccatctgccagccccagtaagggccttcactgtggctgtatcatggccagaagctcacccagctgccttgtgatctttccaggtgtcctgtggcaagtgtggcaatgggttgggccacgagttcctgaacgacggccccaagccggggcagtcccgattctgaatattcagcagctcgctgaagtttgtccctaaaggtgagcttgctttgcacagctggggccaggcctgttggcctttgagcccaggctggggggcccagtgtttgtgcttgtccacttaccatgacaaggtatggggccaccaagtcacgctgcctgggaactgtccaggatcccccagaaaggtggctgcagcgcaggggcaaaggagctggtgttccgcttcctcgcttggttgatcatgactgtcccaaaaaggggcttcagcgtgagaatgtggcaaatggttttcctcagaggcctggcctttcccagaggctagagtcaggggcggggcaggcagagcctgaggccccagtctgtgcggctgtgtctcccactggctaggactgtggccttgcttcttagccgctcagagcctgcctcctcctctgcagagtggcggtggtagcagggctgtgaggacagctgcgtgtcacgtgcacctgggcctggcacacaataatagcttgatgaatcctcatcctttttttttttttttctgagatggagtcttgctctgtcgtgcaggctggtgtgcagtggcgcgatctcagctcactgcaacctctgcctcctggttcaagcaattctcctgtcttggcctcccaagtagctgggattgcaggcacgcatcaccacgcccagctaatttttgtatttttagtagatacggggtttcaccatggtggccaggctggtcttaaactcctgacctcaggtgatctgcccaccttggcctctcaaagtgctcgaattataggcatgagccaccacgcccagcccacacctggttaatttttaattttttttttttttttggtgacagagtcttgttctgtcacccaggctggagtgcaatggccaatctcagctcaatgtagcctctgcttcccaggttcaagtgattcttctgcctcagcctcccgagtagctgggattacaggctcccactaccgcgcctggctaatttttgattttttagtagagacggggtttcaccatgttagccaggctggtctggaactcctgacctgaggtgatctgcctgtctcaacctcccaaagtgccgggattataggcgtgagctaccgcacccagccaatttttaaaatttttatagagatgggggtctcactatgtggcccaggctggtcttgaactcctctgggccttggcctcccaaggtgctgggattacaggcttgagccactgcctcgcctgaaatggggctgttaacagcacacgcttgtggccatcaccgtgctgtggggttgagcgagcagcctgtcaggatctggtgcgtggtaaacctgcgatgttttcgtccttttgttgttatttgtcctccgtgtgagtggagggagaagagattctgggttctcctgtggatgtcagaacaaaatggggtacacagactcccctgagtcgggcatctggtcttttcagctcccctgtggcctgcaggccagggcagagtgtgaaagcgcagggaacggcacctgaagctctgccttgcagtgacttgctttctgcccctaccctggctttccaccgcccccgcgcccggctttccgcccctgcttgctttctgtccccgcatactttccgccccctctcctctctttcaggcaaagaaacttctgcctcccagggtcactaggcgggcagcccacacccaccccagacggccaccacactgaggccacacgttggccattccaccttggagttggaaccctgggcgtcgagacaggaaggcagggcgcagtggttgaaacatcaggacactcccaaggccccggctctgaacaagaccttttcgtttcttggaaaagagactcatttgctgatggttcatgccttctgctgggacaggcctgggctgtgcagccacactgtcggctgacttagccccctgctcactctaggtgcctccaggaggtgagccctgggtgcagctggtctctgaatgacgttacaccctcaccttcttttcctggccctgtctctggactctcccctgtgaggcccaattccaagacagactctcgtcctcaccgaagcttaggcccacatctcccaggctgcttaggagacagaatggaaacggaggccgcccctgccagccgccctggccctggtcactgcatgatccgctctggtcaaacccttccaggccagccagagtggggatggtctgtgacctgctgggaaggcaggctgatggggcacacccttggcctctcgtccacgaggggagaaacctaaaccctgtttcacaatctgtgcggaagtagcttgcctcacttctgcttaggaaagcggctgttgctccataactctaaccagcacagggctgaggcctgcagtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgaaacattcagatgta

SEQ ID NO: 11266 - DNA, 5060 bp, Homo sapiens
ccgggattcgccctccggggagcgattggtcctcgggaggggcggggaggtggacgcgggtaccggcggtcgtcgggtcggcagcctttggtcagttggcagcggcaagcgcgctgcggttccggtggcgccatgtcgttctgcagcttcttcgggggcgaggttttccagaatcactttgaacctggttggtcctgcggcctctcgctgggagggcagcgcggcggggggcgcgcattagcgggggcgccgccgtcgtccgggggtgatgtctctcccaagccgggaatgggggcgaatgtggctgccggggagaagcgaacaggggtcaaaaggactgcggaggagtggggagcctgggggcgaggagagtggggtaccctaggagagggggccttggggctcaccgtcctggagggggcaggcctcgagtgtgaacgtgccgtttcgggggtgggtctaagggatcgggatacgtgggggtggtaccccttccctaccccctacactccaaagtgatggcgctgggggaattcgggttagggtcggggcttcggagaggccaggttcttgtccagggccagctcctgtggccggggcgccccttcgcgggtcatcccgcaggtgttaccctggcccttcccattcccccgagtccgggatctctgggaggagtctggcaagcatagaatgtccccttcagatcctaatgtgccggcccaggtgcctccccacctgcccagggactccaaattggggaaccaggagtgccaccaggcacctgccaacagcccgtgaagtttgaccaggcaggcaggatggggtggtttggggcatggccagccctccacactggccctgatgaatcccttctgggctgggctcgcctggtagtggactaatttggtaaaaacacatccacaggcaagtctgagtgcactggtctccttgggcggatctgctgggtggcacccctgtagcgggttgggctgtgacacaggaccatcccggcaaagcctcccccagcaagactctctggctttagatcccagttgtcctcaggctgctctgccaagccagaaactccacttccacagcagctgctggcttctctttgcttttttctccagttcctggaaaaggctgggtagtttacagtctccaggggaggctgtccccaggtgatgggtgagaggtgactcagcacccctggaggttcctgttttcagtccttaaaacagttctgcaagtcagttttgcaactttcccaccccctccactccaaagggatcctttgtgggtaggctgaaatctgttgtccccagccctctttcttcctgggctcctgtgtggcctggaggccttttctctgggactgttctcttcctgcctggagagcagagcagtgcctgggtatccagcttagggcctcgttgggcagcagggaggaccacttgagaaaggagagggaccaggtggttgggccacatcagggcccctgccctctatgttcctgggggaactaggggggcgagggggagctccgtgtcctcattggactacccaggttccttcacgctgcacacacttgtagctgagtgtctgcatcaccaagcaaagatggaaatgttaggatatgccccgtcacggggctatgagaagaatcaaggagataattgtgaaaggtgactcccctggtctctggcacatctactaaacgtgagctcagcacagcgcctcccgtggcgggtgcctggggaaggagcacagcctaccctcggaacgggggcagcgctgtctttgcctgggttggtggatttgggagcttgaccccggaaaggcgggagctgatgactccacatttgcctctccttccaccacaggcgtttacgtgtgtgccaagtgtggctatgagctgttctccagccgctcgaagtatgcacactcgtctccatggccggcgttcaccgagaccattcacgccgacagcgtggccaagcgtccggagcacaatagatctgaagccttgaaggtgagaggccacaggggtgggggagggacgggggcggccagggagagcagagagccagtcccaccttcctccctctgcttgccccacagctccaggggcttagaggcgtctattccaggcctgttgcctctgccagggagctgccaccccaggctatcgggagagcctggccttctggtgcaaatgtgggaaacaggacaggtttcctgtacgggctccaggacaaaggtcaacctcttatgtcggcggtcagcttgggaaataggcgtgtgggaagaaacaccatctgccagccccagtaagggccttcactgtggctgtatcatggccagaagctcacccagctgccttgtgatctttccaggtgtcctgtggcaagtgtggcaatgggttgggccacgagttcctgaacgacggccccaagccggggcagtcccgattctgaatattcagcagctcgctgaagtttgtccctaaaggtgagcttgctttgcacagctggggccaggcctgttggcctttgagcccaggctggggggcccagtgtttgtgcttgtccacttaccatgacaaggtatggggccaccaagtcacgctgcctgggaactgtccaggatcccccagaaaggtggctgcagcgcaggggcaaaggagctggtgttccgcttcctcgcttggttgatcatgactgtcccaaaaaggggcttcagcgtgagaatgtggcaaatggttttcctcagaggcctggcctttcccagaggctagagtcaggggcggggcaggcagagcctgaggccccagtctgtgcggctgtgtctcccactggctaggactgtggccttgcttcttagccgctcagagcctgcctcctcctctgcagagtggcggtggtagcagggctgtgaggacagctgcgtgtcacgtgcacctgggcctggcacacaataatagcttgatgaatcctcatcctttttttttttttttctgagatggagtcttgctctgtcgtgcaggctggtgtgcagtggcgcgatctcagctcactgcaacctctgcctcctggttcaagcaattctcctgttttggcctcccaagtagctgggattgcaggcacgcatcaccacgcccagctaatttttgtatttttagtagatacggggtttcaccatggtggccaggctggtcttaaactcctgacctcaggtgatctgcccaccttggcctctcaaagtgctcgaattataggcatgagccaccacgcccagcccacacttggttaatttttaattttttttttttttttggtgacagagtcttgttctgtcacccaggctggagtgcaatggccaatctcagctcaatgtagcctctgcttcccaggttcaagtgattcttctgcctcagcctcccgagtagctgggattacaggctcccactaccgcgcctggctaatttttgattttttagtagagacggggtttcaccatgttagccaggctggtctggaactcctgacctgaggtgatctgcctgtctcaacctcccaaagtgccgggattataggcgtgagctaccgcacccagccaatttttaaaatttttatagagatgggggtctcactatgtggcccaggctggtcttgaactcctctgggccttggcctcccaaggtgctgggattacaggcttgagccactgcctcgcctgaaatggggctgttaacagcacacgcttgtggccatcaccgtgctgtggggttgagcgagcagcctgtcaggatctggtgcgtggtaaacctgcgatgttttcgtccttttgttgttatttgtcctccgtgtgagtggagggagaagagattctgggttctcctgtggatgtcagaacaaaatggggtacacagactcccctgagtcgggcatctggtcttttcagctcccctgtggcctgcaggccagggcagagtgtgaaagcgcagggaacggcacctgaagctctgccttgcagtgacttgctttctgcccctaccctggctttccacagccgccgcggccggctttccgaccatgcttgctttctgactcagcagactttccgccccctctcctctctttcaggcaaagaaacttctgcctcacagggtcactaggcggtcagcccacacccaccccagacggccaccacactgaggccacacgttggccattccaccttggagttggaaccctgggcgtcgagacaggaaggcagggcgcagtggttgaaacatcaggacactcccaaggccccggctctgaacaagaccttttcgtttcttggaaaagagactcatttgctgatggttcatgccttctgctgggacaggcctgggctgtgcagccacactgtcggctgacttagccccctgctcactctaggtgcctccaggaggtgagccctgggtgcagctggtctctgaatgacgttacaccctcaccttcttttcctggccctgtctctggactctcccctgtgaggcccaattccaagacagactctcgtcctcaccgaagcttaggcccacatctcccaggctgcttaggagacagaatggaaacggaggccgcccctgccagccgccctggccctggtcactgcatgatccgctctggtcaaacccttccaggccagccagagtggggatggtctgtgacctgctgggaaggcaggctgatggggcacacccttggcctctcgtccacgaggggagaaacctaaaccctgtttcacaatctgtgcggaagtagcttgcctcacttctgcttaggaaagcggctgttgctccataactctaaccagcacagggctgaggcctgcagtgcacacctgcagggaggcccttcccaaggtgtggtgactgtgccttactgtacatgctcggaggcctggccatataggagggtgggtgatgctgaaatcaccccccatcttaagtaattactttctggagtaatcaggtggaaatccatagacaaatgaaacattcagatgta

SEQ ID NO: 11267 - DNA, 1662 bp, Homo sapiens
agctccaggggtcagggagggggactcaggagggcttagctcagcagtgatgggcacagcatgtgcacaggctcagcacacatggggcctgccccaggccctggagggcacggaacaaggctccacaagaaatgcaccattttcccaatttatacccacagaaatccggggagcatgtgggagtggattttaagggtggatgtttcaccctgcagaacccacagctggcatcgccccaaaagcggtggccaggagtgccccaaagggcacaggatggccccaaagcattgcaagatggggccagttgggatctgaactaaggaacgctaaacgccagggtgagcactccagagcatttattagggggacttacagaaggccgcagcgtatccttgcaacaaaagcgagagagaagaggtgccctcccttgatatctctgcagcaaggggacacggtgtggagtggatatggaagtttaagggatttggctcagggctgggccagtttctttcagtgttttagcccacaacctagatttttttttttttttttttttttggagacagagtcttggtctgtcatttaggctggagtgcagtggtgagatctcggctcactgcagcctccgtctcacgcctgggttcaagcaattcttgtgcctcagcctcttgagtagctgggattacaggcgctcgccagtatgcctggctaatttttgtatttttagtagagatagggtttcgccatgttggcgaggctgatctcgaacactgcacccagcctagaattttttaatttaatttttaaaaaattagagatagggccttaccatctcacccaggctggtcttgaattcctaggctcaaacaatcctcctgcctcagtcccccaaagtgctgggattacaggcgtgagccacatgcctggctgcactttgtgattcttggtcaggacacagaaagaaagcaggggaggccaggtgtggtggctcatgcccgtcatcccagcactttgggaggctgagatgggtggatcacctgaggtcgggagttcaagaccagcctggccaacacggtgaaaccctatctctactaaaaatacaaaaattagctgggtgtggtggcgcatgcctgtaatcccagctacttgggaggctgagggatgagaatcacttgaatctgggaggtggaggttgcagtgagctgagattacaccactgcactccagcctgggcgacagagcgagactctgtctcaaaaaaaaaaaaaaaagaaaagaaaagaaaaaaaaagcagggggaaccaggagaccctacagtagggataatggggaaaggaacaaaaaattgggtcaggttgcgtttattgatacgggcccactaagcagaggttctggacctcgtgctaccactgctggggtttgactggttggttggtgagctacaacacagaccaaaaagtgacctacacaaagtgaggctgaaatgccaggcctgcctctctgcgtggcagaggatgggactcaaaggcttggggaggttggagtgtcagagtggatttatcttttgagacctactcacccacccctggagaggagagaggacacacctcttaccacccccacgagaaataaatttgtgaggggaacactcctccttcatga

SEQ ID NO: 11268 - DNA, 547 bp, Homo sapiens
agatcagatgagccagtttatcaatctggttggtgccagcagatccatcaagttgcagggtcggcaaaatatctcaagcactgatcttaggggcagcttagggagggtcagaatcttgtagcctccagatgcacgactcctaaaccataattcccaatattgtggctaatgttagtcctaaaaatgcaatctagtccccaggcaaggaggtggtctgctttgggaaagggctgttactgtctttgttttaaactataaactggctgggcgcggtggctcacgcctgtaatcccagcactttgggaggccaagatgggcggatcacctgaggtcgggagttcaagaccagcctggccaacatcgagaaacctcgtctctattaaaaatacaaaattagctgggcgtggtggcgcatgattgtaatcccatctactcgggaggctgaggcaggagaattgcttgaaccagcgagttggaggttgcagtgagctgagatcgcgctactgcactccagcctggaaacagagtaagactccgtctcaaaaga

SEQ ID NO: 11269 - DNA, 1662 bp, Homo sapiens
agctccaggggtcagggagggggactcagaagggcttagctcagcagtgatgggcacagcatgtgcacaggctcagcacacatggggcctgccccaggccctggagggcacggaacaaggctccacaagaaatgcaccattttcccaatttatacccacagaaatccggggagcatgtgggagtggattttaagggtggatgtttcaccctgcagaacccacagctggcatcgccccaaaagcggtggccaggagtgccccaaagggcacaggatggccccaaagcattgcaagatggggccagttgggatctgaactaaggaacgctaaacgccagggtgagcactccagagcatttattagggggacttacagaaggccgcagcgtatccttgcaacaaaagcgagagagaagaggtgccctcccttgatatctctgcagcaaggggacacggtgtggagtggatatggaagtttaagggatttggctcagggctgggccagtttctttcagtgttttagcccacaacctagatttttttttttttttttttttttggagacagagtcttggtctgtcatttaggctggagtgcagtggtgagatctcggctcactgcagcctccgtctcacgcctgggttcaagcaattcttgtgcctcagcctcttgagtagctgggattacaggcgctcgccagtatgcctggctaatttttgtatttttagtagagatagggtttcgccatgttggcgaggctgatctcgaacactgcacccagcctagaattttttaatttaatttttaaaaaattagagatagggccttaccatctcacccaggctggtcttgaattcctaggctcaaacaatcctcctgcctcagtcccccaaagtgctgggattacaggcgtgagccacatgcctggctgcactttgtgattcttggtcaggacacagaaagaaagcaggggaggccaggtgtggtggctcatgcccgtcatcccagcactttgggaggctgagatgggtggatcacctgaggtcgggagttcaagaccagcctggccaacacggtgaaaccctatctctactaaaaatacaaaaattagctgggtgtggtggcgcatgcctgtaatcccagctacttgggaggctgagggatgagaatcacttgaatctgggaggtggaggttgcagtgagctgagattacaccactgcactccagcctgggcgacagagcgagactctgtctcaaaaaaaaaaaaaaaagaaaagaaaagaaaaaaaaagcagggggaaccaggagaccctacagtagggataatggggaaaggaacaaaaaattgggtcaggttgcgtttattgatacgggcccactaagcagaggttctggacctcgtgctaccactgctggggtttgactggttggttggtgagctacaacacagaccaaaaagtgacctacacaaagtgaggctgaaatgccaggcctgcctctctgcgtggcagaggatgggactcaaaggcttggggaggttggagtgtcagagtggatttatcttttgagacctactcacccacccctggagaggagagaggacacacctcttaccacccccacgagaaataaatttgtgaggggaacactcctccttcatga

SEQ ID NO: 11270 - DNA, 547 bp, Homo sapiens
agatcagatgagccagtttatcaatctggttggtgccagcagatccatcaagttgcagggtcggcaaaatatctcaagcactgatcttaggggcagcttagggagggtcagaatcttgtagcctccagatgcacgactcctaaaccataattcccaatattgtggctaatgttagtcctaaaaatgcaatctagtccccaggcaaggaggtggtctgctttgggaaagggctgttactgtctttgttttaaactataaactggctgggcgcggtggctcacgcctgtaatcccagcactttgggaggccaagatgggcggatcacctgaggtcgggagttcaagaccagcctggccaacatcgagaaacctcgtctctattaaaaatacaaaattagctgggcgtggtggcgcatgattgtaatcccatctactcgggaggctgaggcaggagaattgcttgaaccagcgagttggaggttgcagtgagctgagatcgcgctactgcactccagcctggaaacagagtaagactccgtctcgaaaga

SEQ ID NO: 11271 - DNA, 2036 bp, Homo sapiens
ggattgtaacacatgacaaagtttgagaactactgacaggaagagtcctgctgctgagttctaggcccagttctgtcactggctcactaaatgacttcaggcatgtccctctcctattttgaacttcagttttctcttctgtgaaatgaaagccttggactaggcagcgtctaaaggctctgtcactccgtaattgtgtgactttggtaactttgtttgacttctccttgcttaagttttctcatatgggtatggtaaggaaaatacctacctcacaggattttctaacaattttgtgattattaagtatgatgactgatgactaatatatgacagccagctcttacacagtgctttctatatcctggactgttgtaagtgcttttaatccccgcaacaatcccatctccattttacaaatgaaaaatagaggtcacacggctaatacgtgtcagagtttggattaaaacccagaaaaatctgtccccagagacaatgattttaactagcatgcccttttgctcaataaatgttaattccctcaccctttccacacacacacagtctagctgaccattcatagacaataatcccactttcacagtccatccaacaagatcttaaaagaaccatgagaatctctaggtttcttttgcaaatagttttcaagcatttaaaaaaaaaaggtggggggcggggagggagtggccaagatggctgactagaagcagctaggatgagtggttctcatggaggggaaggaaaggggcgagtaaatacagcgccttcaactgaaacatccaggtacccacattgggtctaatcaaggaaacaactcgatccacagagaatgaagaaaagcaaggcaggatgacagcccacccaggagcaacatggagacagaggaacctcctccacccagggaagtcgtaagtgaatgtgcgatcctgggaaaccacgctcctcccatggatccttgcaacccttgggtcaggagatcccctggtgaacccactccaccagggccttcagtctgacacacagagatacatggagtctcagcagagtagccgcttgagcacgtgcagagacccagcagctttacatactccggccctgggtttcccagcaaaagtaactgcaactcctgcaaagcgggagattagacccctgtacatacccctaggaaagaggctgaatccagggggccaagcggcacgatctgcgggccccacttccactgcacctcacaggataagacccactggtttggaattccagccagccaccagcagcagtgttgcacctacctgggacggaggtcccagggggaagggcaggctgctctctgggacagagctcccagaagtggtaccccagaacagcacagcacagctgctcttcagaagcatggccagactgcttctttaagcaggtgcccaatctgttcctcctcactgggtgggacttttcaaccaaggcctccagcaacccctactggtgttctctggctgacagagatttgaattctccctgggacagagttcccggagggagggaggggccaccatctttgctgtttgggcgacttagctgttccggcctccaggctttggagagcccacaccaaccaggggtggaagcagtgccccagcacagcacagctgatctgtgaaagcatggacagactgcttctttaagcagttccctgatcccgttcctcctgactgggtgagacctcccaaccagggtctccagccttgtcctgcaggcgcatttgggctggcaacaggtctgtacctcgctgggccggagctcccagaggaagaggcaggatgacatctttgctgtttcacagccttcactggtgatagctccaggtactggaaaatccaaggagactaggaaatggagaagaagcccagcaaagtacagcagccctacagaaacatggccagactgtagaaagaaaaaaaaaatccaaaggtcagcaacctcaaagattgaaggtagataagcccacaaagtgagaaaga

SEQ ID NO: 11272 - DNA, 2632 bp, Homo sapiens
aggaagagtcctgctgctgagttctaggcccagttctgtcactggctcactaaatgacttcaggcatgtccctctcctattttgaacttcagttttctcttctgtgaaatgaaagccttggactaggcagcgtctaaaggctctgtcactccgtaattgtgtgactttggtaactttgtttgacttctccttgcttaagttttctcatatgggtatggtaaggaaaatacctacctcacaggattttctaacaattttgtgattattaagtatgatgactgatgactaatatatgacagccagctcttacacagtgctttctatatcctggactgttgtaagtgcttttaatccccgcaacaatcccatctccattttacaaatgaaaaatagaggtcacacggctaatacgtgtcagagtttggattaaaacccagaaaaatctgtccccagagacaatgattttaactagcatgcccttttgctcaataaatgttaattccctcaccctttccacacacacacagtctagctgaccattcatagacaataatcccactttcacagtccatccaacaagatcttaaaagaaccatgagaatctctaggtttcttttgcaaatagttttcaagcatttaaaaaaaaaaggtggggggcggggagggagtggccaagatggctgactagaagcagctagggtgagtggttctcatggaggggaaggaaaggggcgagtaaatacagcgccttcaactgaaacatccaggtacccacattgggtctaatcaaggaaacaactcgatccacagagaatgaagaaaagcaaggcaggatgacagcccacccaggagcaacatggagacagaggaacctcctccacccagggaagtcgtaagtgaatgtgcgatcctgggaaaccacgctcctcccatggatccttgcaacccttgggtcaggagatcccctggtgaacccactccaccagggccttcagtctgacacacagagatacatggagtctcagcagagtagccgcttgagcacgtgcagagacccagcagctttacatactccggccctgggtttcccagcaaaagtaactgcaactcctgcaaagcgggagattagacccctgtacatacccctaggaaagaggctgaatccagggggccaagcggcacgatctgcgggccccacttccactgcacctcacaggataagacccactggtttggaattccagccagccaccagcagcagtgttgcacctacctgggacagaggtcccagggggaagggcaggctgctctctgggacagagctcccagaagtggtaccccagaacagcacagcacagctgctcttcagaagcatggccagactgcttctttaagcaggtgcccaatctgttcctcctcactgggtgggacttttcaaccaaggcctccagcaacccctactggtgttctctggctgacagagatttgaattctccctgggacagagctcccggagggagggaggggccaccatctttgctgtttgggcgacttagctgttccggcctccaggctttggagagcccacaccaaccaggggtggaagcagtgccccagcacagcacagctgatctgtgaaagcatggacagactgcttctttaagcagttccctgatcccgttcctcctgactgggtgagacctcccaaccagggtctccagccttgtcctgcaggcgcatttgggctggcaacaggtctgtacctcgctgggccggagctcccagaggaagaggcaggctgacatctttgctgtttcacagccttcactggtgatagctccaggtactggaaaatccaaggagactaggaactggagaagaagcccagcaaagtacagcagccctacagaaacatggccagactgttaaaagaaaaaaaaaatccaaaggtcagcaacctcaaagactgaaggtagataagcccacaaagatgagaaagaatcagtgcaagaatgctgaaaactcaagaagccagagtgccctctttcctccaaatgactgcatcacctctctagcaagggttcggaattgggctgaggctgagatggctgaaatgacataagtagaattcagaatatggatagaaatgaacttcactgagttaaaagagtacattgtaacccaatgcaagcaagctaaaaatcatgataaaacattgcaggagctgacagacaaaatagcccatgtagagaagaatgtaaccaacctgacggaactgaaaaaacacactacaagaatttcataatgcaatcacaagtactaatagcagaatagacaaagcggaggaaagaatttcagagcttgaagactggctttctgaaataagactggcagacaagaatagagaaaaaagaatgaaaagcaatgaacaaaacctccgagaaatatgggatcacgtaaagagagcgaatctaagactgattggtgtccctgaaagagatggggaaaacggaaccaatttggaaaacgcatttcaggatatcatctatgagaaattccctaacctagctagagaggccaacattcaaattcaggaaatccagagaactccaggaagatactccacgaaagg

SEQ ID NO: 11273 - DNA, 2669 bp, Homo sapiens
  misc_feature (1309)..(1310): n equals a,t,g, or c
  misc_feature (1480)..(1480): n equals a,t,g, or c
ggattgtaacacatgacaaagtttgagaactactgacaggaagagtcctgctgctgagttctaggcccagttctgtcactggctcactaaatgacttcaggcatgtccctctcctattttgaacttcagttttctcttctgtgaaatgaaagccttggactaggcagcgtctaaaggctctgtcactccgtaattgtgtgactttggtaactttgtttgacttctccttgcttaagttttctcatatgggtatggtaaggaaaatacctacctcacaggattttctaacaattttgtgattattaagtatgatgactgatgactaatatatgacagccagctcttacacagtgctttctatatcctggactgttgtaagtgcttttaatccccgcaacaatcccatctccattttacaaatgaaaaatagaggtcacacggctaatacgtgtcagagtttggattaaaacccagaaaaatctgtccccagagacaatgattttaactagcatgcccttttgctcaataaatgttaattccctcaccctttccacacacacacagtctagctgaccattcatagacaataatcccactttcacagtccatccaacaagatcttaaaagaaccatgagaatctctaggtttcttttgcaaatagttttcaagcatttaaaaaaaaaaggtggggggcggggagggagtggccaagatggctgactagaagcagctagggtgagtggttctcatggaggggaaggaaaggggcgagtaaatacagcgccttcaactgaaacatccaggtacccacattgggtctaatcaaggaaacaactcgatccacagagaatgaagaaaagcaaggcaggatgacagcccacccaggagcaacatggagacagaggaacctcctccacccagggaagtcgtaagtgaatgtgcgatcctgggaaaccacgctcctcccatggatccttgcaacccttgggtcaggagatcccctggtgaacccactccaccagggccttcagtctgacacacagagatacatggagtctcagcagagtagccgcttgagcacgtgcagagacccagcagctttacatactccggccctgggtttcccagcaaaagtaactgcaactcctgcaaagcgggagattagacccctgtacatacccctaggaaagaggctgaatccagggggccaagcggcacgatctgcgggccccacttccactgcacctcacaggataagacccactggtttggaattccagccagccaccagcagcagtgttgcacctnnacggacagaggtccagggggaagggcaggctgctctctgggacagagctcccagaagtggtaccccagaacagcacgcacagctgctcttcagaagcatggccagactgcttctttaagcaggtgcccaatctgttcctcctcactgggtgggacttttcaaccaaggcnctccagcaacccctactggtgttctctggctgacagagatttgaattctccctgggacagagctcccggagggagggaggggccaccatctttgctgtttgggcgacttagctgttccggcctccaggctttggagagcccacaccaaccaggggtggaacgcagtgccccagcaacgcgacagctgatctgtgaaagcatggacagactgcttctttaagcagttccctgatcccgttcctcctgactgggtgagacctcccaaccagggtctccagccttgtcctgcaggcgcatttgggctggcaacaggtctgtacctcgctgggccggagctcccagaggaagaggcaggctgacatctttgctgtttcacagccttcactggtgatagctccaggtactggaaaatccaaggagactaggaactggagaagaagcccagcaaagtacagcagccctacagaaacatggccagactgttaaaagaaaaaaaaaatccaaaggtcagcaacctcaaagactgaaggtagataagcccacaaagatgagaaagaatcagtgcaagaatgctgaaaactcaagaagccagagtgccctctttcctccaaatgactgcatcacctctctagcaagggttcggaattgggctgaggctgagatggctgaaatgacataagtagaattcagaatatggatagaaatgaacttcactgagttaaaagagtacattgtaacccaatgcaagcaagctaaaaatcatgataaaacattgcaggagctgacagacaaaatagcccatgtagagaagaatgtaaccaacctgacggaactgaaaaaacacactacaagaatttcataatgcaatcacaagtactaatagcagaatagacaaagcggaggaaagaatttcagagcttgaagactggctttctgaaataagactggcagacaagaatagagaaaaaagaatgaaaagcaatgaacaaaacctccgagaaatatgggatcacgtaaagagagcgaatctaagactgattggtgtccctgaaagagatggggaaaacggaaccaatttggaaaacgcatttcaggatatcatctatgagaaattccctaacctagctagagaggccaacattcaaattcaggaaatccagagaactccaggaagatactccacgaaagg

SEQ ID NO: 11274 - DNA, 300 bp, Homo sapiens
tctagagtgaccaaccatcctcttgtgcccagaactacaggactttccattttaaaactaggagagtcccacacaaaccaggactgttggtcagtcaccgtaccttcttgctgctagatatgtaattttctttggttttcatcaccggttcccatttctttgaaagtgtttgtaggtcacacactgtgtagtccatgatgaaaagaacaaaagatgtatgaattatggtgtgttgtggtggttcccaaagtagggtccccagaccaccagcagtggcatcatttgagaactccttagaaa

SEQ ID NO: 11275 - DNA, 2666 bp, Homo sapiens
aaggaagcactaaatgtagaaaggaaagatggttaccagccactccaaaaacacactgaagtactcagaccagtgacactacagagcaaacatgtaagcaagtctgcaaaataaccagctagcatcatgatgaaaggatcaaatccaaacataccaatactaaccttaaattgtaaatgggctaaatgccccagttaaaagacacagagtagcaagctggataaggaactaagatccaatggtatgctgtcttcaagagaaccatctcacatgcaatgacacacataggctcaaaataaaaagatggatgaaaatctaccaagcaaacggaaaacataaaaaagcagcagttgcaatcctagtttctgacaaaacagactttaaatcaacaaagatcaaaaaacacaaagaagggcattacataatggtaaatggttcaattcaacaagaaaatctaactatcctaaatacatatggacccaacacaggagcacccagatttataaagcaagttcttagaggccttcacagagacttagactgccaggcaatgatagtgggagactttttaacaccccactgacaatattagacagatcattgagacagacagttaacaaagatattcaggacctgaactcagcactggatcaaatggacctggtggatatctacagaactctccaccccaaaacaacagaatatacattcttctgatcaccgcaaggcacttactctaaaatcgaccacataatcagaagtaaaacactcctcgacaaatgcaaaagaactgaaatcatgacaaacagtctcttgggccacagaagaatcaaatttgaaatcaagattaagaaattcactcaaaaccatgcaattacatggaaattgaataacctgctcctgaatgacttttgggtaaacaatgaaatttaggcagaaatcaagaagttctatgaaactaatgagaacaaagatacaaagtaccagaatctctgggatacagcaaaggcagtgttaagaaggaaatttatagcactaaatgcccacatcaaaaagttagaaagatctcaagttaataacctaacatcactactaaaagaactagagaagcgagagcaaacaaatcccaaaactagcagaagacaagaaataacaaaaatcagagctgaactgaaggagacagagacatgaaaaacccttcaaaaaatgaaagaatccagaagctgttttttttttctttgaaaaaaagtaataaaatagaccgctagctagacgaataaagaaggaaagagagaagatttgaataaacacaatcagaaatgataaggggaatatttatcactgaccccacagaaatacaaacaaccaccagagaatattgtgaacacctctgggcacataaactaggaagtctagaagaaatggacaaattcctggacacacacacctccccaaggctgaaccaggaagaaactgaatccctgaacagaccagtaatgagtttggaaattgaggcagtaataaatagcctaccaaccaaaaaaatcccaggaccagatggattcacagctgaattctaccagatgtacaaagaggaactggtagcattcctactgatactatttcaaaaaattgagaaggagggactcctccctaactcattctatgaggccagcatcatcctgaaaccaaaacctggcagagatacaacaacaaaagaaaacttcaggccagtatccttcatgaacatcaatgcaaaaatcctcaacaaaatgctggcaaactgaatccagcagcacatcaaaaagcttatccaccacgatcaagttggcttcctccctgggatgcaaggttggttcaacatatgcagatcaataaatgtgactcatcacataaacagaactaaagacaaaaaccacatgattatctcaatagatgcagaaaaggcttttgataaaattcaacatcgcttcatgttaaaaactctcaataaactaggtattgaaggaccatgcctcaaaataataagagccatctgtgacaaacgcacagccaacatcatactgaatggacaacagctggaagcattccccttgaaaaccggcacaagacaaggatgccctctctcaccactcctattcaacatagtattggaagttctggccagggcaatcaggcaagtgaaagaaataaagggcatccaaattggaagggaggaagtcaacctatccctgcttgcagatgacatgatcctatatctagaaaaccccgttgtctcagcccaaaggcctcttaagctgataaacaacttcagcaaagtctcagggtacagaatcaatgtgcaaaaatcactagcattcctatacaccagcaacagtaaagccgacagccaaatcagcaatgaactcccattcacaattgctacaaaaagaataaaatacctaggaatacagctaactagggaggtgaaagatctctacaaggagaactacaaaccactgctcaaagaaatcggagatgacacacaaaaaaatggaaaaacattccaagctcatggataggaagaatcagtattaaaatgggcatactgcccaaagcaatttatagattcaatgctattcccattaaactaccattgacagtcttcacagaacgagaaaaaaaaa

SEQ ID NO: 11276 - DNA, 300 bp, Homo sapiens
tctagagtgaccaaccatcctcttgtgcccagaactacaggactttccattttaaaagtaggagagtcccacacaaaccaggactgttggtcagtcaccgtaccttcttgctgctagatatgtaattttctttggttttcatcaccggttcccatttctttgaaagtgtttgtaggtcacacactgtgtagtccatgatgaaaagaacaaaagatgtatgaattatggtgtgttgtggtggttcccaaagtagggtccccagaccaccagcagtggcatcatttgagaactccttagaaa

SEQ ID NO: 11277 - DNA, 4591 bp, Homo sapiens
  misc_feature (740)..(740): n equals a,t,g, or c
  misc_feature (3998)..(3998): n equals a,t,g, or c
aaggaagcactaaatgtagaaaggaaagatggttaccagccactccaaaaacacactgaagtactcagaccagtgacactacagagcaaacatgtaagcaagtctgcaaaataaccagctagcatcatgatgaaaggatcaaatccaaacataccaatactaaccttaaattgtaaatgggctaaatgccccagttaaaagacacagagtagcaagctggataaggaactaagatccaatggtatgctgtcttcaagagaaccatctcacatgcaatgacacacataggctcaaaataaaaagatggatgaaaatctaccaagcaaacggaaaacataaaaaagcagcagttgcaatcctagtttctgacaaaacagactttaaatcaacaaagatcaaaaaacacaaagaagggcattacataatggtaaatggttcaattcaacaagaaaatctaactatcctaaatacatatggacccaacacaggagcacccagatttataaagcaagttcttagaggccttcacagagacttagactgccaggcaatgatagtgggagactttttaacaccccactgacaatattagacagatcattgagacagacagttaacaaagatattcaggacctgaactcagcactggatcaaatggacctggtggatatctacagaactctccaccccaaaacaacagaatatacattcttctgatcaccgcaaggcacttactctancatcgaccacataatcagaagtaaaacactcctcgacagatgcaaaagaactgaaatcatgacaaacagtctcttgggccacagaagaatcaaatttgaaatcaagattaagaaattcactcaaaaccatgcaattacatggaaattgaataacctgctcctgaatgacttttgggtaaacaatgaaatttaggcagaaatcaagaagttctatgaaactaatgagaacaaagatacaaagtaccagaatctctgggatacagcaaaggcagtgttaagaaggaaatttatagcactaaatgcccacatcaaaaagttagaaagatctcaagttaataacctaacatcactactaaaagaactagagaagcgagagcaaacaaatcccaaaactagcagaagacaagaaataacaaaaatcagagctgaactgaaggagacagagacatgaaaaacccttcaaaaaatgaaagaatccagaagctgttttttttttctttgaaaaaaagtaataaaatagaccgctagctagacgaataaagaaggaaagagagaagatttgaataaacacaatcagaaatgataaggggaatatttatcactgaccccacagaaatacaaacaaccaccagagaatattgtgaacacctctgggcacataaactaggaagtctagaagaaatggacaaattcctggacacacacacctccccaaggctgaaccaggaagaaactgaatccctgaacagaccagtaatgagtttggaaattgaggcagtaataaatagcctaccaaccaaaaaaatcccaggaccagatggattcacagctgaattctaccagatgtacaaagaggaactggtagcattcctactgatactatttcaaaaaattgagaaggagggactcctccctaactcattctatgaggccagcatcatcctgaaaccaaaacctggcagagatacaacaacaaaagaaaacttcaggccagtatccttcatgaacatcaatgcaaaaatcctcaacaaaatgctggcaaactgaatccagcagcacatcaaaaagcttatccaccacgatcaagttggcttcctccctgggatgcaaggttggttcaacatatgcagatcaataaatgtgactcatcacataaacagaactaaagacaaaaaccacatgattatctcaatagatgcagaaaaggcttttgataaaattcaacatcgcttcatgttaaaaactctcaataaactaggtattgaaggaccatgcctcaaaataataagagccatctgtgacaaacgcacagccaacatcatactgaatggacaacagctggaagcattccccttgaaaaccggcacaagacaaggatgccctctctcaccactcctattcaacatagtattggaagttctggccagggcaatcaggcaagtgaaagaaataaagggcatccaaattggaagggaggaagtcaacctatccctgcttgcagatgacatgatcctatatctagaaaaccccgttgtctcagcccaaaggcctcttaagctgataaacaacttcagcaaagtctcagggtacagaatcaatgtgcaaaaatcactagcattcctatacaccagcaacagtaaagccgacagccaaatcagcaatgaactcccattcacaattgctacaaaaagaataaaatacctaggaatacagctaactagggaggtgaaagatctctacaaggagaactacaaaccactgctcaaagaaatcggagatgacacacaaaaaaatggaaaaacattccaagctcatggataggaagaatcagtattaaaatgggcatactgcccaaagcaatttatagattcaatgctattcccattaaactaccattgacagtcttcacagaacgagaaaaaaaaaactattttaaaattcatatggaaccaaaaaacaaaaaaagcccgaataccgaaggcaatcctaagcaaaaaggacaaagctggaggcatcatgctacctgacttcaaactatgctacaaggctacagtaacccaaacagcatggtgctggtacaagaacagacacatagacaaatggaacagaacagagaaccgagaaatgagaccacacacctacaactaactgatcttcgacaaacctgacaaaaacaagcaatggggaaaggattcccggttcaataaatggtgctgggataactggctagccatgtgcagaagatgaaaaccggctcccttgcttacactatatacaaagattgactcaagatggattaaagactgacatgtaaaacccccaactatgaaaactctgaaagacaacttaggcaatgccattcagggcataggcatgggcaaagatttcatgatgaagacgccaaaagcaattgcaacaaaagcaaaaaattgacaaatggggtctaataaaattaaagagctgtgcacagtgaaagaaactatcaacagagtaaacagacaacctacagaatgggagaaaatatttgcaaactatgcatctgacaaaggtctaatatccagcatctataaagaacttaaacaaatttacaggaaaacaaacaatcccataaaaaagtgggaaaaggacatgaacagacacttttcaagaggagacatacatgcagccaacattcatatgaaaaaaaaaggtcaacatcactgatcattagagaaatgcaaatcaaaaccacaatgagatcccaactaatattagccaaaatggccattattaaaaagtcaaaaaataacagatgctggcgaggctgtggagaaaaaggaatgcttatacactgtctgtgggattgtaaacaagttcagccactgtggaagacagtgtggtgattcctcaaagacctaaagacagaaataccattcaacccagcaatcccattactgggtctacacccaaaggactaaaaatcattctgttacaaagacacatgcatgtgtatgctcattgcagcactactcacaatagcaaagacatggaatcagcctaaatccccaacagtgacagactggagaaagataatgtggtacatatacaccatggaatactatgcagccgtgaaaaagaatgagataatgtccttcgcagggacatggatggagctggaggcccttatccttagcagaccaacacagaaagagaaaaccaaatactgcatgttctcacttataagtgagagttaaatgatgagaacatatgacacatggngggaacaacacacactggggccttttggaggatagagggtgtgaggagggagaggatcaagaaaaacacctaatgggtactaggcttaacccctgggtgatgaattaatctatgcaacaaatcccctatgacacaggtttccctatgtaacaacccggcctttgtccccctgaatttaaagttttaaaaaaaaaaaaaaagggagttggtggctaataacctctaaataaggcttttcaaacttaaaagcaaaatctagccgggtgccgtggctcacgcctgtaatcccagcacttttggaggccaaggcaggaggatcgcttgaggtcaggagtttgaacccagcctgagcagcaaagcaagcccccgtttctacaaaaaaatagaattaaaagaaaagttagttgggtgggagtcatgagtgcctgcagtcccagctactcgggaagctgaggtgggaggatctcttgagcccagcagttcaaggctactgtgagctatgatcaccccactgcactccagcctgggtaacagagcaagaccatgtctcaaaaaaaaaaaaaaaaaaaaaattcatcatttctaattttgcc

SEQ ID NO: 11278 - DNA, 1551 bp, Homo sapiens
ctccattaagaattgattactaatagcagaagattttaaactatctctgttggtagatgaagtgattcttgcatagatagagagagccatttgtcaccacagctggctaagtccccctccttccttcacttagtctgtattagtttgctagagctgccataacaaaatatcagagtctgagtagctttaacaacaggaatccactttctcacacttctggaggttggaaacccaagatcaaggtgctggcagggtgggtttcacagagagctttcaaggaaggatctgttctgggcctttctttttgacatgtagatggctgcccttttattgcctcttcatctgtgtctgtgtgctcctgatgtctctctctgtgtgtccaaacatcatcttataaggacaccagtaggaacggattaggtcctaccctaatggtcacattttttacttgattttctctttaaaggctttatatccaaatacagtcatggtctgaggtacaaggtgttagggcttcaaacatacgaatttgtgggagtcaattcagctcataacatagtccatgagcttgtactaattggaagtgaggattaggtttttagttgtttccttccttccaattactctagatctttctccacttccagttgaccaatcccttcatgctgccagccccacatttgacttgactgcctttacctacactctccagtctttgttattctttccttcctcacatccaaatgtaactctgccacaacccactagacctctattaggaatcatttgaaaactaaaaagtaaaacatctatttgacccccttgacccatgctttctggctgcatattaaaaataatagcaaaaatcatgattacttttgcaccaacctaatattaaaatcatctggggtgttttataaaaatacctatgtctgggccctaataccagatcttctggtttggttggtggagtgaggcccgtgttcctgatgatctgaccactctcatacatttctgtctgtgcttctcttagcctaaaatgctctgtgctttttttccaactcatgaattcttatctattcgaatttataggtggactgtcacttcctcaagaaagcctccatcagttaccccagggtagtgtattagggtcagtctagcagagcagtaggtaacgtgaactaaaggcatagagacctgagtgtgaatgtcttactttgatctttcttaaccaggggactttgaacattttcttaagcctgttgagcctcattgtggtaatcatgaaaagggaaagtcttaaagcatgtcacatagggttgatgtgagaattaagaaaattaccatatgtatgcttcctagctggtagtacatgtccatttaataatctctccttctggtggcgggcacctgtaatcccagctacttgggaggctgaggcaggagaatggcgtgaacccgggaggcggagcttgcagtgagccgagacagcgccactgcactccagcctgggcgacagcgagactccgtctcaaaaaaaaaaagaaaaaa

SEQ ID NO: 11279 - DNA, 121 bp, Homo sapiens
gataggtgccaagaagaaaaaaaaattaacagaaaagaaggatttgaaatatgaagaactagagaagccttggtgagaatgggacattggaaaaaggactggaagaaagtgaaggagctgg

SEQ ID NO: 11280 - DNA, 2200 bp, Homo sapiens
ttttttttttttgttgactgggctcaagtgatgctcccccctcaccctcctgagtagctgggagtagctgggactacaggtgtgtgtcaccacacctggctaagtttttttgtgtgtgttttttgagtagagatggggttttgccatgttgcctgaactggtcacactcctaggctcgagcagtcctcctgccttggcctcccaaagtgctgggattatgtgtgtgagccaccacacctagcctacattctttttaaattttttgtttttagttgacctataatacttgtagaaagacaaagaatacagtgtgatgtttcagtgcatatatgcattgtataaggatcaaatgagggtaattatatccatcactaagcatttatcatttatttgttgtggtaatattcaaaatcttctcttctagctgtcttgaaatgtctatcacattgttatttgctgtactcaccttactgtgtaatggaacaccagaacttattcttcctgtctgattgtaacttaatacccattgaaacaacttctcatggtcccccccttcccccatactccccagccataggtaaccactgttctattctctgcttctgtgaaatcaacttttaaaattcaagggtgaaattacacagtgtttgcctttctgtgccttgctatttcacttaacataatggcctttaggttcatccatattaccacaaacgacggaagaatattctgtttataatgttccattttgtgtgtgtgtatacacggacacacggcattttctttgttcattcatctgtagatgggtgtttaggttgattcatgtcttgactattgtgaatggcactgcagtaaacatgggagtgcaattatctcttcaatatactgatttcatttccctttggatatacacccaaaagcatagggaacaaaagcaaaaacagacaaatgggattacatcaaactacaaagcttctgcacagcaaaggaaacaaacaatatagatcgaagagacaacctgaagaataggagaaagtacttgtaaactttatgcatctgacaaagagttaatatccagaacatataaggaactcaactcaatagaaaaaaaattcagttaaaaaatgggcaaaagacctgcgtagacatttctaaaaagaacacatacaaatggctgacagatatatgaaaatatgcttaacatcactaattatcaggaaaatgcaaatcaaaaccacagtgagatactacctcaccccagtcagaatggctgttctcaaaaagacaaaggataacaaatgttgggaaggatgtggagaaaggggaactcttatgcacttttggtgagaatgtaaattagtacaactattatgggaaacagtatggaggttctcccgcctcccccagaggcaggttctctctctgttgcccaggctggagtgcagtggtgtaatcatagctcgcttggcctcaaacttatgagctcaagtcatcctcctgcctcagccttctgagtagctgggactataggtgtgtgccacgtcatctagttagttcttaattttttgtagagacagtgtcttgctatgtttcacaagctggtcttgaacttctggcctcaagcaatcctcctccattggcctcccaaagcactgggctttataagcatgagccaccctacccagctggaggttcttcacaaaaaaagattggctatatatccaaagaaaataaataatacattctttcatagcaaaagagaggatcagcatatattaaagagtgcttattttaccactgaacaagttgtaaaagtagacgttcttaagctcatgagcctgtggtaaatactaggtagtcactcaaaatgtgtagatttcaagcatactttggactttggaagtagacacatgagattgtagcacggaatcctaaaatcctaggccaaagaagacttttagaaatcatagttcatactgtttcttttatgcaggatttagctaatccatcttagaaaaaaaaagcaagactatttttaatatccagaaatacatattatagtcattggcgactggccttgagggggcataacaaaacatggttgtatgtcagtgatactgcaattgatgaaatgttgctatttagaaacagtaaaaggaagcccccagaagttaaaaatacctgttggacactaaaaaaa

SEQ ID NO: 11281 - DNA, 2200 bp, Homo sapiens; identical to SEQ ID NO: 11280

SEQ ID NO: 11282 - DNA, 234 bp, Homo sapiens
cagacctatctagctaagctgctgttgaattcttggaccatagagactatgagataatgaatatttattgttgtccagtgcagctaaaaattttggggtaagttgtttcatagcagtatataattctcttctgaagttgtgctgaaggggaaatttacacccaattcatgtattagaaagaagctgaaattcagtgatcacaagtgtatttctcaagaagttaggagaagaaca

SEQ ID NO: 11283 - DNA, 93 bp, Homo sapiens
  misc_feature (74)..(74): n equals a,t,g, or c
  misc_feature (85)..(85): n equals a,t,g, or c
gaggcaggagaatggcgtgaacctgggagacggagcttgcagtgagccgagatcgcaccactgcactctagccngggcgacagancgagactc

SEQ ID NO: 11284 - DNA, 7591 bp, Homo sapiens
acgcaacttctgcagctacagctgtgtggtagctttccaggtatggcttcaggaaccttcctcttcttcagtcagtgagtcacctactgtatgagtctgttcttgcactcctctaaagaaataccctagactgggtaatttataaagaaagaggtttaattggctcacagttccacaggctgtacaggtagcatggctggagaggcctcaggaaactttcaattatggcggaaggcgaaggggaagccggcacgtcttacatgatgggctcaagaggaagagagagaagcgggaggtgctacacttttaaacaaccagatagtgagaactcactatcaccagaacagcaggggagaaatccacccccatgatccagtcacttcctgccaggctcctcccccaacattggggattaccgactggacatgagatttgggcagggacacgaattcaaacctatcacctactatagtaatgcacatttattaggtgtttgctagggcctgggttgtataagtttctatatcattcctattaaacttggatttgtagttcattctgtatttggaatttaatttaactgccttctataaaattgaatggtacttttatcacccatattatctattgggaggatattatttttgaggaagattattagttaagttattttattttttcatcataaatgagactccccccattccgtaataagctgctcagaggcaggaacattgcctgttaacagatgtaccttacatgcctagaacggtgcttggcatatgtaggcacacaatacttctttgttttaacaaagattaaattgatactttttgttgttttgtttttccagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataaggtaaagtatagcatgttcatgataagattttgagtatacgtgggtctatttgtaaaattatttttaactttgcatctctcaaaatcataccatttgttttgaaagtaagggagataaggagttccataagacaaaccaaatgtttaattagtacttaatgattatttctttgcagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggtaaagacagaagattatcttacctactgagcatgttggttgttttaaagcagttgatgatgatttaagctttcactgtctaagttaatctgttttattgtttatgtataacgtaaatgccttttcgattcatttacacttagttcattcttttttgatctagttttcttatattatgtagctgttaaaatgaagtgaaagatttgcaaagtataatgcacgaagaagatgatgtgaaaaacatttaacatccttaggttccccattattaggttgatcgggacctcaaagagcttctagttcgtgtacttatttctaaatgggatgccttaaattatggtaacattctaagtttatacttttattgtcttaaacagccattatatttctgaatataaatggcttgaatatgcaaattaatatgtggaagattgttttccttagataactcttctatatgtttataatgttttattttactctaaagctgtattagccttctagagcaagggctttcaaaccttttgataacaccaaagaagaaatacatttacactgtgacccagtatattttcacatacctaaataaaagttttttttgtttttgtttttgttttttgagacagagtcttgctttgtcacccaggctggaatgccatggagcgatcttggctcactgcaacctctgcctcctgggttcaagcgattctcctgcctcaacctcccgagtagctgggactacaggcacccgccaccacacctggctaatttttgtatttttagtagagacagggcttcaccatgttggccaggctggtctccaactcctgacctcaggtgatccacccactttggcctcccagagtgctgggattacaggtgtgagccactacgcccagccccaaaagtttcatgaaataaaatcgatgcagtttaatattttctcttctgtgctatcctgtcttatatcatttaaaacaaaaacaaaaacaaagcaaaacaaaaactagtatagatactctaaaaaatcaagatactctgtgaactggtcaggacccaagtgtgaaaactttgtcctagaccacttatttttcttttttttgtttttgtttttatttgacatggggtcttgccatgttgcccaggctggtctcaaactcctgggctcaagcactcctcccgccagcctcccaaagtgttgggattacaggtgtgagccactgcaccgggcctgtcctaggccatttaaagttgcagaaaactaatacttctacctaatgttaattttatctttcctgatttttaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcaggtaaatagaattcacattcctgggtttttcattctagggcataaattattcccttttaaaatttcatgtcacataaaggacaatttaattatttaaaacttttaagtattaaatgttttatgccttctagcaattaatataagatttagaaagactttaatgttattgaagttttcttttgtttttaatttcctgtaggagacatatcagtcttaagacattaaaatatttaaacttataattttattcacttattatttaaataaagtgaatttgtcttctgaagtctgaggaagatagaccttatttttatttcactttgttttttaattgctatagagtgaagtctgtatgttacatgtgttttttaaaaaaaattagtataaaatcagctgggcgcggtggctcacgcctgtaatcccagcactttgggaggccgaggcgggtggatcatgaggttaggagatcgagaccatcctggctaacatggtgaaaccccgtctctactaaaaatacaaaaaaattagctgggtgtggtggcgggcgcctgtagtcccagctacctgggaggctgaggcaggagaattgcatgaacccaggaggtggagcttgcagtgagctgagatcacgccactgcactccagcctgggcgatagagcaaggctctgtctcaaaaaaaaaaaaaaatatatatatatatgtgtgtgtgtgtgtgtgtgtgtgtgtataatcattgataaagacaaactaattttttgatctaaattctaagttaatttcgtcacttgttatgtgtgtcttatttttattttgtcagaccacagataatttgtttcttactccttgactaccttcttctttttagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcaggtaaaattaaccttaggtactgaatggagtctttggtcaatactaggaactactgttcttttacagatcaggaactgtgtaaacagttgtcattaatttcatgaaacctcagtttccttgtattctgtatcaataacatttagctttttttgttgaacaccttatttcactgtcgtccgtgtgaagagaccaccaaacaggctttgtgtgagcaacaaggctgtttatttcacctgggtgcaggcggtctgagtctgaaaagagtcagtgaagggagatggggtggggccgttttataagatttgggtaggtaaaggaaaaaggggggttgttctctggcgagcaggagtgggggtcacaaagtgctcagtgggggagctttttgagccaggatgagccaggaaaaggaatttcacaaggtaatgtcatcagttaaggcaggaacaggccattttcacttcttttgtgttggaatgtcatcagttaaggcaggaaccggccatctggatgtgtacctgcaggtcagaggggatatgatggcttagcttgggctcagaggcctgacaccttagattaaagctgagtaaaaatgagtttttgattaaatagatttctttgagaatattgaatcaaataaactctgtaagaacttaaatttatgggaaaggataacagttaatggtttgtaattgagtataattggcttccttaaaaaatcctttgagactacttataacaaaagacataaagtcaaaatcacatggccttttaaatataccatgtgcaggccagatgtgatggttcatgcctgtaatcccaccgcctttggaatgctgaggtgggaggacggcttgaggccaggagttcaggggtggagtgagcggtgaccacagcacagcaatcccagctggatgatatagtgagaccctgcctctaaaaaattaaaataaaataaaactatatgtcgtgggcgtgactagttggggccagtgtcacgggctgtaaaggaatttaccaagacagtcataggtaaaggcagatttattggagaaagtgtgaaaatatgttgcaaggttgcagtgagcagcacagcagagaaggggaagtctgcaaagacgcagcggcttgagggacgttttacatggtcctgctggaggggactgcttgcagaatgtagccgtgctcctggggctacctgtaggaggtcatctctcagagtaattactcattgttctcccccacctgggccccttcctctttgttgcttacttaccttgtcaggacttacttatcttatcaggactacacactatgtgctaggccactttatctcagaaaatttattatttaaaaacaacactagtatcatcctgaaagctagaagaatttaagtgtagtctccttacaaataaaagcaaaatctacaagagcctactccaaaacttaaaaaaaaattatttctatataaaggcaagatttaagaaaaacattaggctgaattgtccattaaatctaacctgtgatcttcattggtattgtgtgtttgaggatttgcattgttggtttttaagttggtttttaagttagactatttgttgccttttttatgtaaagataaagttaatagaaaactttcaagttttactaattaaaaagtagaaaaccagggtatggtggctcatgcctgtaatctcagcactttgggaggctgaggcaggcggatcacgaggtcaggagtttgagaccatcctggccaacatggtgaaaccccgtctctactaaaatacaaaaaattagctgggtgtggtgctgcgcacctgtagtcccagctacttgggaggctgaggcaggggaatcgcttgaacccgggaggtggaggtcgctgtgagctgatatcgtgccactgcactccagcctgggcagcagagtgagactctgtctcaaaaagaaaaaaaaaaagaagaaaaccaaaacccagttaatcctaaagtgactttttgctccaacagaaattactcaaacctgaaaacattgtttaacttccttgaaatggtttctgtgtaagtacatataaatcacgtgaggtttccttatttttgtttattttaatcagcaaatatttccatggttcaagctgcttcagcaggacctccatctctgagaaaagattcgactccagttatagccaatgtagtatcattggcaagtgcccctgctgctcagcctacagtgaattctaacagtgtcttacaaggtatggcttgattgggaagcatttatctagcctatttaggttgaatgcagtggtcccctaacttcctttcatcagggattattttcatacatttgacacattcaatattaggaatagtggcttgctgctcaagtttcatatctcatactttagattgctagtttcttccgttgagattaaaaaaacacatgttcttagtatgagggtttgtgtttatgtactgataatcagcttttaatgctaatgttaaaataattgtaaagatcataaatttatgttttaatttatatcaaggtgcagttccaacagtaacagcgaaaatcatcggtgatgtaagttttattacttttattggtattgtcactgtatttatttttcattttcatacagtataaatatgtgtgaactaatttgccctccttctttattatatgaaatagatttcattagctcatttaatctttgttcaggaataggattttctggctatttaaataggtcttttatgtactttaatatctttgaatgctggctatgtagttactgaaagtttttctttaattacacaaaattgaagtaaattgtacaggatttaggcctgaaagacttttggatgttttgtgatgtactcagattataaataaaatgtttatacaatgtagcttatcctccctctgacccattacagattatactgtaaaaaaaaattctttttttaacccattaatattttctgctttgtctcttaaaagaagaaaataaataatgagaaaaacttctgactggaacagtggcatttctaaggtgtttctccaggtttctgggataactttcacgttgtctttattcaagttacttaaatgatcataagtgattctgttattcctagttatcttgaatctctcaagtcctctgtgtcttaatcaggaagtaagaattctcattttaaacttagccagcattgttattgatcagcagtgtgttacaatagaaatagcatttttcttggtaaatagaaattgtgattagagacatgcagagtaatatatagttattaaaacattccttgattactattaatattttaggagtattgtatttcttatacatttggttgaatatttacttgctatgtcctccatgtaattccaatatgacatttcctttaatattataatatttcttataattacaatgagatttttaaaaatgtttttggtttctaatttgtttttttactaggcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacag

SEQ ID NO: 11285 - DNA, 7595 bp, Homo sapiens
acgcaacttctgcagctacagctgtgtggtagctttccaggtatggcttcaggaaccttcctcttcttcagtcagtgagtcacctactgtatgagtctgttcttgcactcctctaaagaaataccctagactgggtaatttataaagaaagaggtttaattggctcacagttccacaggctgtacaggtagcatggctggagaggcctcaggaaactttcaattatggcggaaggcgaaggggaagccggcatgtcttacatgatgggctcaagaggaagagagagaagcgggaggtgctacacttttaaacaaccagatagtgagaactcactatcaccagaacagcaggggagaaatccacccccatgatccagtcacttcctgccaggctcctcccccaacattggggattaccgactggacatgagatttgggcagggacacgaattcaaacctatcacctactatagtaatgcacatttattaggtgtttgctagggcctgggttgtataagtttctatatcattcctattaaacttggatttgtagttcattctgtatttggaatttaatttaactgccttctataaaattgaatggtacttttatcacccatattatctattgggaggatattatttttgaggaagattattagttaagttattttattttttcatcataaatgagactccccccattccgtaataagctgctcagaggcaggaacattgcctgttaacagatgtaccttacatgcctagaactgtgcttggcatatgtaggcacacaatacttctttgttttaacaaagattaaattgatactttttgttgttttgtttttccagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataaggtaaagtatagcatgttcatgataagattttgagtatacgtgggtctatttgtaaaattatttttaactttgcatctctcaaaatcataccatttgttttgaaagtaagggagataaggagttccataagacaaaccaaatgtttaattagtacttaatgattatttctttgcagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggtaaagacagaagattatcttacctactgagcatgttggttgttttaaagcagttgatgatgatttaagctttcactgtctaagttaatctgttttatgtttatgtataacgaaatgccttttcgattcatttacacttagttcattcttttttgatctagttttcttatattatgtagctgttaaaatgaagtgaaagatttgcaaagtataatgcagaagaagatgatgtgaaaaacatttaacatccttaggttccccattattaggttgatcgggacctcaaagagcttctagttcgtgtacttatttctaaatgggatgccttaaatgatggtaacattctaagtttatacttttattgtcttaaacagccattatatttctgaatataaatggcttgaatatgcaaattaatatgtggaagattgttttccttagataactcttctatatgtttataatgttttattttactcaaaagctgtattagccttctagagcaagggctttcaaaccttttgataacaccaaagaagaaatacatttacactgtgacccagtatattttcacatacctaaataaaagttttttttgtttttgtttttgttttttgagacagagtcttgctttgtcacccaggctggaatgccatggagcgatcttggctcactgcaacctctgcctcctgggttcaagcgattctcctgcctcaacctcccgagtagctgggactacaggcacccgccaccacacctggctaatttttgtatttttagtagagacagggcttcaccatgttggccaggctggtctccaactcctgacctcaggtgatccacccactttggcctcccagagtgctgggattacaggtgtgagccactacgcccagccccaaaagtttcatgaaataaaatcgatgcagtttaatattttctcttctgtgctatcctgtcttatatcatttaaaacaaaaacaaaaacaaagcaaaacaaaaactagtatagatactctaaaaaatcaagatactctgtgaactggtcaggacccaagtgtgaaaactttgtcctagaccacttatttttcttttttttgtttttgtttttatttgacatggggtcttgccatgttgcccaggctggtctcaaactcctgggctcaagcactcctcccgccagcctcccaaagtgttgggattacaggtgtgagccactgcaccgggcctgtcctaggccatttaaagttgcagaaaactaatacttctacctaatgttaattttatctttcctgatttttaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcaggtaaatagaattcacattcctgggtttttcattctagggcataaattattcccttttaaaatttcatgtcacataaaggacaatttaattatttaaaacttttaagtattaaatgttttatgccttctagcaattaatataagatttagaaagactttaatgttattgaagttttcttttgtttttaatttcctgtaggagacatatcagtcttaagacattaaaatatttaaacttataattttattcacttattatttaaataaagtgaatttgtcttctgaagtctgaggaagatagaccttatttttatttcactttgttttttaattgctatagagtgaagtctgtatgttacatgtgtttttaaaaaaaaattagtataaaatcagctgggcgcggtggctcacgcctgtaatcccagcactttgggaggccgaggcgggtggatcatgaggttaggagatcgagaccatcctggctaacatggtgaaaccccgtctctactaaaaatacaaaaaaattagctgggtgtggtggcgggcgcctgtagtcccagctacctgggaggctgaggcaggagaattgcatgaacccaggaggtggagcttgcagtgagctgagatcacgccactgcactccagcctgggcgatagagcaaggctctgtctcaaaaaaaaaaaatatatatatatatatgtgtgtgtgtgtgtgtgtgtgtgtgtgtgtgtgtataatcattgataaagacaaactaattttttgatctaaattctaagttaatttcgtcacttgttatgtgtgtcttatttttattttgtcagaccacagataatttgtttcttactccttgactaccttcttctttttagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcaggtaaaattaaccttaggtactgaatggagtctttggtcaatactaggaactactgttcttttacagatcaggaactgtgtaaacagttgtcattaatttcatgaaacctcagtttccttgtattctgtatcaataacatttagctttttttgttgaacaccttatttcactgtcgtccgtgtgaagagaccaccaaacaggctttgtgtgagcaacaaggctgtttatttcacctgggtgcaggcggtctgagtctgaaaagagtcagtgaagggagatggggtggggccgttttataagatttgggtaggtaaaggaaaaaggggggttgttctctggcgagcaggagtgggggtcacaaagtgctcagtgggggagctttttgagccaggatgagccaggaaaaggaatttcacaaggtaatgtcatcagttaaggcaggaacaggccattttcacttcttttgtgttggaatgtcatcagttaaggcaggaaccggccatctggatgtgtacctgcaggtcagaggggatatgatggcttagcttgggctcagaggcctgacaccttagattaaagctgagtaaaaatgagtttttgattaaatagatttctttgagaatattgaatcaaataaactctgtaagaacttaaatttatgggaaaggataacagttaatggtttgtaattgagtataattggcttccttaaaaaatcctttgagactacttataacaaaagacataaagtcaaaatcacatggccttttaaatataccatgtgcaggccagatgtgatggttcatgcctgtaatcccaccgcctttggaatgctgaggtgggaggacggcttgaggccaggagttcaggggtggagtgagcggtgaccacagcacagcaatcccagctggatgatatagtgagaccctgcctctaaaaaattaaaataaaataaaactatatgtcgtgggcgtgactagttggggccagtgtcacgggctgtaaaggaatttaccaagacagtcataggtaaaggcagatttattggagaaagtgtgaaaatatgttgcaaggttgcagtgagcagcacagcagagaaggggaagtctgcaaagacgcagcggcttgagggacgttttacatggtcctgctggaggggactgcttgcagaatgtagccgtgctcctggggctacctgtaggaggtcatctctcagagtaattactcattgttctcccccacctgggccccttcctctttgttgcttacttaccttgtcaggacttacttatcttatcaggactacacactatgtgctaggccactttatctcagaaaatttattatttaaaaacaacactagtatcatcctgaaagctagaagaatttaagtgtagtctccttacaaataaaagcaaaatctacaagagcctactccaaaacttaaaaaaaaattatttctatataaaggcaagatttaagaaaaacattaggctgaattgtccattaaatctaacctgtgatcttcattggtattgtgtgtttgaggatttgcattgttggtttttaagttggtttttaagttagactatttgttgccttttttatgtaaagataaagttaatagaaaactttcaagttttactaattaaaaagtagaaaaccagggtatggtggctcatgcctgtaatctcagcactttgggaggctgaggcaggcggatcacgaggtcaggagtttgagaccatcctggccaacatggtgaaaccccgtctctactaaaatacaaaaaattagctgggtgtggtgctgcgcacctgtagtcccagctacttgggaggctgaggcaggggaatcgcttgaacccgggaggtggaggtcgctgtgagctgatatcgtgccactgcactccagcctgggcagcagagtgagactctgtctcaaaaagaaaaaaaaaaagaagaaaaccaaaacccagttaatcctaaagtgactttttgctccaacagaaattactcaaacctgaaaacattgtttaacttccttgaaatggtttctgtgtaagtacatataaatcacgtgaggtttccttatttttgtttattttaatcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtatggcttgattggaaagcatttatctagcctatttaggttgaatgcagtggtcccctaacttcctttcatcagggattattttcatacatttgacacattcaatattaggaatagtggcttgctgcacaagtttcatatctcatactttagaattgctagtttcttccgttgaattaaaaaaacacatgttcttagtatgagggtttgtgtttatgtactgataatcagcttttaatgctaatgttaaaataattgtaaagatcctaaatttatgttttaatttatatcaaggtgcagttccaacagtaacagcgaaaatcatcggtgatgtaagttttgttacttttattggtattgtcactgtatttatttttcattttcatacagtataaatatgtgtgaactaatttgccctccttctttattatatgaaatagatttcattagctcatttaatctttgttcaggaataggattttctggctatttaaataggtcttttatgtactttaatatctttgaatgctggctatgtagttactgaaagtttttctttaattacacaaaattgaagtaaattgtacaggatttaggcctgaaagacttttggatgttttgtgatgtactcagattataaataaaatgtttatacaatgtagcttatcctccctctgacccattacagattatactgtaaaaaaaaattctttttttaacccattaatattttctgctttgtctcttaaaagaagaaaataaataatgagaaaaacttctgactggaacagtggcatttctaaggtgtttctccaggtttctgggataactttcacgttgtctttattcaagttacttaaatgatcataagtgattctgttattcctagttatcttgaatctctcaagtcctctgtgtcttaatcaggaagtaagaattctcattttaaacttagccagcattgttattgatcagcagtgtgttacaatagaaatagcatttttcttggtaaatagaaattgtgattagagacatgcagagtaatatatagttattaaaacattccttgattactattaatattttaggagtattgtatttcttatacatttggttgaatatttacttgctatgtcctccatgtaattccaatatgacatttcctttaatattataatatttcttataattacaatgagatttttaaaaatgtttttggtttctaatttgtttttttactaggcaagtactcaaacagatgccctgaaactgccaccttcccaaccttcaaggcttttgaagaacaaagctttattatgcaaacccatcacacagactaaagccacctcttgcaaaccacatacccaaaacaaagaatgccagacag

SEQ ID NO: 11286 - DNA, 2043 bp, Homo sapiens
taagatgatagcagtaatgaagagaaatggaccttgagtttcagaaacttgtattctaatggaccttcaaaagatggcaagtattgtgtctggaattggtgggttcttggtctcgctgacttcaagaatgaagccacggaccctcgcggtgagtgttacagttcttaaagatggtgtgtctagagtttgttccttcagatgttcagatgtttctggagtttcttccttctggtgggtttgtggtcttgctggcttcaggagtgaagctacagaccttcacggtgagtgttgcagctcataaaggtggcgcggacccaaagaatgagcagcagcaagatttattgcaaagagccaaagaacaaagcttccacagcgtggtaaggggacccgagtgggttgctgccgctggctcgggcagcctgcttttattcccttatctgaccccacccacagcctactgattggcccattttatggagagctgattggtccattttacagagagctgattggtccattttgacagggtgttgattggtgcgtttacaatccctgagctagacacagagtgctgattggtgtatttacaatcctctagctagatgtaaaagttctccaagtcctcactagattaactagacacagagcactgattggtgtgtttacaaaccttgagatagacacagggtgctaattggtgtatttacaatcctttagctagacataaaggttctccaagcccccaccagattagctagatacagagtgctcattggtgcatccacgaaccctgagctagacacagagtgctgattggtgcatatacagtcctccagctagacataaaagttctccaagtcgtcacctgactcaggagcccagctggcttcgcctagtggatcccgcgccagggccgtgggtggagctgcccaccagtcccgcacggcgcctgcacttctcagcccttgggcagtcaatgggactgggtgccgtggagcagggggtgatgcctgttggggaggctcggtccatgctggagcccaccgccagggggctcggccatggcgggctgcaggtcccgagccctgccccgcggggaggtggctgaggcctggcgagagttcgagtgtggcacgggcagtctggcactgctgggggatccggcgctccctggcctgggtgctaagtccctcactgcccggggccggccggcttctctgagtgtggggcctgccaagcccacgcccacccagaactttcactggcccaagagcaacgcacgcagcccgggttcccacccgtgcctctccttccacacctccccgcaagcagagggggctggctccatacttggccagcccagagaggggctcccacagtgcagcagcggactgatgggctcctcaagggtggccagagcagacgccaaggccgaggaggcgctgagagcgagcgagggccgccagcacgttgtcacctctcagtatgagtgtgttgtagtgtatgtgtgaaagggagttttgcaatgggagtatgggatgatgtgttagtcatagttctacagagaaatagactatctatctatctatatctcagagagagagagagagagagattgagtgtaaggaattggctcatgcaattatggagaccaagtgccaagatatggagacggcaagctggagactcaggagagctgtggcgtagtagtttctgtccaagtccagaggcctgagaaccaggagagccagtagtataagttctagtctgaaagctggcaggcccaagaccaagaagagcccaagtttcagtttgagtcccgaagcaggaaaagactgatattccatttcaagcagtcagacaagtcttatggcagggtcagccttttagttctcttcaggccatcaactgattggataagggcgactcacattagggagggcaatttgcttccaattcagctgtttatctcatcaaaaaacaccctcacagacacacttggaataatgtttgaccaaatgtctggacactttgtgccccagt

SEQ ID NO: 11287 - DNA, 379 bp, Homo sapiens
gcactcagagactggactgtgttagctgggaaggatcacagtctgccaggaaatcagttctcaccttccaatgggacaggatttgagggtgggagttggggtaggagaaagggagcagagaggaaaaatttgtaactgtcatgcaaaaggccagttaagagaatctcaactactctgggcaccaaagagcagcttttagtagatagttgagttggagccgggagcagcagcatcaacaacagcaacagctgaaatagcttgtgcaggacattagagctcttcatgggtagagtgcaggaaggccatgacaatggaagcagtaatagaaatcatacagggaggaaaatgatgtgcagcttaatatggtgagatgcccagt

SEQ ID NO: 11288 - DNA, 301 bp, Homo sapiens
gggccgggcgcagtggctcacgcctgtaatcccagcactttgggaggccgaggtgggcggatcacgaggtcaggagatcgagaccatggtgaaaccccgtctctactaaaaatacaaaaaaaaaattagccgggcgtgatggcggacgctgtagtcccagctacttgggaggctgaggcaggagaatggtgtgaacccaggaggtggagcttgcagtgagccgagattgcgccactgcactccagcctgggcgacagagcgagactccgtctcaaaaaaaaaaaaaagagagagaaatgat

SEQ ID NO: 11289 - DNA, 2654 bp, Homo sapiens
ccgggcatggtggtgcgcacctgtaatcccagctacccgggaggctgaggcaggagaatcacttgaacctgggaggcggatgttgcagtgagctgagatcatgccattgtactccaccctgggcaacagagcgagactccgtctcaaaaaaaagacatgagaataaaacagtttactgcatataccaaggcatatcagatgtttaggaattgcatacaattttggaacacatatcaatacaactgtaactcaaagaaagctgaacactatttcttgtctgacagtgctttccatgtttgaaatttgatttgggggaactgtatcagatatcaaaggtttaaaacactagatatggccgggcgtggtggctgacacctgtaatcccagcactttgggaggctgaggcaggcagatcacctgaggtcaggggttcgagaccagcctagctaacatggtgaaaccccatatctactaaaagtacaaaaaaattagccgggcgtggtggcatgcacctgaatgtgagctacttgggaggctgaggcaagagaatcacttgaacccaggaggaggaggttgcagtgagccaagatcacgccagtgcgctccagcatgggcgacagagcagggctcccatctaaaaaaaataaataaataaatgtaaattaaacagatatcaagataagaaaggtttgaaatgctcagtgttaaaataagatcacaggtcattgtaaaacagtcatttaaacaaagtgataagtcagtgatttttaaaaagtcaaaacctgtgctctttgattagcaggagactccatcaaagagtaagtttgaggagactgtatcaaagagtaagactccatcaaagactcacttttccaaataagacctaataaaggcagcatgagctcaagaaaatctctctctccctccttttcttttgtagtttactcaaaagtaaacaaaaccttttactatctcctgttaacactacctgaaaatcttgttcaaaagagaaaacgaaatcctacctttgtatcagtatattattaatattaaacctaattttaataaaatcttacaataaacagatccatctgagcccagtcagctttgaccagataagattttcatgaatcttttataaactcttacaattttattttttctttctccaactttttagttttagctatatcatgtaaattttgaaacaatctttaacctctaaactaggcaaaattacttttcctttagcaaaactcacaccctcctctcttttttataactttcttcaccaaaaacacatcctactttcattgtatactttgcatacaagagtgtttcccatgtatctagtacttttaattacatatattaactacgattttaactcttagtagttctaatttcaagtgaaaaacctagaaagtaagtagtagttaactggtttatgtctgtatttgtagacaaatcatttcatggtttcgtagaaagatatttctataaaatataattgatgcctacttttttgtttattaacagatctaaagattattaacagatctaaatatatttagcttttttataccatgtaaaaacaaaataccaaattatgtaaactaaactaaaacatatctaataattaatgtttttgtatcttaatgtatgtagaaatgactcaaacattttatgattatctattactttattaaacctaacatgacttcaaaactttaaactactgaaaagaattttgaaactgcaacacagatacccttcctaatgtcttcctcagtcatactgagtcgcaactacccacgtggcacccaagtatgattatgaaggggcagggcctatctgagtcctgattttacacacccataatggagcccaggacagaggacagaactgtgaagataatgtctgactcttcccaccatagccaggagacaacagccaggccagagggagtaccacatatgtctgcagtcctcacttgttagagcccagaatctaatgagtctaatacataagctcacagacaagtcaaataagcatcaaacatatcacagaagcaatagttttatgagcttcagacatctagtagagaaagcctaaacctttctgaccagcagacccaggcaaaaatgtctgattgtgtttaaaactgacaagtctgaagacattctaattttattttaccaacaattaaaaagctaattttatttctcaaagattactaaaatcacattaacttgaaaaatatttgggattattaagctatgagcattaatttgtcagtttggtaccatgtaaacaatatacaaacagatctgtacacatatatacataaaaatacaaacataagtgaagatttcatagctttgatataaaaattctagccatgagacaagtaaaactcgctattttaaaaggacattggattcaaagttcataaatagaacaagttcaagtttattgtatatgcctgaagcccttaccaagttttaaataacaagtagcaaatttatatttcaagcacagagaatttaagctttccaaaaggccaattcaattttacgttatctttggcaaaaatcatgttaacagaatccaaaacagtaaaacataaaggcctttcttctacaaaaaaaaaa

SEQ ID NO: 11290 - DNA, 2655 bp, Homo sapiens
ccgggcatggtggtgcgcacctgtaatcccagctacccgggaggctgaggcaggagaatcacttgaacctgggaggcggatgttgcagtgagctgagatcatgccattgtactccaccctgggcaacagagcgagactccgtctcaaaaaaaagacatgagaataaaacagtttactgcatataccaaggcatatcagatgtttaggaattgcatacaattttggaacacatatcaatacaactgtaactcaaagaaagctgaacactatttcttgtctgacagtgctttccatgtttgaaatttgatttgggggaactgtatcagatatcaaaggtttaaaacactagatatggccgggcgtggtggctgacacctgtaatcccagcactttgggaggctgaggcaggcagatcacctgaggtcaggggttcgagaccagcctagctaacatggtgaaaccccatatctactaaaagtacaaaaaaattagccgggcgtggtggcatgcacctgaatgtgagctacttgggaggctgaggcaagagaatcacttgaacccaggaggaggagggttgcagtgagccaagatcacgccagtgcgctccagcatgggcgacagagcagggctcccatctaaaaaaaataaataaataaatgtaaattaaacagatatcaagataagaaaggtttgaaatgctcagtgttaaaataggatcacaggtcattgtaaaacagtcatttaaacaaagtgataagtcagtgatttttaaaaagtcaaaacctgtgctctttgattagcaggagactccatcaaagagtaagtttgaggagactgtatcaaagagtaagactccatcaaagactcacttttccaaataagacctaataaaggcagcatgagctcaagaaaatctctctctccctccttttcttttgtagtttactcaaaagtaaacaaaaccttttactatctcctgttaacactacctgaaaatcttgttcaaaagagaaaacgaaatcctacctttgtatcagtatattattaatattaaacctaattttaataaaatcttacaataaacagatccatctgatcccagtcagctttgaccagataagattttcatgaatcttttataaactcttacaattttattttttctttctccaactttttagttttagctatatcatgtaaattttgaaacaatctttaacctctaaactaggcaaaattacttttcctttagcaaaactcacaccctcctctcttttttataactttcttcaccaaaaacacatcctactttcattgtatactttgcatacaagagtgtttcccatgtatctagtacttttaattacatatattaactacgattttaactcttagtagttctaatttcaagtgaaaaacctagaaagtaagtagtagttaactggtttatgtctgtatttgtagacaaatcatttcatggtttcgtagaaagatatttctataaaatataattgatgcctacttttttgtttattaacagatctaaagattattaacagatctaaatatatttagcttttttataccatgtaaaaacaaaataccaaattatgtaaactaaactaaaacatatctaataattaatgtttttgtatcttaatgtatgtagaaatgactcaaacattttatgattatctattactttattaaacctaacatgacttcaaaactttaaactactgaaaagaattttgaaactgcaacacagatacccttcctaatgtcttcctcagtcatactgagtcgcaactacccacgtggcacccaagtatgattatgaaggggcagggcctatctgagtcctgattttacacacccataatggagcccaggacagaggacagaactgtgaagataatgtctgactcttcccaccatagccaggagacaacagccaggccagagggagtaccacatatgtctgcagtcctcacttgttagagcccagaatctaatgagtctaatacataagctcacagacaagtcaaataagcatcaaacatatcacagaagcaatagttttatgagcttcagacatctagtagagaaagcctaaacctttctgaccagcagacccaggcaaaaatgtctgattgtgtttaaaactgacaagtctgaagacattctaattttattttaccaacaattaaaaagctaattttatttctcaaagattactaaaatcacattaacttgaaaaatatttgggattattaagctatgagcattaatttgtcagtttggtaccatgtaaacaatatacaaacagatctgtacacatatatacataaaaatacaaacataagtgaagatttcatagctttgatataaaaattctagccatgagacaagtaaaactcgctattttaaaaggacattggattcaaagttcataaatagaacaagttcaagtttattgtatatgcctgaagcccttaccaagttttaaataacaagtagcaaatttatatttcaagcacagagaatttaagctttccaaaaggccaattcaattttacgttatctttggcaaaaatcatgttaacagaatccaaaagagtaaaacataaaggcctttcttctacaaaaaaaaaa

SEQ ID NO: 11291 - DNA, 463 bp, Homo sapiens
cataaaataagaatattcacaaatagttcccaaattctggagaaaatcaggtaaagaggaaggtaaatgtttcacttttccccacaaaagtatactttacctaattgctatgagctataaatggctcaaaaaaaatgtggactctggcaaaacaaatatgagaagaatcaacaatgtttcaaacaaaaagtgattaaaaaatcatttcagtcctctatcagttcagtcccatgtaattaattcctgttctgtttcatgttggcttagcaatcttcattaacacatcagttttttattcgaattttggaaatttttacctagtccaatggtatcatctccatagttatctgaaacctgtattcaagaatacttgaatatggtacaaactcgtattcaaagtcctttccacgaatttctttgaagacacacattttaggatttggagggaaacaaagctcttaaa

SEQ ID NO: 11292 - DNA, 157 bp, Homo sapiens
aggctagctatgtgtatatatatagctatgtgtatatatatatatgtatatatatatagctatgtgtatatatatatgtatatatatatagatagcctgaatgtcagcttttaattaagctaatttctggctatagacctctttcaaagaaaaaaaa

SEQ ID NO: 11293 - DNA, 463 bp, Homo sapiens; identical to SEQ ID NO: 11291

SEQ ID NO: 11294 - DNA, 157 bp, Homo sapiens; identical to SEQ ID NO: 11292

SEQ ID NO: 11295 - DNA, 184 bp, Homo sapiens; identical to SEQ ID NO: 7572

SEQ ID NO: 11296 - DNA, 147 bp, Homo sapiens; identical to SEQ ID NO: 6794

SEQ ID NO: 11297 - DNA, 143 bp, Homo sapiens; identical to SEQ ID NO: 7597

SEQ ID NO: 11298 - DNA, 170 bp, Homo sapiens; identical to SEQ ID NO: 7598

SEQ ID NO: 11299 - DNA, 171 bp, Homo sapiens; identical to SEQ ID NO: 7603

SEQ ID NO: 11300 - DNA, 141 bp, Homo sapiens; identical to SEQ ID NO: 7393

SEQ ID NO: 11301 - DNA, 162 bp, Homo sapiens; identical to SEQ ID NO: 6214

SEQ ID NO: 11302 - DNA, 193 bp, Homo sapiens; identical to SEQ ID NO: 7396

SEQ ID NO: 11303 - DNA, 98 bp, Homo sapiens
tgtgaacctgggaggtggagcttgcagtgagcggagatcgtgccactgcactccagcctgggtgacagagtgagactccatctcaaaaaaaaaaaagg

SEQ ID NO: 11304 - DNA, 153 bp, Homo sapiens; identical to SEQ ID NO: 6795

SEQ ID NO: 11305 - DNA, 202 bp, Homo sapiens; identical to SEQ ID NO: 7667

SEQ ID NO: 11306 - DNA, 166 bp, Homo sapiens; identical to SEQ ID NO: 7670

SEQ ID NO: 11307 - DNA, 190 bp, Homo sapiens; identical to SEQ ID NO: 7674

SEQ ID NO: 11308 - DNA, 193 bp, Homo sapiens; identical to SEQ ID NO: 7690

SEQ ID NO: 11309 - DNA, 195 bp, Homo sapiens; identical to SEQ ID NO: 7691

SEQ ID NO: 11310 - DNA, 2884 bp, Homo sapiens
gaggatgactcgtacgatgacgagatgctgtcagccattgaggggctcagctccacgaggtgaggtctgagacctctgtccacccccctctcctctccccctcggataggggtcccctatatgggcaggcccatctcataccccatgcctggtggcccagccttgttccttccccctgcctgctgccacctcctgagggaatggaccccttcccagcccccatctcaccgcagctgcccccgcccacaggccctgctgctccaagtccgatgacttctacacctttgggtccatcttcctggagaagggctttgagcgcgaggtgagggcccccagcagcctcctccgcagagggacggggtctccaggcctggggtagggtgggggacgcaggtcatggggcagcctgcgttcccaagaccggctaggggaggggcactgagaatccacagctgctcctgggcggggggcaggggcggggccagtgcagcaccagcctggctctctcctgtcggcttcattccatgacccaaatgcaccatcagagatttgcctccatgggtctgcaagacttttgctccgtccagtgccaaagccttagcagatcctggcatggatgcctcaggctgatgggcaccggccttgcaatgagacgagaacccaaagctcagttatcagtgtcctgtcttgctgctatgagctttttgtactgataacgaccatttctttactgagcgccttctgggttctggcagcatcctcggcacccacattatataatttaaccgtcacaacggccagcccaggggtgctgctataccacttcacagagaggaaactggctctcagaggcttcagagcctgtccccagcttcaggtgtggctccctgagttgggggcttcctaggtgaggtcacgaggaaacctgctggccaagtgacctggcagggtgtggccagtgtggccagggccgccgagcctgctttccttccctgcagcaggaacccttctggggctgtgatcctgcgatggtgcctgggtgggagtgggggtggggggcgggatggtctccctacctgccagcttcttggtttgaggtgaggacagccccggaagctcagacttggctcctgtccatgtacttggggccatgagctctgcagggaccttggaaagagagagacgggtggtgtagggcaggggaaggcattgtcttcaaacaggaaaaagctgagaatggaaacaggcgaaacttaccaagtgtaacatcacctggaactgaaggagggtgggaaggttttaattattttaaaaatagagatggggactcactatgttgcccaggctggtctcaaactactgggctcaagtgaacctccttcctcggctcccaaagtgctgggattacaagcgtgagccactgtcccagcagggaggtgttttttttaaagctgattcactggaggcagggtgggcaagtggcactgctggtggccacccctcacagtccctgctgcccccagtaccgcctggcacccatcccccgggcccgccacgactttgcctgcgccagcctgatcttcgtctgcatcctgctcgtccatgtcctgctcatgcccaggtcagttgcagggaggggtgtgggggtccggcctgctgggatccaggctggaaggtgactatgaacctgcaaggagctgtgtgatttgggctggaaggggtcggctgctggggtcctagcaactggaccaggggctgtggcagcacaccttgagttaccaacacttctttttaatagaatgtgtgttttctgccacaggcctccctactccctaacgtctctctcctcagccacctgtcatatgtgtggcctgcatgcattttggttgacagcccttgccttaggtgtttggagtgctaggaggatagactctgaaaactgtaggcgccatcctttttctcttatatatagggaaattggggcacagaggattaatgatttatccaaaactcactgagattcatgcttctggctctagggccctgctggtggggtatagggatgagggtgaagtcagagggaagggggatctaaggtcagctacttggtgctttctagaagagcagttaggccgaagcatcgaccaggattgtggttttggctatgcttactaaagacataatagggaggctgtgcgtggtgactcacgcctgtaatcccagcactttgggaggctgcggggcgaatcactcgaggtcaggggtttgagaccagcctggccaacatggtgaaaccccgtctctaccaaaaatacaaaaattagctgggcgtggtggctggcgcctgtaatcccagctactcgggaggctgaggcaggagaatggtgtgaacctgggaggcggaggttgcagtgagccgagatcatgccactgcactccagcctgggtgacagagtgagactccatctcaaaaaaaaaaaaaaaaaaaaacgaagaaagatgtaatagggaatgcgtttttacagttttttctgagtctaaaggctgcagagacattgctcatttcttatacacttggaccaaaaagagtgatatggtcttgacctcaatcttcataatctagctgggccctgtgtattgcccatggggcagctgggccacagttttcacaggtcccctttgctgtgggcagaataccaggtagggtggggacaggtggctgtgagccagaggattggtgggggcggtggtcctgggcagaaggccctaggcagaactgaggttcttccctcctctccaggacggcggcactgggtgtgtccttcgggctggtggcctgtgtactggggctggtgctgggcctgtgctttgccaccaagttctc

SEQ ID NO: 11311 - DNA, 136 bp, Homo sapiens; identical to SEQ ID NO: 6219

SEQ ID NO: 11312 - DNA, 202 bp, Homo sapiens; identical to SEQ ID NO: 7718

SEQ ID NO: 11313 - DNA, 153 bp, Homo sapiens; identical to SEQ ID NO: 7724

SEQ ID NO: 11314 - DNA, 150 bp, Homo sapiens; identical to SEQ ID NO: 7399

SEQ ID NO: 11315 - DNA, 142 bp, Homo sapiens; identical to SEQ ID NO: 7400

SEQ ID NO: 11316 - DNA, 181 bp, Homo sapiens; identical to SEQ ID NO: 7737

SEQ ID NO: 11317 - DNA, 147 bp, Homo sapiens
acgcctgtaagcccagctactcaggaggctgaggcaggagaatcgcttgaacccgggaggcggaggttgcagtgagctgagatcgtgccactgcactccagcctgggtgacagagtgagactccatctcaaaaaataaaaataaaaa

SEQ ID NO: 11318 - DNA, 166 bp, Homo sapiens; identical to SEQ ID NO: 7759

SEQ ID NO: 11319 - DNA, 268 bp, Homo sapiens; identical to SEQ ID NO: 7767

SEQ ID NO: 11320 - DNA, 368 bp, Homo sapiens; identical to SEQ ID NO: 6222

SEQ ID NO: 11321 - DNA, 2893 bp, Homo sapiens
caggttaccgaggagacctgcaccatcctccagggcctcgggtactcttgtgaatgccgtggcctgatcaacgtcaaaggcaaaggcgagctgaggacttactttgtctgtacggacactgccaagtttcaggggctggggctgaactgagggctcctgctggattccgaaaaggccgggaagccagtctccttccctgaagcaagcccaggagaagactctccgccccacgccaatcccaaaggcatgcagatggctgtgcatgttggcttctttggacctgcactggaggatttctcagacacatgcaccagattctggctcgaagcagccactgagccataatgcgcaggggaggccagaagctctgtgcctggtctgtaacagtttccaggccagctggagaatgttcactggttcggggctgactttgagatctttgttccctgaggtgccaggcaggcaactttagcacatgatgaaaacagacttccacctcagtggcctgtgggcacgcacaagtgaggtctgtttttctagacaccaagggggagtaagctgagctgtctagcacggattggagactccctctccctggtgggcctggcaatgacagcatttctcacagaggcattctggtaaatgaagctgaaaggggtgttttacatctgtaaacggtttcaaacaggtagagagaaaaacaccacaattaacactgttactttttgccttgtctggcatgtttgttttaaatgaatacattaatggggtttttatccttttgaatgacttttcagacactagacataaatctcttccctccagtgtatgctctgcctttttaaccactgacatgtaaggaggactactgtctagcatcagcttatggggtcagctggctgtggggatagagtcctgaggaatgtggtcacagcaagaagacggtgagcagcagagctttgcctttgaatgaggcagcttgtgaggcaagcattctggagagaggtgctttgaaagtaaggtgcggcctttcacctcttccttgattactcacacatctttgcgttctcccctgccgtccttcaactgtatcttacttttcttaccagaaaggaatggagtctgtttagagacaacttggacaacctgtgagtgcatctcttctttcctttagtcttcacagctaactctggagagcttcaaaactagaaggatctactccgcatgggtgcatgcagaggctcctggatctgggaagcccgccccctcacaaatgctgagccgttcttgctctgaaactgcgtgagtcaaggcaaatgcaaaaagccaggttttggggatgtgtcttactgtgcttcaacttcccaaggaattgaaagtcaacctaactgtaacaacagggtgagaaatgaccaaactgcccgtgactttttctgaatggacttcataaccggaagacttaaccggtggcctcatcaccagagcatcgccaggatttctaatgcactcagtttccctacatagcagggattcttagctaggtgtccccatgaaccccgtaaagttctacacaaagtcttgcatacaggagcctttacaagatgattatacagggttgcagattgggtgactgaccagacttgttggggtcctgggatgagttgccccgggctgcaaattaagagtacagctaagtgcgggggtggcggtggagggaacgaaaattgaacctgtctgcctgtgctgtgtcgtgtggctttatcagcccgaggaagggcaggtgtattctaatttgcacaaaggtgctgggtagactagtggcagctctcatgtgctgcacataagtggaatcagtatgaatagaagaacttgctgtataaaggaatttcatggcaacaatgctggtaagggcaattagcctcgcttaagttgccttttttacacaccaaaactttttacatgaagggctggtttcacatgaatactatactgaaatctgtgctctcaagatctagcagtgaccagggctgcccggcgggggctctcctggcaagtcaggaaggtttctgttgctaatataacatagaaacacattagtgcactgggcctctctgaggtcagcatatttgtactcttggaatatttgtttttttcttcagtaacaacagaaaccccagttgggagtttaacaaataactgactaccactcactcatgcatttttatttccaattaaagcaaagcactgtgctgtgctcagataataatagtttgtaagtaaaagtttttagttttcagtgttcaggttatagaatataactgaccataaaaattacctgcaggtattttctttttatgaacttgtttttaaattaccaagtaattactggtgtcattttgttttatgacagacacacgtatctaacaaacaaacaaacagtgaccttctccatgggtcaaggacttccttacaatttctcctgagttaacttttgtgaaaataatacctaaggttttctggcttattgaggaaatttcctaacaaacaaacaaacaaacaaacagaagagaagatcattaaccactgtatactttgtgtatataataggtcagtgtaaagaaatatgatttgaggtggtgcatgcaagtaactagggtttattctatataatgaatatttatagatctgtaacatttgtttcaaaatgctgtttcatttttataaagtaccagtgtttagctgctttttatacattaaattagcaatttgaaaaactcaaatatctgaaggtattttattttcgtggtcctcatgaactcactagagattaaaagtagactcaaacaacttgaaaatttgactcttttagcataagattttaagtcttttcagg

SEQ ID NO: 11322 - DNA, 1548 bp, Homo sapiens; identical to SEQ ID NO: 7779

SEQ ID NO: 11323 - DNA, 4704 bp, Homo sapiens; identical to SEQ ID NO: 7404

SEQ ID NO: 11324 - DNA, 1494 bp, Homo sapiens
gcctttgattccttccctctgaagacagacaaaatcctgacttaggcagtattttttaaaataccaagggtctcggaaacctagggttttataagtaagaggaacagatcaaattctaaatctcctttgtccacattgtcattctccagcttgttgttcttttcagtggtgaggtaagaatataactcctacttaatgttcctgttccttaggtgaaacactaccaccttttgttcaaaagttagatgctggggttgttgctgttgttgttttcttcttttcttcctttactttttagattttgatggagacgtggtaggaagtctgggctgggaaatgaggtgaaaaagaaaagcaattagtttgtctttatacaaaataaaaccttctaaaaaaccttattatcacaaaaaagagctctacaaatctagatagttgttttgaagaagagaagagaattgtgaaaaacatgtataatttgggagggctgggcacagtggcttatgcctgtaatcccagcactttgggatgctgaggcaggcagatcacctgagatcaggagtttgagaccagcctggccaacataatgaaaccctgtctctactaaaaatacaaaacattagctgggtgtggtaacacacgtctgtggtctcagctactttggaggctgaggcacgagaatcgcttgaacccaggaggcagaggttgcagttagctgagattgtgccactgcactccagctttggtgatagaacgagattccatctcaaagctaaacaacaacaacaacaacaataacaacaacaaaaacatgtataactgggaaaaaactgaaagagaatgcaggatcataaaaatatagcaaacaaagtgagtgggatttaaaattagtggaataagaaataatgggtaacaatgaagaacataatttaggtaatagtatagtatcttgggagccctcctggaagtatctagttatggacagtgagcagcagaaacaggatgtaactcaattcagcatacttgatggttgtggtaaccctagaaaatgactccaggaaataggtgagaatccaatcagattgagaggctaatgttcatgacaggggtgccctagcagacaggcaaagctgaatagaaattcaggaggagaggaattttggctatttagtaaaattatgagcagttggtcataggcaaattttatgagtaggtagcccttctgaagtcttaggcatataattaacctaggttggaattataattagacatgaaagtttaaacttttttatctgaaccgagatgcaaaagtaaattggttctgtgttctggagaattgtaaaagaattccttaattccttagcaaaatttggaagtcagtatcaagtggtgaggataggaaagttgaagagactgtggaccaggcaagaccttatcagttgatttaggaagcagcagtgacagaggccagacaggtaacaagagaaaagagaa

SEQ ID NO: 11325 - DNA, 2122 bp, Homo sapiens
gcggccgccgagggccggcgactcccggggcaccgggcggctcctggccgcgggctctgcgtcttccccgcgggcgccaggcggctctcggcgggctggccggttccacgccgccagccagccccgtgtggggacttcggtctagtatttggacccgaggagataattctgtgtggaaaattctctcccttcggttggaaacagtaacaaactggaaacggatgaggtgttatggacgtgcttggaaatgcaagaaaccttcagattacgagctgttgacgggaccagttgtatttcacgtttttcgaattaagctcagaatcagttttcagaatgacatgtgatgcgtggtgcgtggtgtgtgtgcctgtgtgtgtgtatggatataattcattcatttttgtggcgtcagaaaggttatgtcgagcgttgtagcggcttcttaatttacattcacggcatacaactgaagaggagccattatttattttttttcctagcatttgctgcgactacacactgccggagcgtttggaaatgttgtttgctgttaccctgtatttgtctataaaattcttactgtagggaatggccaagtggaccatcagttcgtcctgagatcttctcatgtctctcacgtctttgaaaatggcctgtgaacagactgcatcatatgtaggatgtctggcaaaatagtgtacagcgttcttttctcaaatgagaggaaatgtgtaccttttcgccgcgttgtgacaatgtaaatgttaagaattagtctaaagatgaaaattctttggccaaaacaagataagccttatcgatatgaaaactggaaaacatcacatgggactggaaatcctgtgagtgggtgctcatgacggaaaccctgacagaccttggattccagcatcgctggtgaaaatcagaccttatcatggataagggttaagatgtaaggtgtctcacccagacgccatctgttccagctgtcaatgcagaagccaggaaaggagagagagctggccagggagaattccagctttttttttttttttttttttttttttttgagacattcatgtgaatttctctgcgaggggaaagaagaccaattattttccttggatgctgtcccttcttttggaattaataagatggcttcactcagtgagaggctgtaaagacatttcactggaaacaggcagtaacagtggccagttgtttctgttaataccatcaaaatatccctactcttgtttgtgccttgaagaaagtccttcatttaactgagacatctgagcctgcgttgcggattctgattctctaaatactcctgcaagaatccctttaatttttcactgtgcaactcaagaaggacctttctagggtattgtcaggatacgtatgctaatgatattgtcaggttaggtgagaatgattgatcactcccttaaaatccttttttatgatgttaaagctgtactttaagaaagataaaactgccactgtggcgttgcaagtctgagctagctcaagcaaacaaaggaaattgcgttaaatttgcccaactctattttctcatcttcatatagcaagactctccaaacagcaagtgatctaacctatcaagtattatgcaatagctgaatttccttgcaatggtcagtttaaagaactgttaacttagcagaggcgacgtctcgtggccaaggcccttagggtccactccatggaatcaggaccccttgctgctgctttgcgagtgttcatggaggaagaaaaatcacttggtgttctttttttgcatggaagagtcataataactgacttcagatacagagaaagtgggaagagtgagaaagaaggaggtgaggccagaggatttggaaggctaccagagagaagcagccgaggcctgattgtggaaatgatgcttagacttgctttcagcaggagtgatgaagccagaatgagggaggcccagacgcccgggagaggtacaggggataggtgccatgtggtttgcaccaccgcagcaggctttgggtcccaaagacgcgaatggaaatagaagaaaatgcagttttaaatagaaaagaaaaaaaaaaccgagaaaatgtta

SEQ ID NO: 11326 - DNA, 669 bp, Homo sapiens
ggcccctgtgcacagtgaagggacatgccagaaaccagcagatacttgactgagacagaccaggacaggagcttgtggcaggaaggataaggaaaaatgcaaatctaccatcctgccctcagggtgctaacccttcgggggagaatactttctcccaccaggaagaaaccagaaagtaaaaatgtaggatgaaatgaattagtggattgtgtagaattctggaagcgtggtgggaatccaccataagggaaagagaaagtcttctgggaagcggcgttgagttgaggcccagtgtcaggaaagctctggtatagtggggccatctggtccctcttacagggccccctcccactttgttttggtaagatgggatctgacggcttgccatcctgtcactccttgccagtagatgcagtgctggccatgctgctggtcattgggtttccagttgggaagttgcatgtgctggcctttggctcttgccaggcagggccttttgtgactgggagctcatgtgggtcatgcatactgtactgtgaagggcatggtctgtggaggggaacagagcagcaggccctaacctgggtggcaccactttgctgtccctaccatttttcattgcaggttgaaagtctccaaagtggcaggggaaggggtgtaaatgttaaa

SEQ ID NO: 11327 - DNA, 19436 bp, Homo sapiens
gcgcgcaggcggctggctctgggcgcgcgccagcaaatccactcctggagcccgcggaccccgagcacgcgcctgacagcccctgctggcccggcgcgcggcgtcgccaggccagctatggcccccgacccggtggccgccgagaccgcggctcagggacctaccccgcgctacttcacctgggacgaggtggcccagcgctcagggtgcgaggagcggtggctagtgatcgaccgtaaggtgtacaacatcagcgagttcacccgccggcatccagggggctcccgggtcatcagccactacgccgggcaggatgccacggtgagcgcagccaggcgggggcacaggagagggcgggaccggaggctgagtgcaggggagacagagttacgcactccgagccaaacaccgactaattcggaggaaagcccggaggcgcctgatcatacctgttgcccggtgattgggtgtcctgcggatgcgggatgaaaaggcgggagagaggcctggagaagtggagtctggggagtggggatggaggccaacaacacgcacacacaaacaaagggtcccgcctccctgccgtgcattccatctgcagccccgagcctcaggtctctgggcggggacagaaccccgagctgggtaggctaggagggaggagagcaaggatgcaggccgcctggggagggagggggtcagtggccaggggagggagtcacatcctgtctcgatggctaggagaggcagcgcagccgcgtctggacctaggtgccggtctccactcgccagcaggagcggagagggagcaggaaaggagcccattctcgaggatggggctgaaacgggaagcttggggagaccgctgccttggggacccctgcgtcgtgtgaagactggaggacgcggaagggacagcgctggccggggagggcaagcggccgctggcgtacataagggattgggaatggcatacacttagcgaggacccccagagctgttctcgaatcgccggggaggccactgagccgcaggccagcgaggtcttcagctattccgcggagcggaccgctgtttacgctctggggcggtaggcccttcgcggggtcctgtcccttcttcccttggtctcactgcggggtcggcgcgcgccccagccccaggcctgctgcttccctttctagaccacagccctcagagctaaggccccggcgcctctctgctgggttggagtcctggggactcagtcctagggactcgaaagtcggggcgttcccttcaccgcgtttcccccttggcggccagaatggcgtcccctccccttgcatccccctctgatcccgtgccctgcagcgtgatgccctccactgtccctatccactaccctggcgtcccagagtgtgccgcgggtcaccaggttcccataacgtcgcagcagagcttagacgctgcggggcgaagacccgccccaccctctgacgcgaccagcctagtgggcgaggccagagcttgcgcgggtcaaccagagtgaccactcgggagccctgactgcggccaagggcgcaggcgtgtcccggcgcatgcgcagacgaaacaggcaccaacgctggagcttcccgcagtgtgatttggggccgggaatgccgcggcggggacggcgattggtccgtatgtgtggtgccaccggccgccggctccgccccggcccccgccccacacgccgcatcacttacagggcccggggctgccggacctgccaacgtgaatcttatcgccatggaccttaccttgcacaacccaaagtagctgccttggggcagggggtggccagagtgcttagggaaatgtggagccctacccagaacaacggtggagggaaagggaagaaacgcagaagtgccccagttcggacgtagggaagtcttcctcttcgtggtttttggagaaccctagctaagagaggaaagggacttattgaaagacccgcaagaagggacggaagtctcatagccctgagaggtgaagccagctggagttgatgggtcgaatggggacctagagaacttttctgtatctagaggtttgtaaaatgcaccaatcagtgctctgtaaaaacgcaccaattggcgctctgtagctagctagaggtttgtaaaatgagccaatcagcaggacgtgggcagggacaactaagacaataaaagctggccaccccagccagctgctgcaacccgctccagttcccttacaggctgtggaagcattgttcttttgctcgtcacactaaaccttgctgctgctcattctttgggtctgcaaagagtgttattcctttaagagctataacagcgggaaggtccacggctccattcttgaagtcagtgagaccatacccgccggaaggaaccaacgcccgacacagccccacccatctctcctgtttctcacctatactgaaattcttgggcaaaagctgtctgtggacacacccaggggaaaggccagcccaggcaggtgtttcttagtggttcccctcagccaatgcttcccattccttgatgcatccttctaactagagcagatactcggtgatcttaaactgtggacacctgggagcaccctcaaaaggcagctgggcctagggagatggcctgtgcttctgtgtcaggagttggttccttcaggtgggctcgtggtctcgctgacgtcaagaatgaagccatgaaccttcgcggtgagtgttacagctcttacaggtggcgtggacccaaagagtgagcagcagcaagatttattgtgaagagcaaagaacaaagcttccacagcgtggaagggtacccgagcaggttgccgctgctggacgttggggggtgtgagggggagcagccttttttttttttttttttttttgagacggagtctccctgtcgcccaggctggagtgcagtggcgcgatctcggctcactgcaggctccgccctcccccggggttcacgccattctcctgcctcagcctcccgagtagctgggactacaggcgcccgctacctcgcccggctaattttttgtatttttagtagagacggggtttcactgtgttagccaggatggtctcgatctcctgacctcgtgatccacccgccttggcctcccaaagtgctgggattacaggcgtgagccaccgcgcccggccgggagcagcttttattcccttatttgtccctgcccatgtcctgctgatttgtccattttatagagcactgattggtccattttacagggtgctgattggtccattttacctctagctagctaaagagcacggattggtgcattttacaaacctctagctacagaaaagttctccaagtctgcactcgacccaggaagtccatctggcttcacctctcacttcaacttgggtacagccttctggcgggcaggaggatggcctttggtgcgaacactgccggagtccagggggctggctccctcacctttcatcttctcccggcacttgcaggatccctttgtggccttccacatcaacaagggccttgtgaagaagtatatgaactctctcctgattggagaactgtctccagagcagcccagctttgagcccaccaagaatgtaagaccctgtgtttgctatgtcgcaactattggttgttgagggggacagagagggggtggaaggagagtctagatgggatcacagtcatagtaatcacagtcagtagtagctctggggagtcttgaggtccctgcttctcttgcatagtcatgaggtcacaggcccaagggagcatggctttgcaacctatggctcccccaaggctgccactaccatggctgccatcattgttatcatcattgttatcatatgagcacttactatgcaccaagcataaactcataactcttacacatttacagatgagataacaggctcagggaggttaagcaacacagccaaggatcacacagttagtaaatggcagagcaaggacttagtcccctgaactcttaggcactatcccatggcacctcctcctgtcatcctcattgtcgtggtatctttgcctaggactgtggacttcccacagctacctcagtgggaggtccttgagcctgagagggcccttgtctccagtagcattggggtgcagatgagaagaataacagctcctcttcctcttctgcagaaagagctgacagatgagttccgggagctgcgggccacagtggagcggatggggctcatgaaggccaaccatgtcttcttcctgctgtacctgctgcacatcttgctgctggatggtgcagcctggctcaccctttgggtctttgggacgtcctttttgcccttcctcctctgtgcggtgctgctcagtgcagttcaggtgagagcctttggcttgtcaagtgcacagcaatgctcagcatccctggggaaagctccttgggtgtttgaggaaggccaagagtgcctgccctccaagcagggcagatctgaaggtatgcaggagtgagtgcaggaacatgcattctgctgtcttgacctgtctgctctttagccacatggacatcttcatttctctcactgcctttttagctgcttctccaagggttctcttcttcctatgcggtttgttctctgccacagcccacctgtgccaggagccaagtttctggtttcttagcaaagcttggctccctccccaccactgacattgcccaatatgttaataatgattgagcgctaattcttgactgtcaggacccatttggcaagccttctgctcatgtttcagtcctttctgtattctagatgtcagtccatcataagtcatgagcttcaggccaggtgtggtgactcatgtctgtaatcctagcactttgggaggccaaggtggccggatcacttgatctcagttcaagaccagcctggccaacgtggtgaaacctctactaaaaatacaaaaaggccaggcacagtggctcacgcctgtaataccagtaccttgggaggccaagatgggcagatcatttgaggtgaggagttcaagaccacctggccaacatggtgaaaccccgtctctattaaaatacaacagttagctgggagtggtggtgggtgcctgtaatcccagctacatgggaggctgaggcaggagaattgcttgaacctgggaagcgaaggttgcagtgagccgagttggcaccattgcactccagcctgggcaacagagcgacactctcaaaacaggccaggtatggtggctcacgcctgttatcccagcagtttgggaggccaaggtgggcagatcacctgaggtcaggagttcgagaccagcctggctaacatggtgaaacctcgactcttactaaaaatacaaaaaaatcagccaggcttggtggcgggcacctgtaatcccagctacttgggaggctgaggcaggagaattacttgaacccaggaggcggaggttgcagtgatctgaaaccgcaccattgcactccagcctgggcaacaagaacaaaactgtctcaaaaaaaaaaagtcatgagcttcggagctggcgaaacagaagaacagagaagggatggtgatttgccccaactcacgtgtgagtcagtggcagaggcagaactaggacccatgtttcctgactcctgaggtgcatcacaggccttggcagatgaaggaagtgggagaggctgaaggaggcatcgaggtcagtgaaggcgacactggggctggtgggctgctctcagtgttgactcttctcacctaggcccaggctggctggctgcagcatgactttgggcacctgtcggtcttcagcacctcaaagtggaaccatctgctacatcattttgtgattggccacctgaaggtcagtgggatggggaggagctctctaaaactccaggcaatgaagggctgccttgggggaagcttttcatactcgtgtccctgcttttctgtagggggcccccgccagttggtggaaccacatgcacttccagcaccatgccaagcccaactgcttccgcaaagacccagacatcaacatgcatcccttcttctttgccttggggaagatcctctctgtggaggtgcgtggaggtatcagtggaaaggtcttggggaataggaggcagccaacataggggagttggggaagatgcccacgatgttgtcagtgtgggcaagacactggggctgggctggctggggcttttgccattttggaagttctggaaggcaacaggcaatagatgggggctgcccaggagggagtcaccatcctccctagagagttcagtcagcaaaccgttactgcataaaaggcacctcattttgcaaaggatccagcggatgaccagaaggatccaaatgatgagatagcctatccttgaaggtgctgatggcacctcctggaggtgcttttttgacactcttgccccaggcaagtattccccttgcactttgtatttctctcccacacttaggtatccttcttgtcacagtcttctctgtccagggctggactgtcttactcttctttcatgtccaatatctggaacattcattcactgagtacttcttcccaccctgctgatccccagcctgatttcctgggtggtcagcgttgggtttgagatgtcgtctgaagttgtaagcagaaataatgtagctgctgaaggaataatgcctgggggtggagatctggtgagcttttagtgagcattaggcaatggaaggttctaaaaggccagcagaattctttgaaaagttcatttaaagccctttgtcccaaggctgtaggctgcagagttcttccaggtccacctcctccactttgtgacatttcagcttgcgaggaattaaattgtcgttaaaacacatttcagttctaggcatgagttcaaggtagcctggcgttcctctcgcccctggccatgagaactttgaaagggctttggcagcactggttggcctggcatgaggagctcatagcttgaggctcatgccccacctgtccataatgttcttattttcccatcatgagcatggacttgggtttgttacatgtccgataccattatggtcagtactatgcagatgacgaagcagccctgtcccccgtctgactcccatggctgcttcaagggcagtgtggttatttgctgggcagtggcatggggcttgtgcatttctactgtcactacagagggtttaaaaaaaagacatgggcaggttaagtggaagggaacagtctcacaccactacctttattgcttcttggtacttgggttttcaggaaattcctatcagcagacatcaaaaacagagaatgaagggacgcagttggcatgtgcctgtggtcccagctacttgggaggctgaggtgggagcatcgcttgagcccaggaggtgaaggctgcagtgagtatgatcacgccactgcactccagcctgggtaacagcgcaaccctgtgtgtaaaaataataattttttaaaaagattaaaaccaaaaaaaaattgtaaacagagttcaacgtaacttacagattaaaaacagtaaaatatgacagaaactgagaggtagtcatgatcagatatggcctccttcgggtgccgacatctgaactgagacctgaatgatgaaaagggccaacactgcaaaaattcagggaaggaacatttggaacagagagaacagtcaagtacagaggctcccggatgttcagggacagtaagcaatgagagaatgagaagaccagaaaactagggaggggccagatcatgtagggccttagaaagccatggtaagggtgtggtaagaagtttgggttttattccaatagcaatggggagtcacaggagggtttctggtgggtacagcaatctgctttgcactttaaaaggcttgctctggctggaggtggagaggatgaattatagagggtaggtataatcacagatataacctcagtgaggcggctggagcgagtccagaccagaccacggaggagcaggtgaagccaatggatttgggatatgttttggaggcagtgtaagcaacgcttgctgaggacctggatgtggtggtgagaatcaccccatctcgagcaacattaactgaggaaaaaattgaaaaaggggcgcccttgcttgggggcttcctattgtggaactgttatggaaaggagccccatccattgcttcctccttgaatggcaaatgcctttatgatccctataacttgtcccattatgtttagacccttggtggtcagaagggttctatttagggcagtgtcccctgcccctccttgtcctccaaaaattttgggaggcactgacgtggatgtcatggggtcagcacaggcatcaacatccccagagggatggaaccaagcagcctattgcccaggcattcactaacaggcagcccatcctcagcctcatagctggccggggagaagaaaggctattttgggtcccagatctttttttttttttttgagacagagtctcgctctgtcacccaggctgaagtgcaatggtgcggtctcagctcactacaacctccgcctcccgagttcaagagattctcctgcctcagcctcctgagtagctgggactacaggtgcgtaccaccaagcctggctaatttttgtgcttttagtagggacgtggtttcaccatgttgcccaggttggtctcaaactcctgggctcatgcagtccgcctacctcagcctcccaaagtgctgggattacaggcatgagccactgcacccggtctctgtttacaaatttatcaccagcttcatcccctaaggttataagctccatgagggtgggaagtctgtattgttcacctctgtatcctaagcatctagaacatagcccggcacacagtaggtgctgaagaacttgaatctgttaatgtagaaaggatgtttcatctagctgaagtgtcttgtacagaataaactctcaataaatgaactgtggacacatggaagggtgagctagagctctgctcaggggttgagtgctcctcttgtgcccttgtggttgtctggttacctgaactaattggagtgcgatgcagacatagtcatggagtgagacagcagaactttgctgtcttgtttgtgagcccacatcaggggttctagactggctggttgacatggtggccccagcctgtctcttcagcagctcggcttataaaaaataaccaccacctactggggaaaactgctggaaccttcagattgccaaattgttcttggtgtcttttccagaaatatttgccaaactcgaattagccttcaggagatttgataaagctcatgtttaagtcaagagaccaaaagattttgatggggagaattaggggctggatatagagggaatacttaacctgtataggggcagatatggttgtccatggagattctggtgtgaaaaagtacgatggcggccgggcgcactgcctcacacctgtaatcccagcactctgggaggctgaggtgggtggatcacctgaggttgggagttcaagaccagcctgaacaacatggagaaaccccatctctactaaaaatacaaaattagctgggcgtggaggcacatgcctgtaatcctagctacttgggaggctgaggcaggagaatcgcttgaacccagggaggcagaagttgtggtaagccaagatcgtgccattgcactccagcctgggcaacaagagcgagactccgtctaaaaaataaacaaaaaagtacgatgggagaaaggggagagggcagtggggcctggaaacctcatgacaaagagaatgaacacaagagggcctgtggtcctgtagactctgtgctgtgcacatccctcatgtgagcatgggccatccagctgcaggccatggtgtgacacactctgcagattacagtctagggcttcatgttccatgtgctggaggtaaggctgggcctcttggagctttccaatagcaccaacaagctgtcagccctggaggaggcctaaacctccaagcaaggaaaggtcaagtcacagagggaggaatcactggtctccgaatgctcatgtgtttgcttttcttcacagcttgggaaacagaagaaaaaatatatgccgtacaaccaccagcacaaatacttcttcctaagtgagtgtccccatccaacacaggggagctgcctcaggagggaatgctgagggaatgaggaggatgtggctgtccaagggattatggtattttaaggaaaggggctagaggaagtaccccactcccacccccagttactccctgcatgacagcagtttgccatctcagctgagcgaagtgaagttaggctgatgattggttgaaggcaaactagttcttcccatccaaccccagtttccactgggaagctgggtgtttggggtgtagaggggcctcttgctttatcctcaaccttatctttttttttttttttttgagacggagtcttgctctgtcgcccaggccggactgcggactgcagtggcgcaatctcggctcactgcaagctctccgcttcccgggttcacgccattctcctgcctcagcctcccgagtagctgggattacaggcacccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccctcaaccttatcttaaactttgtcaagatgggccaaggtaacctggtagagcccagtccaacccccagaggaacaaaggtacagatagttctggaaggatgggtcctgaggagagaatggaagagctgttagaacgaagaagatctttctgatgactgccacatattcccagctttaaaagtctgtcccagctactaaggaaactgaggtgggaccatcctttgagcccaggaatttggggctgcagtaagctccgattgtgccactgcactccagcctgggcaacagagtgagatcttgtttcttaaaacaacaacaactctgctccataatgcctaaaatgagctttaaacgcctttaaattttcaaattttttaaagaaggaagggaaggagtccactgatcttattttagtttgaaggaattcatcctaactgcctatcaccaactatcacgaatagagaaaggcgatggggcagaagggtagagcagagacctctggaagaaatagttttagaatccatggcacatcaagatggaggagccatgggtgagcattgtcatgctaggagttatgggtagcatcaggtgccacagagaagggctacagaaaaggaaatgaggaagcatgtagaatgcaacacttcttcaactcccagttttctttcaagagaggcccctctgttccgtcccacagctgacctccagggcttcagattggggtggcacaagcccatctccctagtttaaggaagtgagcttcacagcctgtgaaggatccacagggtccctcccaacacacacacactttcctgctcctgccccttcacctgcatggtggagctgccaggaacaaagggcagatgactgtagggacagggctgtggccaaggtaagtaagagagtattagcacccttttaaaagtgtgggatccttggagtgtgtatgtagaaaagagaagaaaaatgaaaaataataaaggtgtgggagcagagcaagtcccatgcgtggggcctgagttcccaagcacctgtcactgaagagtgccactcgcacccctcaccttccctggcatcctcttgggagtttttgccttccccagacttggatttatgcccaccttcagtgcctgctggttccagtggattgcagagcactcaagcacctggaggggagacagaagggatggttggaagaggcagccccctgctagaggccatctctcccaacatcaactggccctttcatgaccttcctgtgctcatgcctcctctttgtctcggtttcctccccagttgggcccccagccttgctgcctctctacttccagtggtatattttctattttgttatccagcgaaagaagtgggtggtgagtatccatggcccaagaagcccacatccttgtctccagcacccagagtgggggataggggttccccaggggaaacttgagactgactctaggcctaatttagaacaaaataatagaaccagacacagatcctccttatctctaagtgggacgaaatgatttgagcttagcaggcagcctgattcccaatgtgtaatttcatgcggtcagtgtctccagaggttcttgtactgggcataatgccagggggctgagttgggaatggggaagatgaatgagagacaatacctactttcaaggaaacttctgatgaagcagaatgtggttattaatcagaaaagaggtacaggcaataggttctggggactccaaaaggggcctgactgcacctggctttgtgaagtcacttttctagctggccttgaggctgggcagggtttctgacaggcagaggtggagcaggggggatgaactctgagcagagaagctggaaatgaggggtaagtttgaccaccagacatattgtggaggactagtgtcaggggaagagtatggtgcttggttcagtgatgagagatttgatcagggcactggcatggactgagccatggtcctggcagattcatttggcggcatgctgaaggatttagattggctaggaagagctagaggcaaagagaccttgtaggccttggtacttttgaaggggacatgcaagaagggctggggggtgccaatgggaatggaagaaaggagcagtggcactagatactgcaggattggacccctgagaagctgaagatgagtgagtctggataaccaggagaatggctgcaccatgcaaacaaagagctgctgagaggaagaggaagagttgttcgtgactgttatgctcgctgcttttctcactataggacttggcctggatgattaccttctacgtccgcttcttcctcacttatgtgccactattggggctgaaagccttcctgggccttttcttcatagtcaggtagtattcggtgggggcggatagggactggtgaaggaaatgttggggagtgaccagtctggtctaggggccgtgctggggctttgggtaacagtgggtgtttcaggagttggcttgggaaagtagacaggctggagcagttatctgaggggggaatcagaattctgggctctgtgtgtactgtttttgtctgtgtaatacatctaacaggttcctggaaagcaactggtttgtgtgggtgacacagatgaaccatattcccatgcacattgatcatgaccggaacatggactgggtttccacccaggtaagggacagtcactcagaagactggagcataacacaactattgaaaaggatgcgtaggtgaaaacagcaaaaacaaaaagtcccccaaacagcattttctcattagcctgaggctcttgttctgcaaccatgtgaagggagtgaccaagacagtctcatgtcccttcctcagccagctttacctggagaatgctgggctggcctttccatctgatattcaacatgctctcccctgaccttttccgccagctccaggccacatgcaatgtccacaagtctgccttcaatgactggttcagtggacacctcaacttccagattgagcaccagtgagtagggagcctggggaagcagggtcctggggagggtgtaagtgttgggtacaggtgggagcagagaagcaggaaccactgactcccccgttctccctaaagtctttttcccacgatgcctcgacacaattaccacaaagtggctcccctggtgcagtccttgtgtgccaagcatggcatagagtaccagtccaagcccctgctgtcagccttcgccgacatcatccagtgagtatctgagaccaggaagatggctagtagggagggaagagggcagggcaatggaaatgatgacatgtagggtggggagtgaacagaaggtgttcccagtcgtgtgggatggagttcaccatggcaaaggcaggattctttattggacctgtggccaggtcaggcctttgccctcattggggttcccctcagtaccatggcccaagctagctttctctaaagtagaggggaggaaaacctccagatggaagaaggccttaacctcactgctccatctccggtgggttcaactctgcttgtctccctcactgtctgcccccattttgtccctgcagctcactaaaggagtcagggcagctctggctagatgcctatcttcaccaataacaacagccaccctgcccagtctggaagaagaggaggaagactctggagccaaggcagaggggagcttgagggacaatgccactatagtttaatactcagagggggttgggtttggggacataaagcctctgactcaaactcctcccttttatcttctagccacagttctaagacccaaagtggggggtggacacagaagtccctaggagggaaggagctgttggggcaggggtgtaaattatttcctttttctagtttggcacatgcaggtagttggtgaacagagagaaccaggagggtaacagaagaggagggacctactgaacccagagtcaggaagagatttaacactaaaattccactcatgccgggcgtggtggcacgcgcctgtaatcccagctacccaggaggctgaggcaggagaatcgcttgaaccggggaggtggaggttgcagtgagctgagatcacgccattgtactccagcctgggcgacagagcaagactccatttcaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctgtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagacacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaacaacaaaaacttagaattgaggagttgtacctccattggcttcctcactccaaaataggtgctgatccttcctattcctattctttgccaccttttgggtgtggtgtcaccagcctgtttagccaagtagctttgggcataggctgcccaatctgagcaaacaccagtgaggctctattgagccaagaccaagtcctcaaagcacctgaaccactgtggccttctcagcctacagcagtgtggtctcttacatggccacaaagggacacacagtgacaaaaggctcggaatgttacaatggtaaaatgagtgatctcaaatccactgacagatataaaataggcttagagaggaaaagctgcctctggtcaagtagatcatggcagcatgaattccaactcacttttttacaactccaacttctatgtttatctttgttactttcacttttttacaacctggccagaggcattttttaaatcaggcccaatatcagtattctttttgtgtgtgccaattttgttatcacatccctatgaagttgaaaaataaagttaattttgaccaaaagacttcatttgtaacccatgatgttcatctgtgtgtgcacaggattcctgagtgcctctgctacgagttactgttcacctctctgtgctcttaagttcttgaatcactagactcccctttgtattgggcagaggaagaaacatcaggaccctccagaaaacaccaaggcaagggtgaagtatggcaaggaagagcaaggcaaagtccttctgatgactcccgtgttcaaatgtgagattgtcaataatctcaccaagtttcacacgtatcacttcctcctattcatgaggcaatgcccttgcccttttgtccttcagctttccattttgaattattttctctttatttttacacttacttgttttgagacaaggtctggctctatggcccaggctggagtgcagtggtgctgccatcttagttcactgcattctctgcctcccggcctcaagccatcttcccacctcaggctaattttttttttttttttttttttttttttttttttttttgagaccagagtttcactcttgctgctcaggctggagtgtagtggcgtgatctcagctgattgcagcctccgcctcctgggtccaagcaattctcctgcttcagcctcccgggtagctaggattataagcatacaccaccgcgcccagctaattttttatttttagtagagacagggtttcaccatggtggccaggctggtcttgaactcctggcctcaggtgatccacccgccttggcctcccaaagtgctgggattacaggcgtgagccactgcgcctggcctctctttacttttaaactcatttctagtttccaaatagtctccctaagtcctatctgcctaaatcttcctctgcaagtgtgatccctcagagcttgactgcagagcagtgcctcttaaccatccaactagaacagctctgagcaaaaacatttgtaggcatcattaatcttccctgcagtgtgcacacagaaagtcagattaacaaaattctataggagacaaacttaccttcaaaagacaaaagaaaaccactacattcttgaccaccacagggtataagcccttaattattaagagctactgcactgaggcaataactcctaagaaatcttaacatttcgccaggcaaggtggctcatcctgtaatcccagcactgggagagaatggcacacgtaatcctagcctttaggaggccaaggcgggaggattgcttgagcccaggagtttaagaccagcctgggcaacagtgagatcccatctttacaaaaaattgaaaaatcatccaggcatggtggcctgtgcctgtaatcccagctgcttgggaggctgaggtgggagaatcacttgagcccaggaggctgaggctgcagtgagccaagatcgcactactgaactccagcctgggtgacagagcaagagactctgtctcaaaaaaaaaaaaaaaaaagaaatcttaccgtctttagttcctatcaccattactgcagatttagaagcaatctacctgaatcagaaaatagagctcaaataagttgtgtggcttggtataatctgggaaaatcagtttcaaaagttacctgcccttgggatagaactttttgtcaacaccagttttcaaaaagtaccctagttatgaggccgttgctgggtaaactttatcccattccagcttcaaccagaggaacctgtacatcctaaagtttcacataagattacacttgaagaataggtttctccattaaaagacttgaaaactactggtcttcaggctccctacctgtttaatctgtcaagacattgccagcttaaatttcggacagttacataagtgtccctgttaacttcaaatggccctgacaggaatgctaaaacgtcagacattcaaatgggccaagctttatcaggattataaaactttcaaagctcaaaaacatgccatctctatgggaaacagtatcttggatttgatgttacaaaaggaacaagaaaatggtttctgaatggcagctttcagtttacaagtagtggcaaagtaaatgcttggatgttatgaggtagttgatctaaattgtgaggctttcttaaaggcactcctttgatctcatggagtgagagactagaaatctattcaacgtattaaaactcctctcccagcaaaataaaataaac

SEQ ID NO: 11328 - DNA, 1222 bp, Homo sapiens
aaaacttaaagtataataaaataaaagatttacataaaacatttttccttgattctgtattaaaggaaagatgacattattttcaatgtctgcaaaatatttcactgatgggcatttagagtgtttccatttcccgctatcatagatactgctttaatgaatattttttgtttataaatagttttctttttttgtgtgtggatatagaatcttgctttgttgcccaggctggagtgcagtggcacaatctcggctcactgcaacctctgcctcccggattcaagcaattctcctgcctcagcctcccgagtagctgggactacaggcgcacgccgccacgcccagccgatttcttttgttcaggctggtcttgaactcctgagctcaggcaatccgcctgcctcgacctcccaaagtgctaggattataggcgtgaggcaccccgcctgacctataaatatttttctaagaacatttccttaggctatattcctaaacatggaattattgggaacatttttatttttctattttttttcatctcttcagtattcaaaacattcctaaattctggccgggtgcggtggctcacgcctgtaatcccagcactttgggaggccgaggcgggcagatcacgaggtcaggagatcaaagccatcctggctaacatggtgaaaccccaactctactaaaaatacaaaaacaaaattagctgggcgtggtggcgggcacctgtagtcccagctacttgggaggctaaggcaggagaatgccatgaacctgggaggtggagcttgcagcaagctgagatcaggccactgcactccagcctgggcgacagagcgagactccatctcaaaaaaaaaaaaaatcttaaatttctatataagttgtcaaactattttttccagtttaatcaacttacacttctaccagcagtatgagagcttttatcccactgcacagtcacataggaaaaatggtttatgtaaaggacctctcttctgttatttaatacccatgaatttcttatatagttgtaatcagcgaacccatactactttgggttctgcttatttcacggggaaggattctatatctatcaatatagttcacattctagccatttaaaatcattctttaattcttcattgtgttaacagatcccaataagcttggcgattttcttattgtcaggactcgggtttatttccagtttttg

SEQ ID NO: 11329 - DNA, 4443 bp, Homo sapiens
acattttggttacttttagaattttattgacttttttcttcataactttaaaacaaaaacagcgcatgaaaaccagtgtcttattccaaagtctcaactcagctgattgccaggtgaacatcaccatcttactcctctgaataactagacacaaattacatagcaagttcgagtttctgcccacccaagacacagccagtaatcagtcacaaacacagacacagccaactccaggggctccagctttctgcccatcttctctcagcagttcctcccatctgctaagatgcgccttcctggtggctctctctcaaggtgggtcaaggctgaacaagacagaaaagcacagtctaggtccaccatcacctcccactggccaccagttggccagccaggaaatcatttctgtacatcttttgtctcccccttttatctccctctctcttctccaaaacttgttgctatctatcactttcatgtaacaatggacttagtgtccattaaactgcctgagaagtggtttgagcctgacatattttcctgagctaaaaaaggaaaagtacctctgtggccttcttgccattaagatcaagtaaaaaagggactagcactactgaaaagggtcacgctagaaaagccttagaatcctctctccaccccgtgaaggtttctctagctgtagctcttaagggtacaagacggcaaatattctggggtgaaggaggtataatggggaaacacatttattttccccttttaaacttccctgctgccccagtctttgccttcttcttagtggatcccttgggttctggctccttgcgcttagctgaagagagtgagccggtcaccttgaagaaatcatccaggcggccctgggtgctgccttggcggctcttactcagcctcttgaccccactgcggattcgctcctcagagaactgcttttcaccacacatgaacttgatcagctcttcttcatttggctcgctccacttcagctccacagactctgggtccagcacctcaggttccaagaagagctggtgagcctccttgtggagccaattttctggcacagggtacttgttggggtcaagtcgccgcacgatctcctcgatgctcttgtgcttctggatgaggtccacagcccgcttgggcccaataccccggatactctcacagtagtcactgcctagcaggatgcacagatccacaaactgttcctggttcaggcccagctcctgcagaatccggctcaggtggaattcctggattggcagctttttggcttcactggcagtcaggtgtcgcattagcacagggctgccgaaggtgaggcagtccatgtcctcggtagccgcagcatagactttgccagccttcaccagggcagcacagctggcctctgcctcactgggtgcatcaagataagggatgcccatgaggctcagcagatgtttgcactcatcattgtgctgcttagtgaccttcaccagccgcttagtgaatttttccacctcctgctcggccccagcagcctgagcctgctgcagctgcttctctgcctcagcccgccgctcactgcgtttggccagctcgcctgacttgagctgtggcggcttgccatcaaagacatacacgggcttgatgccgttctccatcatgcgaatggtgcggtagaacatgcccatcaggtggctggtggtctcaccctcctcattctgcagcacatccccaccctggcgaacagcaatcaggaactgataaatgctcatagaggcatcaatggccaccttacggccaaagtagctcttgatgtcattctcccggatggcactgggggccacatcagcaattagtttggccaggccttgaattcccatggcaacacagaggagggatgactaaaaaagaaaggcaagtcagagacggaggaaaggagaaaggttataactggtgttatctcaccaacttcatgccttcaactaaattccacacaacaaaaaggacaccatgtcagcactgctaaagataaaaagatgaacaaggtccccattctcaaaaaactcagtctagcaggagaatttactcaatagtaaggctcaacgagtaccagaaattgaaccacgtgcttagagaaataagatactgttgatattctaaggtagcagcattatttattacacaaaaaaaacctgcaacataggtctccatcaaggaccacagaaggccaggatgcttggcctggcttgaggagtccagggaccataatggcagacctgaaagacaggcaaatacaccagctaaacaaacagatctgatttgttttgagtctctggagaaccctgactaataaggcagccttgaaaaaggattgcaaacatatctgaatggaggtgatgtggctttctcacaagcttctctaaactctcttcatcatcgcctcagcacataagagtttctacttttattataatgttgctagagtttcaagtctttccctttgcgttttctcgccaccactcagtctgaaatgttaactccatggctcctccccaggtcctgatttaggggtctggcatgctgtagtcactgggctcaaaagagtattgcacttcagagttcagtgtttcccagatagcagtgtttcccaaatcaccctcacgatttttgctacttccaactaaaacccgtactttcattcacttagaattttttttaaaaaactaaactggaaaactcataagcaataatatttgtgttctattagttatattttaatatgtattaaatgtataactattaaaaaggatttttagggggtgcaatttaaaatcatcttgccatcctggccaacacggtgaaaccctgtctctactaaaaatacaaaaaaaaaaaaaattagctgggtgtggtggtgtgcacctgtaatcccagctactcgggaggctgaggcaggagaatcgcttgaacccaggaggcagagaatgcagtgagccgagattgtgccgctgcactccagcctagcaagagagtgagactccgtctcaaaaaaataaaaaactcatcttgtgcccactgttggtatgtgtccaatactccaagaaatattctactggggccaggcacagaggctctgggcagtaatcccagcactttgggaggccgtggtgggaggatcacatgagcccaggagttccaggctacagtgagctatgattgtgccaccacactccagcctgggcaacagagcaagaccctgtcaagaaaagaaaagaagacaaaagaaaagagaaagaagaaacgaaagactccatcaggccttttcattgttcccactctttcttcacagggttctttctagagcatcaatgactgttcaattcttccttctaattcagtccaaacacttcagcatggcatcacgatctttcatgttctggttcccaacctaaccctacattctgggatctcaacagaaagctggaataaggcccgccttttcccacttttccttagctgtgccctcctctcgccatcctctcacgcgtccttccaggtccatccctggattattaatcaattaataattaattgacaatgaattattcatttgattaatatgaataattcccctgtgaactgcagcggcaaaagctctggccttgaatctaggcgcggcatttaccatccgtgtgacattaccaagccactgaggtttattttctcgtctacagaagaagaacgattaccatgcctgtctctcagggctgctgccagggttaactgagacaacagacagaaacctctaatgtcccctctccaggcctgttcaacccttcggctcttgcctcaagccggccgcgctgctggagtgtggactgaggaccagaccatgtagcccttgatcccctcacggcgtcccacagacaggtaggcaggaaaggggcctaaacaactcaagtgtcagaaatgtttctcgtccaaggtcttaggaaaaatacaacacgaccccataaggtggaacttattaccgcttttctacaatggaggaaagagaggctcggagcttacgcgactggcccaaggctcacagggggaaaagtggcgggacctcttgactgcgaatcccgcgcactccagaccccggctccccacggcccccagcgccaagcggaccccgtcgctcccggaggcgcttcccatggggtctcacctggcctttgggacacgcggcctcggcggctaaagcttggttcggggttgccccgggcaggcggtcctaagctcgctctcccttctcagcttagcggcgggtggcctgacgttcagccgccttccaaagcccgcgctcccgtcacgtgacctgctcgccacgcacagcctcttggggcgcgtagtgcaggctgcgtcccctcagacggctgctctcatggcaac

SEQ ID NO: 11330 - DNA, 6725 bp, Homo sapiens
ggtgattaaggctgcagaagacagtgcgttgcagtatatgaacttcatgaatgtcatctttgcagcacagaaacaggtgaactgagagcctgccgtttaaagtatttgtttcataacgaaggagtcaatttcattttttgaatgctctactctgaggtattctgactacgtaggcttatgaatgggcaaggaatccagaatctgtattatgttctagtcttttctctattttgggtcctggaccacttgagaatctgatgcattcccaaaacaatatgcactcaaccacagttttgcatagagtttcatggtattcaggtaacctttagcccatccttggaccccatgccaagaatccctggtttgacagtttgctgtataaaccttgcatcagtttctttatcttgttgctgtggcgaagctgtaaaaattcagtatttttactttgcaaagagctgaaatgttcagatgaagtataatacattttcttctttggtgtgtttatgaagaaagaaaacctccttaaaatttcagttttaatgtaaaatgctgctatagccatgcataatgttctctgttgtggagtggcagcatgatgtagtgaaaagagcctggactttggagacatgccgagtggggtgacagctttctcacccgctggctctgtgaccacagcccagccatgtcctgggtgcttcagctgccaaatgcaaatatctgccgtgcagagtcacgttgcatattgagtgagctattttaagcatagagtatggcatgtagtaggttctcagtatagggtaatcattattgttattattcctgtaatattttcaaaatgtttcttttagaatattttgattgatgcctgtgttttagactccgactcagggctcctccaacaggtatgttttaaaaccatgctttgtgtcggtggttatgacaattagtgatttttatattgattacaatttaaaatgaaagctttgggtatattgggttaaataaaatatgttattcagcctaattttatctatgtctttcccccttacgtatggagctactggaaaattttaaattacatattgcttgcgttatatttccgttgggcagcactaaaagacaaaaactgaattttactttaacccgaaagggaaacaaaaccctaaagtaagtctgaagaaattactgagtttttgttagatgttttttggccacaaatgttgtttcctaaaggatcagttacaagcacaaaactatgacaaaccctgaatttaggttactgctggggatgaaggatggggagagcgaggtccaatgggaaaatttacatgcttcaaaggctctgagattgtactgtttcttcagcttgatcgtaggtatatgatgttcattttattatttaaaccatacttacacattatgtatacagactcttgtacatattatatttcagtagtaaaaattcaaaaagtttgaattcattttttagcaacacatttcagtctacacattgtctattaactccaagacgatcttgtctctgccatgaattcacataccagctctacctcctcagccctcacattcatttttctagtccagtcccagactctcctgagttccagacttgcagaatcagccgtgtacgtagtacctcctcttggacgtctggcaggcatcttcagtgtcatgtgtcaaaagcagagagctcttggtttgtcctctcagcctcttcctgctccactggtagccccatctccctaagtggcagtgcagttcactcagcaactcaagcaaaaacctgactcttccttgtctcttctcttccctcctttcataaccatgagcaaatcctgttgattctgcctttaaaatatatcctggctgagctcagtggctcatgcctataatctcagcacttgggaggctcaggcgggtggatggcttgagctcagaagtttaagaccagcctgggcaacatggcgagacaccatctctataaacaatacaaaaaaattagcctatcatggtggtgcacgcctgtagtctcagctgttcgggaggtggaggcaggaggattgcttgagccaggagttcgaagctgcagtcagctacgatcatgccactgcactccagggaaaccctgtctccctcttaagaaaaaaaaatgtgaaagttggttctcagaacagctgtcagaatgaagctttcaaaatacaagattggtgcaaaagtaattgtggtttttgccttttttttttttaacagtaaacactgcaattacttttgcaccaacctaatataaattagaacctgttgctcacttgcttaaaaccctcccatagcctagcatcatacgttgactaaaacccagagtcagggcctgccagggccttccagatgctgcttgctgaggctcctgggaaccttttgccccgcatcttccacactctccctcttcagtccggccccaccgcccccttgctattgcctgaaacaggcctgcttcggccagaggggcgctgcactttctgttctctctgctcgcaagctcttcccgcaggtgtttgcatggcctactccctgcctgccttcacgtctctacttctgtgccacctcctcagagaagccttccctgaccaccattgttagtgttactccctctccccttagcctactttatttttcttcatagaaatgatcataacctataacattatttttgcatttacttacctgatttactctctgccttctccactagaaccttaacttcatgaggatggacactgtgatgtttactgctgtaaccctgcacagtgctctaaaacagttgttaaatgtgtaaatgaatctaacggaccaactgaaccaggactgtactatcagaggagcctcagggtcctaggatcggagctagggttttcagtgtaaatggaagcactgctgtgttaaagcgagaaagctgtgtttatgaaatgaatagatgaatgattgttgggaaaaactattaacatggacaggaaaccttagtgtcagcaaccaggagagcttgagtgttttgtgtctttggaaaactctgaagatagcaaaagtttggaaaaagaggaccaaattcaaaagagttttatttttattttattttattttatttttagacagagtcttgctcttgcccaggctggaatgcagtggcatgatcatggctcactgcagccttatcctccccagctcaaatgatcttcccactcagtctcccaagtatctgggaccactggcatgcactacaatgcctggctaattttttaattttttgagacagtttcactcttgttgcccaggctggagtgcaatggtacgatctcggtgcactgaaaccccaactcctgggttcaagcgattctcctgcctcagcctcccaagcggctgggattacaggtgcccgccactacgcccagctaatttttgtatttttagtagagacagggttttatactctattggttaggctggtatcgaactcctgacctcaagtgatccgcgattacaggcgtgagccaccgcgcccggcctaattttttaaatttattgtagagacagggtttcactatgttgctcaggctggtcttgaattcctgggctcaaacagtcctgaagccttggcctcccaaagtgctgggattacaggcatgagccactgcacctggacaaaaaagtgttatttcttaaagagaacagaataaagccatctcacagtttctttttacataataaaattaacaaaatacaatgaaaacaaatctcataaaaattaaaaatttttgtgcttccaagggcactatcaagaaagtaaaaagacaactgggagagatatttgcaaatgatgtatctgataaagggactagtattctgattatataaagaactcttaaaattcaaaaataagacaaataactcatttcaaagtgggccaaggattgaacagctatttctccaaagatctgcaaatggccaagaagcacatgaaaagatgcttaatatcattaccgaccagggaagtgcaaatcaaaaccacaatgagctattacttcactccactaggacacatgtaatcaaaaagtcagctaataataaatattggtgaggatatagagaaattggatccctcctacattgctgctggaaatgtaaaatggtatagccacttcaggaaacagttcagaacttcctcgaaaagttaagcatagaattaccatgtgactggggaaaccccgtctctactaaaaatacaaaaattagccaggcatggtggcgcatgctgtaatcccagttactggggaagctgaggcaggagaatcacttgaacccaggaggcagaggttggagtaagccgagattgtgccactgcactccagcctgggcgacagagcaagactctgtcaaaatataaaaataaaaataaaataataataatctgcagtgtcatatcctcctctgattttgtaggcccaaggcattgctcatgagaacctcattcctctggaaaccctaggtaagtgcgagtttggcagcaagccgcctgtgtcttgcaggcttgtgacatcacgggaggactgtacctgaaggtgcctcagatgccttctcttctgcagtatttgctggtaaggagacagcagcggcgaccctgatgcctggagggaaggatgacctctgtgtcctgggaaaggaatggaagcaagatggctggtgctagtactcaggagaagggaataaatggaggccttggagttccaaggcctagaagggtgggcttcatgttatttttttcccatgttttaaataaaagtttcttttgtttgtttgttttacagtgggtgtttcttcccgatcaagatcagagatctcagttaatcctcccacccccagttcatgttgactacagggctgcttgcttctgtcatcgaaatctcattgaaattggttatgtctgttctgtgtgtttgtcaagtaagttaatgtacctagtttttcttttttttctatgttggggggcaggaaaacagtttctcagctgtgttgtttttcagccaccctattgtttctttttttttttaatttacagtattctgcaatttcagccccatttgtactacgtgcgagtaagtatctttgagattgtgtgggtggctaatacttcacagctctagaacattaaaaaatgttttcctctctgtaatttcaggacagcctttaaaatttctctgcctccagtgctgaaagccaagaaaaagaaactgaaagtgtctgcctgaggataaaatattttccccatcttttagagctgttaatagaaattatatagcagattctttgttgggaagactgaaaaaaataaagataggtataggataatttttaatatggtgaccttacagaaaatatttcccaaacatccttttcatcctgtgcttctggaggactgatttgtttgagggaatcattctatgcattatatcctaaaatattctatgactggtttctgtccatgtttgtggctttcatttttttaatgggatgactattagtcaaagtcagcttgtcatgactcatcataggctttctaacctactccctgaatccgggtcctcattgtgaaatgcatgccatacgaaatttgaacgtagctttggaaaaagggactatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgaggaaaaaaaatccacattaatattgaaactgcacctgtaatcccagcactttgggaggctgaggacagaggattgcttgagcccaggagttcgagagcagcctgggcagcaaagtgagaccccatctctactaaaaatttaaatgtatttattaaaactgttctctagaagctttggactgaatcccaaaagtgtttataagttcaaaagcaaaagtatttgtaatttcaacaacaaaaaatgtatttctttatgtaatcttgaaattattaaaagtccttttagcttctagcacatatttgtacaaagagtttaaggaatggtggctggtttggtttgttttttaaaaatgtttactgacgaggccgggcgtggtggctcacccctgcaatcccagcactttgggaggccgaggcaggcagatcacaaggtcaggagttcaagatcagcctggccagtatggtgaaaccctgtctctactaaaaatagaaaaattagccatgcgaagtagcaggtgcctgtagttccagctactcgggaggctgaggcaagagaattgcttgaatccaggaggcagaggttgcagtgagccaagatagcgcctctgtactccagcctgggtgacagagcgagactctgtatcaaaaaaaa

SEQ ID NO: 11331 - DNA, 970 bp, Homo sapiens
gaaaactaaaattctgagagcgatagaagaataagtggagagccatattttgttcttggatgtcagttttcccaaaatcacactgtaaattcaatttacaatctcagtcagaatatcagggaggtttttttttttcctggcagggtggggagatttaaaaaagaaattcaaggctgagcacggtggctcactcctgtaatcccaacactttgggaggccaaggcgggtggatcacgaggtcaggagatcgaaaccaacctggctaacatggtgaaaccccgtctctagtacaaatacaaaaaatgtcgtgggcgcctgtagtcccagctactcgggaggctgaggcaggagaatggcgtgaacccaggaggcagaggttgcagtgagccgagattgcgccactgcactccagcctgggcaacagagcgagactctgtctcaaaaaaaaaaaaaagaagtgccaagtaacgagatattcattgtttgttgcttagcacaaatgaaaaagctggcagttcccagggttgatggtgatgttggggattgcttattctcatgggttgctgataggaggataaattggtaaaaatcttttctggggtgcattttggtaatctgtgtcaaaattaaatgttcatatactttagtaatcactgcttattttccggaggtaattagagagctgtgcagatggtatatgagggtatcatcagggtattgtttaaaactgagaactggaaactgcttaaatagtggaaatttatgaagtccgcaaggagcatagtatatattataattcattgacattagaatattttttcccacatatattgtggactgaaaaagcaggttgcagaatgctaagtaatcatcttgatacgtgtgagtgtgtgtattttggatgtgtgtgtattctggatgtgtgtatgtgtgtatattttggatgtgtgtgtgttttgggtgtgtgtat

SEQ ID NO: 11332 - DNA, 1521 bp, Homo sapiens
gaattctgtagtttcgtttttaaacatttgaggatattttaggtgatttaattcattgtagaacatagactgcatgatttcacttgttttagattgagattgttttgtagcccaggaaatgttttatcttggtgaatgttccatatgtacttgagaagaatgtgtattatattgttggttgtagtgttccataaaagtcagtttagctcattggtagtggggcctaaatcatctgtatcctaactgatagtgtgtggttgtgtgtctttgttttttctttgtcccatctgctttttgggttctttgattttcttcttttgtttcttcttctggattaatcaaggattttataatattcagatttatctcctctgttggggttttagctgtacctctttattttttaagaggctgttctagggattacagaatgcattctcaatttatcataaaatagcaagaatattataccaccttacatgtttcacatgtaataaaacatactttcatatactattttcatcctttgtgcttttattgtcataagttttgcttctaaatgtattatagttattgtattttgtgattatttgtgcttcagaaagttattctttgaagaaactaagaaatgagaaaaattaacatctacctgtatattcaacatctacatatatatttaccatttttgccattctttattcctacataaagatcaaagtttacatctcatatcattttctctcagtctgaagaacttgatttaacatttcttgtattgtaggtgtcttagtgacaaattctttcagcttctgttttcagcttttatctgaagatacctttattaatctttactttttctatatattttgtttgttcgtttagagataaggtcttactctgttgcccaggctggagtccagtggcctgatcataacccactgcagcctcaaactcctgggctcaagtgatcctcccacctcagcctcccaagtaggtgggactataggcacacgctaccgtgcctggctaattttttaatttttttggagagttggggtctcactttgttgcctgggctggtctcgtaccccagggctcaagcaatcctcctaccccagcctcctacggtcctgagattacaggtgtgagccaccatgcctggttatttaaaaaaatatgttttgaataatacagccaattctgtttttttaagctgtcactatgttctgtatagccaccaaaaacagggaattagcaaatactgaatcattgttcttaggggaaatacagacttggctcctgtaagcctcttgtcataatatttttgttaaccaatcagtatattaccttgttttatgtgtttttctatttaaagccacctggggtacaaaaatacagttggatagaaggaataagttctagtatttgatagtacagtagagaaattatagttaatgatttattctatatttcagaatagctagaagaattgtaatgtttctaacacaaagaaaagaaaaa

SEQ ID NO: 11333 - DNA, 1641 bp, Homo sapiens
cattccttactgtgaatagttgctttcatactacagcagcaatgttgaagagttgtgacaatgaccacatggcctataaggcctggaatatttgctgtctggctctacgcagtttaagtttgctgacccctgtgcaaacttcgtcaaaggtaactttgacttagtgcgtactcttgattagtacccaaactctctaaagttagatattaacttagaaaaaattgataagtttcaaaaaaaaatttctctttggtagggaaggtaactccaagagttaacggttttcttgccttgaagggcgttatccagttttgtatctatctctgcagtcttatttcccattgacattcttttttccattgactgcatgtgtcagtttctcatgtcctgctttgagccacccattgtcattctgcaggtcccttcattaatgaattaaataaatcttagacacacgctcactatatattccaatgagagtgtttattgtatggagaattatatgttgtctccttgaggcttggcagtgcctcttgaatgtagtcatttaaccctcttgggcctcaggtaacttctctgttaagtggaaataattatccccagtaccttagccaaattactgtctcacccaaataataattggacatagttttgtaatttaagttaaaagatgttatgtttatgaaagagttttgttagctgcaaagcgctatttgttggatattgcttcttgaaaaaatacagatcttaggtattaaagaataggtagaagcctgttaggtatgaattatgaacagatattcgattctttgacttctccattcagaatagttatttttaaaaagcaaatatgtaaagatctttctgctcttaagcctaaccactcatctgatgagtgtactgaaaatagaagtggtttattgcaatatgtcagagaagtattctactgataaccacccatacatgaaatcttaaagaagtagttatgagttggaaatttctaggttgtaatcagaagagggagcaaatgacagaatacagctgtgcattgtttggaagtgggctggaaagaattcattgcctctttaattgaagaaaagcaaagagtgacactaatcaaagtaaaagaagggaagtactcatagctgaaaatggaactataaattgtttgctttttagagcaacatcagttctttgaaacccatacagttccttataatattccaaaacaaactgccatatggaaacctgtttagaaaggaataatagcactctaccctcctccccagccactaaattgaaacatacgtgaaaatttaatgtagttttttaatcaagctcagaaaattttttttttttttgagacggagcctcgctctgtcgcccaggctggagtgcagtggcgcgatctcagctcactgcaagctccgcctcccggtttcatgccattctcttgcctcagcctcccgagtagctgggactacagcttggctagtttttttgtatttttggtaaagacagggttccaccgtgttagccaggatggtctcaatctctcctgacctcgtgatccgcccaccttggcctcccaaagtgctgggattaccagcgtgagccaccgcgcccagcccagaaaaaaaa

SEQ ID NO: 11334 - DNA, 1641 bp, Homo sapiens; identical to SEQ ID NO: 11333

SEQ ID NO: 11335 - DNA, 707 bp, Homo sapiens
tatttttagtagagacgaggtttcaccatgttagccaggctggtcttgcactcctgacctcaggtgatccacccgccttggcctcccagctcatgctgatattacaggcataagccaccacacctagccaagaaaccattctttgaacacaagcaaatatactttggagaaaaatttaataatcctggcagggctacattcaacataattctgttatgggggaaggcagcatgctttggctgctcagtgagctatgttctgtacaaccaagtgaaattgctaaaaaaagattctcctgtatacagtaacttaaagtgatgcagtctacttaagatcagatctgagttacaaaatcaaaagtgacagctcctatgttcttttaaagtccaatctctttttttcattgttgtgctccaaatgccttgagtacctgatgtagagtaggtggctaataaatattggttgaatttcttgaacgaatctgttatgaaaagatctactttgctcatctctgtgccccaatagcaggagcttgaggagaaggagaaaatattgggtcagagcttttgattaatatgtatgattctattaaacgggttcactaaaccaaaaaaggcaaaggaaaacagttaaaccaagagttcttgaggttaaagtcttgtgatgattaaaatcatcatcctaagatgatgatgacataaactttc

SEQ ID NO: 11336 - DNA, 414 bp, Homo sapiens
gaggaaaccgccttcaaatgagctgaatacaggtccctctgctagttttgatcttgtaggtcagtggttctgaggcatgagtgctaaaggtcctataggtggcacatggactccaccttcctgcatcacgtgtttccgttgtgatcattcctccagatgagtgctcttccatcactgggaagcacctggcctcatgcatttctgataggccttggtgatgtcttaccagtcttaggcttcccatggattctaatgaggattcctcaaggtatgggaaagggataggtggtccacagaatattctccccaagcaagcaagccaaagactgagaattacagaaaaacacttttcttagtatttttaaattttaatctttttctttcatacagctttatttgtttcttatctgaact

SEQ ID NO: 11337 - DNA, 414 bp, Homo sapiens; identical to SEQ ID NO: 11336

SEQ ID NO: 11338 - DNA, 707 bp, Homo sapiens; identical to SEQ ID NO: 11335

SEQ ID NO: 11339 - DNA, 1262 bp, Homo sapiens
agtaattatatcttgtagtagcaatttcatatctctacttatagttgggacaattaaggctcagaaaaatggcaaagctgagattaaaattcaggattttctgatttctagccaatgtcatgctcattttctgtgttaattttatggctcagggtccagttaaaaacgtctgaagggagtggtaagtacaagagagatgggagttgggggtggggcttgaaggagagcacacctggccccaggtgacaagactgggctccagccctgcctcatcacagttggacatgatggccctgggtcatttgacttttgaggacctcaggaaaatgagggagcttaaaaaattctatggttcctaatgaaatacttagggatgaaattacagttctgggatttgcttgaagacacaatcagccatggtttgtcactgttgatgctgagtaatggatatttggtgttctattgtgagtctttggtacatgtttggaattttccatgaaaaaaccttctgcttctaaaatgcacaccttgattcttcccatcgccctcctactggctggtcctgtgcagctcactcatttctcaggaacagcagcagactcactactctgaaggaaagaaagccctttgctttggtctgttcctaatgtacatattattagagacttttccgacaccctccccattttttatttcttaacagctaatacgatagctgtgctttcataataaattcaaaagctgctctctatttctcaccagtttgaattgtagaaaagagtacaaaagattagagtactttaaaataaatctcagctaattatacatacaactgcattcactaaatgtgaatattttcaggctttctttgctaccaagtgccacctgctcatgatttaaatgggcacaaatttagttccattaaacaaaatgcagcaactcttctcctatagcgcaaactcctttaggtcctattttgaaactgagaagctaattccagtgttctcttgttagctctcggtccatgtcaaccaccccacaaggttgtttacttgaatagtttgcagccttgctttaaaagttctagtaggcaaataggtttgttgatgatgaagtggtttgtgttttataagagtccttatggtctagatggcatttgaacttgtggttccagtgattaccaggaccctgaattgaagaatacatgctgtggccttttcagctcaggaaactttttactttctattgccaaaaaaaaaaaa

SEQ ID NO: 11340 - DNA, 2239 bp, Homo sapiens
gaaaattatctgaaattcaaatttcagtgtccttaagtaaagttctattggaacatggccacacatttatttatatatcttcttgtggctgttttctgctacagctgcagcgtcttatactaaacagactgtatggcccataaagcctcaaatatttactttatgggactcgatggaaactttactgacccctgatctcagtgtttcttttaagcattgcaaagatagtttgcaaaaatgctatgagagctctatgatggcattagatacctaaatgtagcagctgaaaaaaatttcctaaagtggtattaggcctaaaaaaaagtgattctagggctacttaaacaagaagtttttacagcaagagttacatcctctactcattttaatgtctaggtaagccagagctttaaatcctgtattaatttacctgtgaaaatatttcatattctcccttttgtgccgtgtgtgcgttggattccccagtgggtgtatagatgaatttataatttatgtggctggatggaagcctgggtaaatacaagcataaacaacatcaggcaatgccagtcgatagactgcgattccaggatgtgttctgtccaggcctgccgttcattccaaaggcctgcatttcaaagctgcaggcttggagctgggactgctgggaaggtggggggcagggttcagaactggttgggcttaggaaggtaccaggagagtgcaccttctagtacttgaaatgtccctccattttgaggacacaggagtggcctacctttcatctaacaaagacaagagaattgaacgctgattgtctttgtctttgaagggtttattgctttacctcttcacttcacctggctttggcacctctgtcatttcttcatttactgttttttctagcatacttttaacttctttctgtactttctctttccaactgctgtccacatgccacctgtgtatagaatcccaagaaaacataacccaccattagaattttagttgctaaactatataagaactttgagctgtagattaacatcctctaccttcctttggtgccatttgtttacccctttttccgaacaaaaaacaatacctgcccctgttccaaaggtgtcttactattccaataaagaatgcatgcctgggaataaaaagaagcttagactactgttccaatggagctaagtgttcaaagaaattcctgaattcatttcctgggggaaaaaatgtggttagtgacctggaaactactaacaacttataaaactcaatactctgatggcgactctgttcgctttacccctaagacatcttgaaaggaaagacttttgtcagagttgggcttctaaagttttaataggaaattgaggcactttctgtataattcaagccaaagatttttttttttctgggtttgaatgattggataattgcctcaattctctgttccatgtaattgagatcacttgactcttcttagtgctaataaagagatgttgggattcacggtttattaaccaaacttttcagtttgtggacctgtcattcaaaactgcaaacaaggctgatcccatgcaaaatagactactgcctttatgctgtactaagaatcagtccctcttaaaggatgcatttataacctttatgcaatgaggaaatttccaggtagccaattttctttatagtgctaccagccttcagcaagcttaaactctgccctgcaagcctgaaaccctgcttctctaagattctacataacaggagattaaacatccaaatgtgtataatcgcattctggacagtatgaagaagctgtcttggaatattgttaactattagaatacttaaagtgtgcacatcacccaatttaggatttcttggtaatagtagcctatactttagaaaattaaagaggaggaaggggccgggcacagcggctcacacctataatcccagcactttgggaggccgaggtgggcagatcacttgaggtcaggagtttgagaccagcttggccaacatggagaaacgccatctctactaaaaatacaacaaataattagccaggtgtggtggcctgtgcctgtaatcccagctactttggaggctgaggcagggaatcgcttgaacctgggaagcggaggttgcagtgagccaagattgcaccactgcactccagctagggtgacagagtgtgaccctgtctccaaaaaaaaaaaaaaaaaag

SEQ ID NO: 11341 - DNA, 2239 bp, Homo sapiens; identical to SEQ ID NO: 11340

SEQ ID NO: 11342 - DNA, 452 bp, Homo sapiens
gaggggcggtctccatttgcttggtacctagcccctggggtgagttagggcaatttctatattggcttggtgtgtgaaagttagataaaggggaaggttgcggctatgttcttgacaatagttagatatgctcagggctcagtcctttgctgtctccaagaattagctagtcctgggagtctcttccctgccagcaaaatttataagataccagaacatcataagatacagaaaaaaaaccgtgatgaatgcaacttcacaatattgcctcctttttccttgcactgcctttccctgatccctctaccactttggttattgtgacagcaacaagattcatctttcaaccatctacaccaggggtcagcaaactatgggctgatggccagatctagccagctgcttgttttgtatggcccacaaggtaacaatgctagaaaaaaaaaaagaag

SEQ ID NO: 11343 - DNA, 501 bp, Homo sapiens
ctgcttggagaaaatgaaagttagcaaaaatcacctttctccagatgaatcgttgtgggaaagtaagtttagcagaatgtgctgtcaacttggttgagataaggcagttggaggactggcattattaaattttctgtggtgcaattaggggtcctcctaagtgcaggtgagctgtggtgaggagttaatgtatgctcagtaaatatgtgctgaatgcatgagcaaggcagttattaatctggttatcattggggattcacaaatttcactttatatcttgtaacaaatctcaaattgtgcccctgaaacatctggattttgaaaagtgattccaatccattgtcatgggtggcactattcccagaaatcaacaaaggaaatccaagccactgagggtttttaaaaaattttgagtattaactagactgttatactcttctgtgtttatatgtagtaccaataatcaagacaataaatccatctttaacaataatataaaaa

SEQ ID NO: 11344 - DNA, 501 bp, Homo sapiens; identical to SEQ ID NO: 11343

SEQ ID NO: 11345 - DNA, 452 bp, Homo sapiens; identical to SEQ ID NO: 11342

SEQ ID NO: 11346 - DNA, 3690 bp, Homo sapiens
gccttcctgaccctagatgggctttgtaaaaagagcaagtcgtgtgtgccagcctgtgcagcagtgagggcacaggcagcaccagggtcccgggtgtgtgggtgctgccccagcttgcagtgtggtctcctcggtgctggccacagctgtgggtccccaggaatattgtgctgcaggtcttagacagatttgggtactactggttctctgttcagcgtggcctggacagtccacagatggtagtagaccatggggtgttgagatgcaaggagactctgccgttctttcacattctgcttttgctcctgacagcttaggaaagctctctttgaaactttggtatgtgtggacctgagattgaatgtatctgaaaggttgctaatttctcactgtccttgcttcccaggacgccaggaaagcatgtgcagatgcaactctctctcaggtaagagcccactgagtcacgcagagccatctgcctgtgaggaggctagcacggcacccacacctggagcctcgggagggctctgcttgcattctctgttgcgcagtgaggatgccaagccactgcttttattaagaagtcattctgatggtaggcataggaaatagaggggcttattgagataaaaatgagatatctcaagccttgaataatcatctacctgttacagagggtaatagttgtaaaatattgttattgtcttaagatattttgaagctcctctcctcaacagaatctgcctcagaacttctatttctaatatccaatttgataatacctcaaaaagttaaacatagaattattgtatgactcagcagttctgccattaaatatatgcccaacaggattgaacactgcttttcaaacacacacatgtacatagcagcaccattcacaatagccaaaatgtagaaacaaccaaaatgtgcataaatgaatgagtggagaaacaaattgtggtgtctctgtgccctggagtattatcagccattaaatggacgtcagtacagtcagaggctgcaacgtggataaaccccataaatattacgatagtgagagaagccaaacaaatggctatgtattgtttagttctatttatatgaaatatctagaatagtaacattcactgagacagagtggactagtggccagcaggggtgttaggggagagagggagaggaagtgaacagggagtgactgctgaatcaatgtctggtctccttttggaagatggtttggaactagatggtggcagtggttttacaacaatgagtgtactaaatgccactgaactgtagactttaaagtgattaattggatgttacgtgaacttcaccttattaaaaaaatgaagtccatcccagcactttgggaggccgaggcaggtggatcacttgaggtcaggagttcgagaccagcctaaccaacatggtgaaaccctgtccctactaaaatacaaaaattagccaggcatggtggcacacacctgtaatcccagctactcagggggctgaggcaggagaattgcttggacccgggaggcagaggttgcagtgagcagagatcgcaccactgcactccagcctgggagacagagcgagactccatcttaaaaaaaaaaaaaaaaaaaaaagataataaaaataaagtccaaataattggacagaaatgtgaaagaaaaactatattcctacttctactgaagatgattaagttttttacattgtctaaatgctttaggggatgtgctttaattgaggttaaattgtaagttaaagaaaaaaaaattaggctacatagaattacctgaatttcaattctgagaagcactttggactgtccgtttttaaaacccactattgtaatccacttactccgtttgccaacctaaactcattaacatcagtgtctatatgtaggatgggctcagcaggtgtgtgtacagctggtgctccaagtgatggtcgtgcagaagcaggtgtcatgcaggcccacacatagcctgacataggaaccagctattaaattgtggtgtgggacatctgtgtggtgtcataagaagagttgcgagatctcaaagaactcagagacctaggaggagatggtcctggatggacagggagaggaggaaggaagcaggaagggaacagcaagtgcttcaaggctggccatgttcgtgtgcgtgcattggagggcagggcacacaggttcctgatgaccagccagactgagacttggtaagaggtacggaaggggttcagtgcagaatgccacagtggaagccactggagaactgtgggaagggctgggaagaggtaggcacagtgggcgagccaacagccttgacaaggatgggtgatgaggagaatcgtttaatcacagatgttgatttacagaaatgtttttattttcaagatcacaaacaacatcgacccagtgggaagaatccaaatgcgcacgaggaggacactgcgggggcacctggccaagatctacgccatgcactggggcacagactccaggtaggcgtgggcatgagcaggatgctgcttgttacattcaggggctgctctgttgtcctaggggaaaagtacctgaacccatttgctgtgctgtgcagtgaagaaattaggaagttgaatcagaactctgggcacgcaaggtgcagcgttcacaggtgcatattccctgtccagttttccacttacctgggctgaaagaacactgccatttcttcactgtctgaatcacattaatacaagttctgatttttctttctcccttctcctgtctctttcagtttctagacctctgtcttcccagttctactgcatcctacttatgtgaactggggaagttacctctctgtgcctgtttctcaagggctggttggccctcgccctcttgtgatgtcagtgccctggctcaggaaatcacagaacctgccccgaggatcctgagggattaagtgtattgagccttagaacagcattgtgctgtgtgtgctttgctgcggcagacacacgggaatgcgctgtgagctgctctcaccattctctcatctggcctgtctgccctgccttcctttggtttaccatcccaagagataattcccttcatgggctcctatttgttcttttcttttctctttttttttttttttttaaagacggagtctcactgtgttgcccagcctggagtgcggtggggcaatctcggctcactgcaagctccgcctcccgggttcacgccattctcctgcctcaccctccctagtagctgggactacaggcgcctgccaccacactggctaatttttttgtatttttagtagagatggggtttcaccatgttagccaggatggtctggatctcctgacttcacgatccacccgcctcggcctcccaaagtgatgggattacaggcgtgagccactacgcccagcctctttttttctttttttttttttttttttttttgagacagggtctcactcagtcatgctggagtgcagtggtgtgatcatatctcactgcagcctcgacgtcctaggctccagtaacccttcctactcagcctcccaagtggcataggccacaggcatgtgccaccatgcctggctaatattttttggttttttacagagacagggtctccctttgttgctgacactggtctcaaactc

SEQ ID NO: 11347 - DNA, 142 bp, Homo sapiens; identical to SEQ ID NO: 7551

SEQ ID NO: 11348 - DNA, 1202 bp, Homo sapiens
aagaaaagaaaagaaaatataaggatgtaaaagaagcaatttgcttgcacatctgaatatccttcttgtgcctccattttcactcttgaaaactgaaagcaatttgacttttatttttgtttttctaaagaacagctaggtgaaaggaggttaagctgattgtcactctgcctgcccactacctactccccaccatggtgtttcatgaaacatccccaccacctgaagtgatctttttaatccttgtgatagtaaatgcattgataattaacaggaaaaacatgtttttaaataatctacaaatgagaacccaaatagtagtgttttgtttgacagaagtaaatcaaatattatggtttaaatataatgcaaaatttcaggacagttaatttggacttcccttaccctaagagggtttttcttataataaggagaagaggtgtggttcaaagaaaattaagagacaaaaccttcaggtacataatgcatgaaaatctttaaatgcctgcaaaaattaagttctgttataataccagccaattctgaattagccaatgccctaaaagcatctaacaatttaaggttatcttatgagtcctatgaaaacaattatttgttgctaaatttgagttttagctaccaacgccatgtttacgtgacaagaaattgttttggccctgtggtttatgacgtgctgctggataagcatttatgtaaaactgagtatttcaaagagaaccatttacaattggaatttccacctgtgtggctgtttgcagacctacctctgtcttccattttgcatcctgtcagtgctataattagtttgatcactttgtcttgtttttcagtgtctacaattatagcttattcactatgttctaactatttaaaaataatgggccgggcgcggtggctcatgcctgtaatcccagcactttgggaggccgaggtgagcagatcacaaggtcaggagatcgagaccatcctggctaacacagtgaaaccccgtctctactaaaaatacaaaaaaattagtcgggcatggtggcgggcgcctgtagtcccagctactcgggaggctgaggcaggagaatggcgtgaacctgggaggcagagcttgcagtgagccaagattgtgcccctgcactccagcctgggcaacagagcgagactctgtctcaaaaaaaaaaaaaaaaaaa

SEQ ID NO: 11349 - DNA, 184 bp, Homo sapiens; identical to SEQ ID NO: 7572

SEQ ID NO: 11350 - DNA, 143 bp, Homo sapiens; identical to SEQ ID NO: 7597

SEQ ID NO: 11351 - DNA, 183 bp, Homo sapiens; identical to SEQ ID NO: 7394

SEQ ID NO: 11352 - DNA, 175 bp, Homo sapiens; identical to SEQ ID NO: 7613

SEQ ID NO: 11353 - DNA, 162 bp, Homo sapiens; identical to SEQ ID NO: 6214

SEQ ID NO: 11354 - DNA, 193 bp, Homo sapiens; identical to SEQ ID NO: 7396

SEQ ID NO: 11355 - DNA, 1209 bp, Homo sapiens
aagaaaagaaaagaaaatataaggatgtaaaagaagctatttgcttgcacatctgaatatccttcttgtgcctccattttcactcttgaaaactgaaagcaatttgacttttatttttgtttttctaaagaacagctaggtgaaaggaggttaagctgattgtcactctgcctgcccactacctactccccaccatggtgtttcatgaaacatccccaccacctgaagtgatctttttaatccttgtgatagtaaatgcattgataattaacaggaaaaacatgtttttaaataatctacaaatgagaacccaaatagtagtgttttgtttgacagaagtaaatcaaatattatggtttaaatataatgcaaaatttcaggacagttaatttggacttcccttaccctaagagggtttttcttataataaggagaagaggtgtggttcaaagaaaattaagagacaaaaccttcaggtacataatgcatgaaaatctttaaatgcctgcaaaaattaagttctgttataataccagccaattctgaattagccaatgccctaaaagcatctaacaatttaaggttatcttatgagtcctatgaaaacaattatttgttgctaaatttgagttttagctaccaacgccatgtttacgtgacaagaaattgttttggccctgtggtttatgacgtgctgctggataagcatttatgtaaaactgagtatttcaaagagaaccatttacaattggaatttccacctgtgtggctgtttgcagacctacctctgtcttccattttgcatcctgtcagtgctataattagtttgatcactttgtcttgtttttcagtgtctacaattatagcttattcactatgttctaactatttaaaaataatgggccgggcgcggtggctcatgcctgtaatcccagcactttgggaggccgaggtgagcagatcacaaggtcaggagatcgagaccatcctggctaacacagtgaaaccccgtctctactaaaaatacaaaaaaattagtcgggcatggtggcgggcgcctgtagtcccagctactcgggaggctgaggcaggagaatggcgtgaacctgggaggcagagcttgcagtgagccaagattgtgccactgcactccagcctgggcaacagagcgagactctgtctcaaaaaaaaaaaaaaaaaaaaaaaaaa

SEQ ID NO: 11356 - DNA, 187 bp, Homo sapiens; identical to SEQ ID NO: 7657

SEQ ID NO: 11357 - DNA, 153 bp, Homo sapiens; identical to SEQ ID NO: 6795

SEQ ID NO: 11358 - DNA, 193 bp, Homo sapiens; identical to SEQ ID NO: 7690

SEQ ID NO: 11359 - DNA, 136 bp, Homo sapiens; identical to SEQ ID NO: 6219

SEQ ID NO: 11360 - DNA, 150 bp, Homo sapiens; identical to SEQ ID NO: 7399

SEQ ID NO: 11361 - DNA, 142 bp, Homo sapiens; identical to SEQ ID NO: 7400

SEQ ID NO: 11362 - DNA, 181 bp, Homo sapiens; identical to SEQ ID NO: 7737

SEQ ID NO: 11363 - DNA, 166 bp, Homo sapiens; identical to SEQ ID NO: 7759

SEQ ID NO: 11364 - DNA, 379 bp, Homo sapiens
ggatatgagcctatatagttgccttattgtgcaagcttctacatttttcatgaagtggtccatgaagtgggctgtgaaaagttaaagacatgtattgtaatccctagagtaaccactaaataaataatgcaaagaagaatggctaaaaaggcaatagtaaaatattttaattctaaaataatattcaaataatttgttaaaatgcagaagaacaaaaaaaaagctagtataattacaataataaaatgatagacccaaaccaaaccatataaaccaaagataaacctgataatttgttgccctgttaataacatttaaattgttatctgcttgggaattctactttttttttttttttttgagacattatcttactctg

SEQ ID NO: 11365 - DNA, 268 bp, Homo sapiens; identical to SEQ ID NO: 7767

SEQ ID NO: 11366 - DNA, 368 bp, Homo sapiens; identical to SEQ ID NO: 6222

SEQ ID NO: 11367 - DNA, 4704 bp, Homo sapiens; identical to SEQ ID NO: 7404

SEQ ID NO: 11368 - DNA, 1658 bp, Homo sapiens
tacacaagcctccacccagcttctaattgtctcactgagaacagacaaaactccagtagaatccttgaatgacagctaattgtctccagaaaaaatccaaaattgcctccctcccttaattgtagtgcagcatgattctgtttttctgctgggcccctatttgcttctttctgtgcaatgaatcattgaaagagtgaccaccacggacttggagaatctttgtagcttttagtctgtgtttgggtgtggctggagagacaaattaacacacagagccggaccttgaaggggaaggtcctcatttgtctcagattgggatcatttggggaatcagaaaatgtttatatcagaaaagaagagaagtcaatgtgtttcgcaggtttgtggttttttgaaggagaaacatctagattctagtcctgttcctctgcctccttcttaggtgatgttagacaaaataattcacctctctgagtcaatttgcttatctgaaaaatagcaataacaacagcactcattttactagggcatgtgaataaacagatttttttcccattgagtggcaggtatttattgagtgcctactatgtgccaggcaccatcctactctctggggatacagcagtgaacaaaacagacgcacacctagtgatgagggatggagtaaagcccttagccgatgccaggacagaggacatgagtcacctgtagtcgctgccactgctgctatttcatggctacattttgacccctgtggacccactgaaacctcctcactgcctcacaggcagaacaaggacagggtcttggccaccaagtttactcacttgagctgcatttagattattcttccagctaggccatgacagtaggtagtggcagctctctgtaaagatgaggggtccccagctcggacccctggtttcctccacctgcctggaccttacagtggtagccaggtgtgtcctgctgactgggaagctccttacctgggtgcttgaagtatggctccttagcatgtgtggagagaaggctattatgatagcaacctgcaggggtgggatgtgtaccagaccttcaccctggaactcccgaggaagtgcctgcagattgcctggcaggtcttattcgggtgatgtagagcagaacgctggggccaggttctgaagtcagacccctggactcaactcacgcacaactccttacctccaaactgtgtggccttggtcaggggaactgacttctctgagcttcattttcttcatcttaaaaaaaaaaggagaatcacaccacctaccccatggagttgttatgaggcagagagatgtgatataaagcatgtacttggccaggcacagtggctcacgcctgtaatcccagcactttgggaggccgaggcagttggatcacttgaggtcaagagttcgagaccagcctggccaacatggttgaaaccccatctctaaaacactaaaagtagctgagcatggtggcacacacctgtagtcccagctacttgggaggctgaggtgagagaattgcttgaacccaggaggcggaggttgagtgcaccgagattgtgccactgcactccagcctgggtgacagagcgagaccctgtctcaaataaataaataaataaataaataaataatgaa

SEQ ID NO: 11369 - DNA, 1659 bp, Homo sapiens
tacacaagcctccacccagcttctaattgtctcactgagaacagacaaaactccagtagaatccttgaatgacagctaattgtctccagaaaaaatccaaaattgcctccctcccttaattgtagtgcagcatgattctgtttttctgctgggcccctatttgcttctttctgtgcaatgaatcactgaaagagtgaccaccacggacttggagaatctttgtagcttttagtctgtgcttgggcgtggctggagagacaaattaacacacagagtcggaccttgaagggccaaggtcctcatttgtctcagatcgggatcattcggggaaccagaaaatgtttatatcagaaaagaagagaagtcaatgtgtttcgcaggtttgtggttttttgaaggagaaacatctagattctagtcctgttcctctgcctccttcttaggtgatgttagacaaaataattcacctctctgagtcaatttgcttatctgaaaaatagcaataacaacagcactcattttactagggcatgtgaataaacagatttttttcccattgagtggcaggtatttattgagtgcctactatgtgccaggcaccatcctactctctggggatacagcagtgaacaaaacagacgcacacctagtgatgagggatggagtaaagcccttagccgatgccaggacagaggacatgagtcacctgtagtcgctgccactgctgctatttcatggctacattttgacccctgtggacccactgaaacctcctcactgcctcacaggcagaacaaggacagggtcttggccaccaagtttactcacttgagctgcatttagattattcttccagctaggccatgacagtaggtagtggcagctctctgtaaagatgaggggtccccagctcggacccctggtttcctccacctgcctggaccttacagtggtagccaggtgtgtcctgctgactgggaagctccttacctgggtgcttgaagtatggctccttagcatgtgtggagagaaggctattatgatagcaacctgcaggggtgggatgtgtaccagaccttcaccctggaactcccgaggaagtgcctgcagattgcctggcaggtcttattcgggtgatgtagagcagaacgctggggccaggttctgaagtcagacccctggactcaactcacgcacaactccttacctccaaactgtgtggccttggtcaggggaactgacttctctgagcttcattttcttcatcttaaaaaaaaaaggagaatcacaccacctaccccatggagttgttatgaggcagagagatgtgatataaagcatgtacttggccaggcacagtggctcacgcctgtaatcccagcactttgggaggccgaggcagttggatcacttgaggtcaagagttcgagaccagcctggccaacatggttgaaaccccatctctaaaacactaaaagtagctgagcatggtggcacacacctgtagtcccagctacttgggaggctgaggtgagagaattgcttgaacccaggaggcggaggttgagtgcaccgagattgtgccactgcactccagcctgggtgacagagcgagaccctgtctcaaataaataaataaataaataaataaataatgaa

SEQ ID NO: 11370 - DNA, 161 bp, Homo sapiens
ccgcctggtggtcctggaccacccccaccactgcaacgtcacctacaacgtcaataatggcatccagtatgtggccagccaggcggagcagaatgcgtcggaagtaggctccccaccctcctactccgaggccttgctggaccagaggtgtgtgctggatg

SEQ ID NO: 11371 - DNA, 301 bp, Homo sapiens
cagctgtggagctactggcagtcttgatagaacagcagtttctaggtagtgaccagattgcctggaattagtacagtcgaagcggcacgtacaggacaagaattcaagatgcttgacagtggagcacaagggcattagcttgagggacagccagaataaatggaaacttcattatccatggattatgcacttggaacttaggtcctaggcaactctgatattagtaatttggccagcaggctcattaagctcttaagaaaagtgggcctagttaatgaattaacacaagatgacattttac

SEQ ID NO: 11372 - DNA, 160 bp, Homo sapiens
ccgcctggtggtcctgaccacccccaccactgcaacgtcacctacaacgtcaataatggcatccagtatgtggccagccaggcggagcagaatgcgtcggaagtaggctccccaccctcctactccgaggccttgctggaccagaggtgtgtgctggatg

SEQ ID NO: 11373 - DNA, 301 bp, Homo sapiens; identical to SEQ ID NO: 11371

SEQ ID NO: 11374 - DNA, 2673 bp, Homo sapiens
gagccgctgtgaaaaaggcctccaccagcctctcaccagaagagattgctcattggaacgcaatgccacctggtgggggacgaggacagtgcgagcaagcagatgttatttcctactgacctaatttagagaacattaaacgtaagagagggaacatttggggttggaagcctgtgcccaaaaccttaaagagtgcaggcagctggccataaaagcagcttgagcaaacccctcattcagccgttgaaatgtgtgtgtgaacactttaaaggtttcctctgtgcttttcctgcgtgcatttggtcatcacagctgtgaagtggggtgggaatgtttcccctcgttttctaggagagaaattttgggttcagtgagacgaagtgctgcagacaggcccatggtgatgctcaggcctctgcttgaagttggtgctcacttcctggcaccacttcctgcccccaccagtgcttctggcagagcccagggcagtggctttatggaactgtgtaaggtgataggaacccacaggtggaatggccgtgtggcctctggactgaggagggctggaccaggttgtgggcacgcctggaacacacgccacatcctatcccatagcgaggcctcttccttgtggctctcgaaggatttgaggacgcgggagggtgaaatgtttccagagaaatatccaggacttttagaactaggctttcaaaagcatttacctgtcagataaattcaagtggcatcaatgcagattttaaatgtgtacagatatctccactcgcacgctgagttgtgcttcacacaagttttgcgcacggagtattccattaaatctactgaagcagtggggcaaggagaaaggagaggtgactgctgatgtttttaaagctctgacagtcacatatagattgtcccaggtacccctgctgcccccaagacactccaaaggcaaagatggatggtgacaaagtaaccttcatgcagaaacaagaacagtcacccccaacaacaagccctgctgaaggtgaagaatgccaccaggctgcctggcagttactgagtgcttattcctgctagcctattggagtcacgtcatatttgttacatggtaacttaattgtgccttccacgccttcacaaaatcagttgtacaagagaaggcacccaccacagtccatgtgacctttctcggtctgatttacatagtggggatgatgacactcgcgttgtagagtagttgcacgattaaacctggcacacagacataaagcactcaatgtctgacacatagtggactctcaagaagtttgtcatgcaggggacacttgaatgcccagtatgggccagacagcatcagctcatttcagtcccacagccctgtgagggaggaactctgccctgttttacagttagggaaattgaggcacaaaggctaagaagtcgatatccaagggcacagaatgattgggtgacggtgagcccaggcagtgtgacaacaaggttgctgccccacgccacctctgtctttcgtgggtatgtcggtgtgaggtgtaggcagccctgcactggcattcagcaggcgggactcccgggcaggctcttctgcgaacactcatgggccaccagccccttttggaacttgccttttttttttttttttacctgaaagctacgtgaatcgttggtaaattggtgtaaaaatggaactgagtcatctcaaaagttcctttcagttctaaaattctgtgaattgaagcctactttttcactttaaatgatttattgggtttacagttctttacgctttctgattgaactgatttgaagttcttatttcgtgtgttggggaacacacccccaacccgtcacagcgtggccgtgggtgggagatggacgttaggctggccagtcactagggggcagcatcagcacgggtctggctgtccctggccttagggagcagtttctgcccctcctgccccgtcagaaagtctcggactcctctctgcttgcatgtgtaaagttttcattttcaggggccttttagtcaaaaaaaataaagctgtatgacttagtgctgaaggatatgaattaggcgtagctcttgggttggcagcataaaccaaggggcatcaacccaccaccgacaagctaagaatggtttttacatctttaaatggttgaaaaaggaaaaagaatgtttagtgacacgtgaaaaatacatgaaattcaaacttcagtgtctacaaataaagtgcattagcacacggtcgtcttgcttctctatgtgttgtctgtgggtgctttgtcttatcccagcaaagtggaataactgggatggagacgctatggccctcgaagcctaaaatatttaccgtctgtcccttacaggaaaagcttgccataatcagcctcatctgaagaaagatgcacttcgcattatcttgaaggtcctgattttctgggaggagggactcgtgccctccttttcgggctctgctttcttggcacagtcagtagtttctggcgcttaagaaggcacagacgctaagtgggtgcagtgagcccaggcagtgcgcggcactgagcggttaggaagttgctggttcttatgcacagtcattcagcaaaccttggctgggagctcagcctagcgaggggcatcctagc

SEQ ID NO: 11375 - DNA, 2673 bp, Homo sapiens
gagccgctgtgaaaaaggcctccaccagcctctcaccagaagagattgctcattggaacgcaatgccacctggtgggggacgaggacagtgcgagcaagcagatgttatttcctactgacctaatttagagaacattaaacgtaagagagggaacatttggggttggaagcctgtgcccaaaaccttaaagagtgcaggcagctggccataaaagcagcttgagcaaacccctcattcagccgttgaaatgtgtgtgtgaacactttaaaggtttcctctgtgcttttcctgcgtgcatttggtcatcacagctgtgaagtggggtgggaatgtttcccctcgttttctaggagagaaattttgggttcagtgagacgaagtgctgcagacaggcccatggtgatgctcaggcctctgcttgaagttggtgctcacttcctggcaccacttcctgcccccaccagtgcttctggcagagcccagggcagtggctttatggaactgtgtaaggtgataggaacccacaggtggaatggccgtgtggcctctggactgaggagggctggaccaggttgtgggcacgcctggaacacacgccacatcctatcccatagcgaggcctcttccttgtggctctcgaaggatttgaggacgcgggagggtgaaatgtttccagagaaatatccaggacttttagaactaggctttcaaaagcatttacctgtcagataaattcaagtggcatcaatgcagattttaaatgtgtacagatatctccactcgcacgctgagttgtgcttcacacaagttttgcgcacggagtattccattaaatctactgaagcagtggggcaaggagaaaggagaggtgactgctgatgtttttaaagctctgacagtcacatatagattgtcccaggtacccctgctgcccccaagacactccaaaggcaaagatggatggtgacaaagtaaccttcatgcagaaacaagaacagtcacccccaacaacaagccctgctgaaggtgaagaatgccaccaggctgcctggcagttactgagtgcttattcctgctagcctattggagtcacgtcatatttgttacatggtaacttaattgtgccttccacgccttcacaaaatcagttgtacaagagaaggcacccaccacagtccatgtgacctttctcggtctgatttacatagtggggatgatgacactcgcgttgtagagtagttgcacgattaaacctggcacacagacataaagcactcaatgtctgacacatagtggactctcaagaagtttgtcatgcaggggacacttgaatgcccagtatgggccagacagcatcagctcatttcagtcccacagccctgtgagggaggaactctgccctgttttacagttagggaaattgaggcacaaaggctaagaagtcgatatccaagggcacagaatgattgggtgacggtgagcccaggcagtgtgacaacaaggttgctgccccacgccacctctgtctttcgtgggtatgtcggtgtgaggtgtaggcagccctgcactggcattcagcaggcgggactcccgggcaggctcttctgcgaacactcatgggccaccagccctttctggaacttgccttttttttttttttttacctgaaagctacgtgaatcgttggtaaattggtgtaaaaatggaactgagtcatctcaaaagttcctttcagttctaaaattctgtgaattgaagcctactttttcactttaaatgatttattgggtttacagttctttacgctttctgattgaactgatttgaagttcttatttcgtgtgttggggaacacacccccaacccgtcacagcgtggccgtgggtgggagatggacgttaggctggccagtcactagggggcagcatcagcacgggtctggctgtccctggccttagggagcagtttctgcccctcctgccccgtcagaaagtctcggactcctctctgcttgcatgtgtaaagttttcattttcaggggccttttagtcaaaaaaaataaagctgtatgacttagtgctgaaggatatgaattaggcgtagctcttgggttggcagcataaaccaaggggcatcaacccaccaccgacaagctaagaatggtttttacatctttaaatggttgaaaaaggaaaaagaatgtttagtgacacgtgaaaaatacatgaaattcaaacttcagtgtctacaaataaagtgcattagcacacggtcgtcttgcttctctatgtgttgtctgtgggtgctttgtcttatcccagcaaagtggaataactgggatggagacgctatggccctcgaagcctaaaatatttaccgtctgtcccttacaggaaaagcttgccataatcagcctcatctgaagaaagatgcacttcgcattatcttgaaggtcctgattttctgggaggagggactcgtgccctccttttcgggctctgctttcttggcacagtcagtagtttctggcgcttaagaaggcacagacgctaagtgggtgcagtgagcccaggcagtgcgcggcactgagcggttaggaagttgctggttcttatgcacagtcattcagcaaaccttggctgggagctcagcctagcgaggggcatcctagc

SEQ ID NO: 11376 - DNA, 353 bp, Homo sapiens
tccagagacaggcaggggcaggcaggggctgcaggcacctgcttcaccgcgggagggagccaggagaagtgggtcccagaggaaaatcttcctgtacacgggctgcattagtggtacctgagggcatctggaagaccgtggttctccttgcaacagtcacctaatggccttcagtgaaaagacagactccttgactctctctttccccaaacacattcctacagagtggaagtttccagagaaaacagccatcaaagaaggttgagagtgagaattaagagacactggagaagatcaagagaatgtgccctgaagacaacaacaaaaatcaataaaagatttcaagaatgaaa

SEQ ID NO: 11377 - DNA, 353 bp, Homo sapiens; identical to SEQ ID NO: 11376

SEQ ID NO: 11378 - DNA, 2236 bp, Homo sapiens
  misc_feature (996)..(1995): n equals a,t,g, or c
tgcagggagctgagatcgcgccactgcattccagcctgggtgacagagtgagactccatctcgaaaaaaaaaaaaaaaagaatctgaggtttaattcaaggagcagtggaagccattcattccaaattgtcaggatctatgcaggtatgcccctccctgtcctctctgagcttagggtcaatgcctagaaatgtatgtgattgctaatagatttgctacatgccaggcactactctgagcactttattccttcctttctaatttgtgtgccttttatttcttttccgtgctttattgcattggctagggcctccagtacagcactgaataggcatggtgacagcacgcagacatcccttccttgttcctgatcttaggagaaaaacattccacttcccactcccaccaggaaggataagattcgctgtagttttgggtgttattattattatttttttggtttgcttgagacagagtcttgctctgttacccaggctggagtgcagtggcacaattttgactgactacaacctccacttctcaggttcaagcaatcctcctgcctcagcctcccgagtatctgggactacagtgtacaccaccacacccagctaatttttgtatttttagtagagacagggtttcaccatgtttgccagtctggtcttgaactcctgacctcaagtgatctgcccgcctcggcctcccaaagtgctggaattacaggtgtgagccactgtgcctggcctagttttgggtggttttttgtagatgtcttttatcaagttaagaaagtttccttctagttctagtttgccgagagttttcttttttaaaatcatgaatggatgttgaattttatcaaatgcttctacatttattgatatgataatatcatttttctctaataactatacatttatttaagcctcccaacagtcttatgaggtagatactgggttcacaccaatttaaaaaaaaaaaaaaaaaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgagtacagaagttcaacaccatcctggccaacatggtgaaacctgtctctactaaaaatacaaaaattagttgggcatggtggcatgtgcctgtaattccagctactggggaagaggcaggagaattgcttgaatccaggagacggaaattgcagtgagcccgagatcatgccactagcactccagcctgggtgacagagcgagactctatctcaaaaaaaaaaaaaaaaaacaagg

SEQ ID NO: 11379 - DNA, 957 bp, Homo sapiens
tttatttctgttgttgttctacttctgggagacttcttcaactttgtattctaatatttctctgaatggaaaacaacttcatatattattcacacaccacataattcacctatttaaagttcaatggtttttggtatattacattattagttttttaataattgtagtaaaacatataatacaaaacagttatcattctgaccacttttaagtgtaccattcagtggcaataacttagtgttgtgcaaccataaccacaaactatttccaaaactttttcattatcccaaacagaaactttaatcattaaacaataattatccatttctccactctgcaacctggcccctagcaacctctattccactttctgtccctatgaatttgccaattctatatacttcaaaaaagtataatcatacaatatctgtccttttcagtttggcttacttcacttatcataaggttttcaatgttcatttacatagcatgaataaggatgtcattcctttttatggtggaataatatcccattggatgaatataccactttttgggcttttgttatttttcattgacatatgataatcatgtggctggtgtctgcaatcccagcactttgggaatctcaggaggggggatcccttgagcccaggagtttgaaaccagcctgggcaacacagcaagatctcatctctacaagtaatttaaaaaattaggccaggtgcagtggctcacgcctgtaatcctagcactttgggaggcggaagcaggcagatgacctgatgtcaggagttaagagaccagcctggccaacatggtgaagccccgtctctactaaaaatacaaaaatcagctgggtgtggtggcgcacgcctgtaatcccagctactcaggaggctgaggcaggagaatcgctggaacctgggaggcagaggctgcagtgagctgagatca

SEQ ID NO: 11380 - DNA, 115 bp, Homo sapiens
gggcgcagtggctcacgcctgtaatcccagcactttaggaggccaaggtgggtggatcacgaggtcaggagatcgagaccatcctggccaacatggtgaaaccccatctctacta

SEQ ID NO: 11381 - DNA, 89 bp, Homo sapiens
tgagacagagtctcgctctttcgcccaggctggagtgcagtggcgcaatctcggctcactgcaagctccgcctcctgggttcaggccat

SEQ ID NO: 11382 - DNA, 2907 bp, Homo sapiens
  misc_feature (27)..(27): n equals a,t,g, or c
gatccagcgcactgggccctgaccctnggacctggtcatctttgcgtgtggaaaagatggcatttccagttattgacaggtggatgctggcctttagggaaaaaaaaatattagaattccctacagaataaaggatgaagatgagaggttaaggtttttctaaggcatgaagagctgtgggggcagctgcccttgttctttttgtcgtgtgtccttcacatgcagtaactctgttcacgcctcacaaaaaccctatgaggtggagacctgccatcaacccttcctgcccgggtgccactgaggccccaaggttaaatcatttcccagagtgtatcagcagaggcacagccacagagacacgtccgcacagagagctttccagatcaccagtaacagcgtgagatcatggtgcagaaggtcatgaggaggatggcaacgagcgagacacagccggttggtgctcacaaggacattggtagatctgactgagggccaggtcggctaggccttcccaggtgacaggagcccagtgccggccttggtgcacacagcgcgtccttgtgctttctcaggagagcttcactggggacactctgtgatgtttttggagggtcatttggtaatgtgttcaggagccaaaaaatatgcataatattcagtcttacaattacattttttgaatttatctcaaggaaatcccagggatctgtgtgaagctgcacatgctgctgctgctcagtgcgggactgtttataatatttgtaactcaaatgtccagaagaactgtacactctgtgcatgttttcagtaagttcatatttgtaagaaaaagtgggtgtgttgagagacaaatttttgtgtacatttacctggaaacaagcagtagtacacatatgcatgcatgaagtggtgttttcctgagtgttaagattgtgaatgttttattatgatcatttctactttttctattggaaaatactttgtgtaattaaaacatgaagatggagctaccatcaaaatggtgagcaatagagcactgttcctcctggggtggcctggtgggcctgagggactcaggtggtgatgaggagtggccttgagtccctttcctttccatgggacagtggggacgagagctagagtgatgaggcaggttaagtgtgtgcctacctccctgtggctggagcactgttgtggccaccccgggaccccctgagcctggtgtcgccctggcttgctggtcccagcctagggagtgggcccctatgggcagagggtgaggtggctgtgctggcactgcagctcaggcacacacacactggagtgttccaatgggtgatcaggttggatggagccttgaaattaagtcagtgatgtaatttttataatctgtttcactttaaaacaaaaatctttgcacacctggtccaagttttctcccctttcttcctgttgctgccatgatgaaagcagaagggaccaccctccagggagagcagcaggaagggaggtgcgggtaggggccctgggtcagcaggggcggtcagtccggaggtgcacccccatttattcctcgttctggaagagatttctagtcacatgcatgtggctcctgtgccacatgtgtcatgaggtgcccaggtgggtttggatttggatgagggcatctttgaggatgcaggggctttgtcataccctgtgggccccgtgtacacccctggggcagatgtggcctctaacaggggagggtgcatggatctctaagccggggaggaaagcagattgcagacttgccgaagtgggagctgtctgctcttgtgttttctttaggggcaggagaattttgcccagcagtccctcgtggctccctccacaccactgacccttacgcgtccaaggttggagccctggcaggtaaagggtgagcaaggtgcagttgcctgtgagcagctgtggaggggcctttcctgttgtacacttcctgtgagggtctcagaccccttgcagactctggacatcacttcctagaggggcctgggctcctttagtcctgtgagtaaagctttggttttgatgactgtctcagggaaaggtagaaaggtgcttggtggcagtgaacttcctgctgcagaagtgggtgtgaccccagtgctggagaatgggctgtgagccgagtttcccgcacctgcatgagtgagcgccatggtccttctccacagagcgtcctgctgtcactttggtttgtgttaactttgacgcctttcttgtttcttactctgctttcctgcatggagcacacagccccggctccctttcagtctgcatggcagacacctggcctctgcaggtccagttcattctgtgtcccctttcggtcgtccctatgttgccgtcaggtgattgagggtgaaggtcggccttggcagcccagtggaaagtcccttgactcctggccgtcagtggcaggtctccagcctttgggaggaggaaacttctatttaacaaagaaatggaattgactttgccacacacagccagagcgatgatttgtagagccaacctgctgagacattcaaagcatcagtcgtagggtcaggaccgccaggtgaggtgtggctccacctgcagcagcctggggcaggttgcctagcctctggctttagcatccccttctgtgaaatggggaaagtgatgggacctggctttgtagggtggttgtgaggacctacaggggtttttgcaaaatacttagcccagggctgactaaaagattcagagacgctgggcatggtggcacacacctgtagttccaggtactcgagaggccgaggcgggaggatcacttgagcccaggaattaaagtccagcctgggcaacatagtgagaccttatttcttaataaaaaaa

SEQ ID NO: 11383 - DNA, 4602 bp, Homo sapiens
cccagctcagctactcaggaggctgaggcaggagaatcgcttgaacccgggaggcagaggttgcagtgagccaagatcgcaccattgcactgcagcctgggcaacaagagcgaaactccttcgccaaaaaaaaagaaaaaaaataaaagctaattacaaatacaggaaaatggataggccatgtgtttataagtttgagctcttgagccagtgacttccctgcacgttcagctttctcctttgtgaaatggtaatagaagcacgctgcacaaaaaattcttgtggattacatgtgagggtcttagaaacacttgatgtgtaagccaactattatgtattactgtatatggaacacaagggatgtagccaaaactaaatgcaagtttgtgcctcagatgtcttcctatcagaacagagtcaaatccagattttgatgcttaaatgtgacagcttattcagatttagaaaaacttttggtatgggccaaagaaaacatatccttaaggggatatggcccctaggccctcattttccttttctgtctgagcaattaaaaaaagcattaagtaaattccacaaattctttggaatacctagagataaacagatatcatgttaactgtatgataataagttagaatacttgcaacaaaatgcagagttttctaggaaaacaagtaatcattcagaaataagaatatgaatagttcctcagttctccccctttgtggaatttgtgcagtaaatgctgctccaaagctctgtggaaaacagaagcttcccatgaaaaatctgacaagggtatctctcagaaagagagctgtaatcccagcactgtgggaggctgaggtgggagtattgcttgaggccaggagttcaagaccagcctgggcaacgtggtaagacccccatctgtaaaaaaaataataattagccacgcgtggtggtgcacacctgtggtcccaattactggggagactgaggcggaagaatcgcttgagcccaggagatggaggttgtcgtgagctaggatctgccactgcactctagcctgggtgacagtaagacccttgtctcaaaaaaaaaaaaaagaaaaactgcagattggtgactcttacgaagatagatggaaatgttctaaataaaacacacttaggatctggcaatatatatatttaatgtactattctgaccaaatggagcttaatcagatagcttgagaatgatttaatgttacgaaatctgttaattgcattatctcaataatagatcggtgaataactttattattctctcaacaaatcctgtatttgatttacaaaatggatgggaggtttcagggagagcagttggaagcctgtgtgctcacctgttaggaacgagagtggcaacagcagtggggaggagtgctcggctcctgcacctgtctcgatggcagagcccacaggcttggctgacagacgtgggatgaaggaaagagaagcctctcactcttcccacagcattgtagtgcgatttcatgcagaagtccaagcaggttccaggacaattgtgtaagaagctatggacaagaacgtctaagaaacggaaatgacatagaggatttgcactgtagctaagacttcacgcaaggctgtggccagctgaaagcatgttctggtgctggggctgcgtggcagagccaggagcccaggatccagcgcactgggcaccgacctgggacctggtcatctttgcgtgtggaaaagatggcatttccagttattgacaggtgaatgctggccttttagggaaaaaaaaatattagaattccatacagaataaagaatgaagatgagaggttaaaggtttttctaaggcatgaagagctgtgggggcagcctgcccttgttctttttgtcgtgtgtccttcacatgcagtaactctgttcacgcctcacaaaaaccctatgaggtggagacctgccatcaacccttcctgcacgggtgccactgaggccccaaggttaaatcatttcccagagtgtatcagcagaggcacagccacagagacacgtccgcacagagagctttccagatcaccagtaacagcgtgagatcatggtgcagaaggtcatgaggaggatggcaacgagcgagacacagccggttggtgctcacaaggacattggtagatctgactgagggccaggtcggctaggccttcccaggtgacaggagcccagtgccggccttggtgcacacagcgcgtccttgtgctttctcaggagagcttcactggggacactctgtgatgtttttggagggtcatttggtaatgtgttcaggagccaaaaaatatgcataatattcagtcttacaattacattttttgaatttatctcaaggaaatcccagggatctgtgtgaagctgcacatgctgctgctgctcagtgcgggactgtttataatatttgtaactcaaatgtccagaagaactgtacactctgtgcatgttttcagtaagttcatatttgtaagaaaaagtgggtgtgttgagagacaaatttttgtgtacatttacctggaaacaagcagtagtacacatatgcatgcatgaagtggtgttttcctgagtgttaagattgtgaatgttttattatgatcatttctactttttctattggaaaatactttgtgtaattaaaacatgaagatggagctaccatcaaaatggtgagcaatagagcactgttcctcctggggtggcctggtgggcctgagggactcaggtggtgatgaggagtggccttgagtccctttcctttccatgggacagtggggacgagagctagagtgatgaggcaggttaagtgtgtgcctacctccctgtggctggagcactgttgtggccaccccgggaccccctgagcctggtgtcgccctggcttgctggtcccagcctagggagtgggcccctatgggcagagggtgaggtggctgtgctggcactgcagctcaggcacacacacactggagtgttccaatgggtgatcaggttggatggagccttgaaattaagtcagtgatgtaatttttataatctgtttcactttaaaacaaaaatctttgcacacctggtccaagttttctcccctttcttcctgttgctgccatgatgaaagcagaagggaccaccctccagggagagcagcaggaagggagatgcgggtaggggccctgggtcagcaggggcggtcagtccggaggtgcacccccatttattcctcgttctggaagagatttctagtcacatgcatgtggctcctgtgccacatgtgtcatgaggtgcccaggtgggtttggatttggatgagggcatctttgaggatgcaggggctttgtcataccctgtgggccccgtgtacacccctggggcagatgtggcctctaacaggggagggtgcgtggatctctaagccggggaggaaagcagattgcagacttgccgaagtgggagctgtctgctcttgtgttttctttaggggcaggagaattttgcccagcagtccctcgtggctccctccacaccactgacccttacgcatccaaggttggagccctggcaggtaaagggtgagcaaggtgcagttgcctgtgagcagctgtggaggggcctttcctgttgtacacttcctgtgagggtctcagaccccttgcagactctggacatcacttcctagaggggcctgggctcctttagtcctgtgagtaaagctttggttttgatgactgtctcagggaaaggtagaaaggtgcttggtggcagtgaacttcctgctgcagaagtgggtgtgaccccagtgctggagaatgggctgtgagccgagtttcccgcacctgcatgagtgagcgccatggtccttctccacagagcgtcctgctgtcactttggtttgtgttaactttgacgcctttcttgtttcttactctgctttcctgcatggagcacacagccccggctccctttcagtctgcatggcagacacctggcctctgcaggtccagttcattctgtgtcccctttcggtcgtccctatgttgccgtcaggtgattgagggtgaaggtcggccttggcagcccagtggaaagtcccttgactcctggccgtcagtggcaggtctccagcctttgggaggaggaaacttctatttaacaaagaaatggaattgactttgccacacacagccagagcgatgatttgtagagccaacctgctgagacattcaaagcatcagtcgtagggtcaggaccgccaggtgaggtgtggctccacctgcagcagcctggggcaggttgcctagcctctggctttagcatccccttctgtgaaatggggaaagtgatgggacctggctttgtagggtggttgtgaggacctacaggggtttttgcaaaatacttagcccagggctgactaaaagattcagagacgctgggcatggtggcacacacctgtagttccaggtactcgagaggccgaggcgggaggatcacttgagcccaggaattaaagtccagcctgggcaacatagtgagaccttatttcttaataaaaaaa

SEQ ID NO: 11384 - DNA, 443 bp, Homo sapiens
gggagtttcatggcgatggccgtctaccctcatggctgtggccccagttcttcctgggtgggccctgctgtagttctgctatacgctgtccctgttctggactctggtgacgccacaccttccctagtccctccagccctaggggtggcagccccacgacgtgctggtctctggtgcttgcttcttagtgcatggccgtgccatgccctggtgcctgcccgggatgcctgtgtggaatgcccagagtgttctaggcagggtcccctctgtgattagctcctcaagggtggtgtctgtgtcacagacactttggggtcctgtcagtggcctctcgaggctcccagggtaccctgtactttctcaccccttgttgctcatctattgtgggtttgtctgtgtgctgcaaaatgcacggctgtactgagcgcaccagccagcagctg

SEQ ID NO: 11385 - DNA, 443 bp, Homo sapiens
gggagtttcatggcgatggccgtctaccctcatggctgtggccccagttcttcctgggtggcccctgctgtagttctgctatacgctgtccctgttctggactctggtgacgccacaccttccctagtccctccagccctaggggtggcagccccacgacgtgctggtctctggtgcttgcttcttagtgcatggccgtgccatgccctggtgcctgcccgggatgcctgtgtggaatgcccagagtgttctaggcagggtcccctctgtgattagctcctcaagggtggtgtctgtgtcacagacactttggggtcctgtcagtggcctctcgaggctcccagggtaccctgtactttctcaccccttgttgctcatctattgtgggtttgtctgtgtgctgcaaaatgcacggctgtactgagcgcaccagccagcagctg

SEQ ID NO: 11386 - DNA, 1936 bp, Homo sapiens
  misc_feature (1768)..(1768): n equals a,t,g, or c
ttttttttttttgtatttttagtagagacgggggtttcaccgtattagccaggatggtctccatctcctgaccttgtgatccgcccgcctcggcctcccaaagtgctgggattacaggcgtgagccaccatgcccggcctcaacgatattgattctttgggctgtagtcagtattggattatgatcaatattatcaccatttattttgttgctacagttcttccagctgtggccaatccttcagttggattcttgttttccatcaacattctccatcctggctttttgttttgagcacttccttccttcctagcaccaccaggctcttgtattatccctgtccctgccctggaatcgactcctcctccagagagccctggtttcttttgttagaggatggtatatagaatccaacatgcagacactcggtggacttattgttactggggttttgttatactagggtttcagtggtcagtgctagtatttatgtatgttaacccacgctgtgctttggattcaggctatttcaaattttagataatatggtacatatattattaataccactagttactacattggtacttttcagcaaaatatatctaagtgggatcaaatgagactgtaaatagctttacatcagttcaggtcagttatgttgctaaattacttttggcattaagtttagggaaaaaaaattgggtttgggattttttggtttcaacatttgtgattgagagactatggacctgtaataagtccaagaacagcagttgcagtgtaacaggactgttaatggaatcgggtcatttagaaacagtcaagacttcgctgttgtgcatgtggttaggagccagtgcacacgtcagttcttaggaaatgtacagtctgagcaatagcatttgaaatccaagactcttcccattgtgttgctgttgagtgtagaaaataaaatgtgtgaatttctttatcttgagtattgagattctccccttagaataaaacaagaatttttctctcagtgtaaaaatgtcaagttttattcttgaaatgaatagcaaagttaagcttaaaaacgtgaacagcttcagaactataaatgggtatgtatacctttctgctgtctaagggcagagaagggaaagaaagtgtggtgcttatcagaggagacagcagcaagacacattgtgacagaaaaccaagggtatcctgtgtcacagtgaagtgtaatgagggcacctctcctttcaagagacgaagattgaatacatgggaagcacactctccgctgtgtgttgtctaggagaggtgcaccctgtatggaaatatttgggaaggttaagattaagacagggtaaaataaagcaaaggcaaatcacaaagcaagggctaatgttaatatgaaaagtgcagaattcaaggaaaaagcatggggacaaagaagatttttcctctttttggttgctgttcatgtgtagcctacaacagaactataagacctatagacatttatatgaatatttatttgaaaacgtataatatcaaacaatgtaaaagccaatagaaatctcagataattgaatgtatagaaactagcagtttgaaagtgattagttcattatttgctgatcaagcagaaaaataagcatatgaaagatatttaaaatgggattaataaagttgatttaacagatcctattccatgtcctttgaatatttatagaaattaaatggaacaaattagggcatcaggaaaactatacanaagtctttaccaaaaaaaaaaatatatatatatatgtgtagtactacctatatatatacataatatatagtactgcttatatatatatatgcctatatgtacacatatatatatacatgtataggcagtactatgttttctgatcataatatgttaaattagtaaaaa

SEQ ID NO: 11387 - DNA, 22689 bp, Homo sapiens
agagaaaggaaaaaattcttagcacagtacttattacaatctgatttcttttctttgtttttctgtcaccttttactaggatgtatgctccatgagagcagagcttcatggtcttgtttgcctctctgctgtctccacaatgactgcagcagtgtctggcacagagatgccaaacatttgctaaaggaatgagtagggaatcaggttctgttttgtcttacaccccccagtgcctaccactgtgcttggcccataacaagtgcccagaaactggtgggtactctgaggccactctgaatataattgctattggtagatctgtgttctcatcctagaatttagaatgggaaagcggtttagaactaagagtctttcaagtgtttcgagccaaactgcaaagcttttagaatattgtctctgcagcctgaaactgactattacacaggttcccccagttcccattcaagagcgaagtctagatgtttagaattctatgcctaaatagcagaacggaagcctcattttattttgattaaattcctattttaatacatacattgcatcagtcagtgagtcagtgagtatttattgagccccttcaggatacaaagtagtgctctggtagagctattgagtttgaaatattagtcacatttttaaaccaaaaccaaatccccaagtagttgaaagtgctgttcaaattgtcagagtgcagttcctgtagactgtattttgtgagatgggcttttactttatatgttcccacttgggcaggaacaaaagtttggtaaattactgaggtattacattttaccaaaatgaaattttgaagtgatccttcatcattagctttcttcctgtccaattgttgagggagtgtgtgataattacagcatcttttgagtaatttaagattttgggatcttgtgctgccaggacagggtaaagaataacacttgccttcactctttgacactagtgttcaaattgggcagggaaagaaggggtattattgttgcctcccagatcccaactctatccaaagtactgtctcctttacttctgtgagctgacagggttgcagaaacacataaaatcctagactatcttgacatcaccaaccgtagagtttgtgaaggtaacgtgtcctctacaaattctcatttgttttcattgtttgttactcttttttgttcagatttctctgttgacttctgcagtgaaccacctcaaagccaatgttaagtcagctgcagacttgattagcctgcctaccactgtagagggacttcagaaggtaggtgccatgtgtgggtacagagacttcagaaggtaggtgccatgtgtgggtactatttgccataattctagcttcttataagttttcattgaaagcctagcatttgaaatcagctgctccaagagggcagtaatggagtgtatcactgtgtcctaaagaattcagaacaattttgttttggtctggttagttaggcctttaatttgcaacaggttacctcagctgtgatttatatgggttcatacctttttatttggctctctgagtcccagaattgctctgctggcactcttgtgttagcatatatgggttcgcttttcagcttgctttttcagttcaccactcacaatatcttcatcaaagcagaccaattgtacatgatagttaccctaaatctctgttactttccataattaagaaagttaaaaaaaaaaaaaaaagatgacctggggaaatgcaaaaattaaaaattcaggaaacaagtgttggcaaggatatgtggaacgaaggaaattttcaaacactcctgctcctgctaggagtattaattggtaaaaatcactttggaggctgggcatggtagctcatgactgtaatcccaacgttttgggaggctgagccaggaggatcacttgaacccaggaattacagaccagcctgggcaacatagggagacctcgtctttacaaaaaattttaaagttagctgggcatggtggcacacaactgtagtcccagctacatgggaggctgaagtaggaagatcacttgagcctgggaggttgaggctacagtgagctgtgaccaaccagatgaatagtactcagggatccttagagatggacgggaagagtggataggggtaggaaggcagaagaggtgcctaattcgaacataaagaacatcatcccctgacacaggaaatggaagaagggattccccaaacggtggatatcaaatctaggatctttgaattataaaaatatgtgctaagtttggtcagattatgtgccagggtctatgagcatatgaattctttccacaaaggagcaagaaatttctaagccataagcgaagacaaaatttgctattttatagccacaccatctgtgtgtgctcagtctccataatttgctacttgtccaatgtggccatctacttacaaattcggggggaaaaaaaaggggtagggacaactctgatgaggccagattcttgccgttgttcctagggccaattcaggaaatgataggcttctgtagccattagtacagaagcagctctcacagtcttgcattagaaaaggaaactggtttattcttttttttattacactttaagttctagggtacatgtgcacaacgtgcaggtttgttacgtatgtatatatgtgccatgttggtgtgctgcacccattaactcatcatttacattaggtatatctcctaatgctatccctccccccaccccaaaacaggccccggtgtgtgatgttccccttcctgtgtccaagtgttctcattgttcaattcccacctatgagtgagaacatgcagtgtttggttttttgtccttgcaatagtttgctgagaatgatggtttccagcttcatccatgtccctacaaagaacatgaactcatcattttttatggctgcatagtattccatggtgtatatctgccatgttttcttaatctagtctatcactgatggacatttgggttggttccaagtctttgctattgtgaatagtgccgcaataaacataagtgtgcgtgtgtctttatagcaacatgatttataatcctttgggtatatacccagtaacgggatggctgggtcaaatggtatttctagttctagatccttgaggaatctccacactgtcttccacaatggttgaactagtttacagtcccaccaacagtgtaaaagtgttcctatttctccacatcctctccagcacctgttgtttcctgatttttaatgatcaccattctaactggtgtgagatggtatctcattgtggttttgatttgcatttctgtgatggccagtgatgatgagcattttttcatgtgtctgttggctgcataaatgtcttcttttgagaagtgtctgttcgtatccttcacccactttttgatggggttgtttgattttttcttgtaaatttgtttaagttctttgtagattctggatattagccgtttgtcagatgaggagattgcaaaaattttcttccattctgtaggttgcctgttcactctgatggtagtttcttttgctgtgcagaagctctttagtttagttagatcccatttgtcaattttggcttttgttgccattgcttttggtgttttagacatgaagtccttgcccatgcctatgtcctgaatggtattgcctaggttttcttctagggtttttatggttttaggtctaacatttaagtatttaatccatcttgaattaatttttgtataaggtgtaaggaagggatccagtttcagctttctacatatggctagccagttttcccagcaccatttattaaatagggaatcctttcccattttttgtttttgtcaggtttgtcaaagatcagatggttgtagatgtgtggtattatttctgagggctctgttctgttccattggtctatatctctgttttggtaccagaaaaggaaactggtttattcttgaatttattcattcaataaacatttgtggaacttcctccagtatgtaccaggcactttgctgttgatgggaatactagtttcagagttttgctccagagttcacatggctctgtcagttgcttccttaggggaaaaaagaaaagaaaaaaaaaatccttaaacaagagcttactatcttctggcatcccaatgggttcatacatccagccagtgaggattggattcacaaacagtaggtgtctttgaatgcctgtagcttttgcaacaggcattcagagcttacatagatagcaacagagcttacatagatagcaaaccagcttagatacttttacccagtgtgttgtctctttgcaaatctgtgtgtttatcatgccaggcactgtgtttctttcaagtggctcagttttgaagtggtaggtcatgccaaatacctaactttattgtatctcatgtaatttttattagtgtcatctcgtgttctcttggattcttggatatcagtgtaataaaaatgaccttggttaaaaatactaatgtggcactgtaaaactgtcagcatgtcttgaaaaggccaaaactcactgaatagtaacacccttttagatgttcccttaggacaggctttttttaaaacatggcttctgaattatatctccaagttccctgtccacttgggctttttagggctaatgaaagcaaagtaagccactactcatatccctattcagtggttgctgacaggattctacttttttttcatctctgcagtattgagtttcccaaagccagatatggttccctcccacttttgctcgaagtgtcctttgctcctaacaagtggcagtctactgtgttagctcggccatctgccttcccacagcagggattgacagaggcagtttgtgagagaaccttatccctgggttccagatttataaactaatattttttctttagggaagatttggttttcctctaggaaaaatcatttaaattaagaaaattacttgtttgattgatagagaaagagtcctgttaattatctcagtatacactacatgtaatcatagtttgaagatatttgaaataatcagaaacaccgattttcattagggcagtgtttcattagggcaatgtaaattaaaatcacaatatacacttccattagaatggctgaagttgaaaagaatgactgtaccaatattggtacaggattggtgaggatatggagtaacaggaactctcattccctgctggtgggaatgtaaaatggcataaccattttagaacattgttgggcagttttttaacaagtgaagcatagacctgccatatgatcagccattcacctgctaggtattatggcgattagaaagcatatgataaaggggaatgtctataagtccacatgaagacctgaacacgaatgtttatagcagcttcatttgtaatagtcaaatattgaacacagcctaaatgtccatgagcagggggagagataaactgtgatagagccacacaatggaatgctgctcggcagcctgccaagtagcctcaacatggatgaatcccaattctgctgagtagaagcagccacactttaaaaagcactacttgctcactggttctacttatataaaatctagaaaatgaagactgatttattgtgacagaaagtggatcagtggttgcctgggaacgatcggcaagggagtgattacagagagtcatgaggaaactttcagaggtgatgagtgtttattatcttgattgtagtactggtttcacaattgtttatgtgtcaaaacattcaaattatacatttttgaatatgtacagtttattgcatgtcagttgtctcttaaagcttttttacaccttcctatatgtttccattcagagtgtagcttccattggcaatactttaaacagcgtccatcttgctgtggaagcactacagaaaactgtggatgaacacaagaaaacgatggaattactgcagagtgatatggtaaggagacccagcaagtcagcatgctcctgctcacccttttttgtgtaagagtcatgttgccaactttccactaatctgaaaaggccctgctatgcatctgttcaaaagatctaataagcagtatacattgattgttctacaatttgttaataaagcaattatggtagataaaattaaaagccaaatcttttgcaaacatagtactggaggaggtaaggtaataagacacagttcctgaggatggaatgggtaggacagaaaatggaaaagaaggaaaggaagtggaaaagtgtctcattgtttattactacataacaaagcacccccagaagtttgtggcttaaaacaagtaattatttctcactattctgtgcatcaggaatttgagcaaggctcttagactcccaaatgctgaaacatgtgctcgtggatgaaaggcaggctgtctagcatgttccagctccagccaggctgtcagttaaatgcagcctacaacacatggaacagcaccacccccatccctcaacccccagctgagcccagtcaacccacagaatcatgagaaatacttaattgttgttgttctaagccacaaagctttgggataatttgttaggcagcaacagataactgacagaatcaaacccctgcagtgcctaggaattgttttcaaatatctctggatcacttagtgctgctgcagatgtaagctgtctgcagtcatttggaggccttaatcaatcacttaatgggtgacagccccgtgaaggatttatgaagagtaaaaaaaggatggtgcagcccttgccatcttgctggggagatgagttatatgtaactcatctgaaatcaggactattcaaggcacacaaaagttccctagtctctctgccaatttctggatctgccctcccacccccacctgctctttgcaagcttcagaatttcaagtttaaattgggaagtttgtaccaaggagacctgggctatattagagagctctagaagagagtttttttccattttcttcaggactggcacacctcactgttacttagtggggctaacccagaggaaaaaacattgatctgggtgtcaagacccttggttctggttctaactgccgctgagtaactgtgtgacccatagtaacaaagacccctctaattcagcaattcttttattattttaatatcttgattatgctctcaagtaattcactattttctaaaataatttttcctaactaaaaaatttcctgccttctagaaccatggattcccccctccttctctcctccttttctctttattgttgccttttggttttcttataaaaacagggttgatttcagatttcaaggaaaacaacttattttcaccagttgcattctgttataattaaatctacttcttttaaatttccatagctgccaatggtaatcctcctactgtcattctttgtgctagataagtcatagttatgggctctgaagggttaagccatgcaaagttttcctcactaaaggaaaagtgtatataaacatgttatacttcagtctctggaaagaaacttgagcagtgggaagggaatgggaaaggaaagataaccctcaaacataagtcttacttagcataatgctataagggaaaaactaataatgcacatgattggtggttatgctaaatgcccaagccagtggttacatgactggctgcctttttaatgtcaaagctcttgagtccagtggaaacaatgacactgtcccaggttgagaccgagttggtccctggaaagttacagtgatgctatagtttctctgggagcacaggcaatggggcaaaggagaaatggtttctagagagttcattcctttaagagattgagaaatagactaggaggatctcagttccctaatgtaatcttggtgctgctggcctagtgcatgctcaagctgggttctctcagaacctagcacaagactggttagcctgtacattccctggcaatacttactgattaatctgtggatgcattctgggggaggctagaatgttctaggacaatctcagatagttaagtagacctaataattccttgttgcctacactaaacttctttcctcttaacagaatcagcacttcttgaaggagactcctggaagcaaccagatcattccgtcaccttcagccacatcagaacttgacaataaaacccacagtgagaatttgaaacaggtgctttttatctctggcttaactccctgtgaccacagtgcactgcagaggcagccaaatagtttgggcttagtgtttggtgtctcagcaggtgcatcctgtatttatttgcctgcctgggagctgagcagagaggaatgtgtgttggtatctcggggatccatattgctgtcctttcccttctttggcactttgcagtttttccctgcatgtcagtcagtggagtaaattccttttcttatcttgaaagacatagaatgagcagattatcctgaaactctttatgaaaaaatagctatctgggcaggttaaagatgaatggatagctaagtaatccagagtgatggctattttgagccacagtaaattctaagaatgttagaaagcatatccttgaaaatcaggattttctaaagtctaaagacgaaaaggcaagagggggaaaaaagactttgagttcagaatcacattaaagagaatagaggaaatcttcactcagaagaattcctgtcctgagtttaatgccctttaaaacctatagttatcattctttttaaagtagcaatcagtactggaggatgtcagtaaaaataattgaatcttatactaaacaatgcactacttgttatggtattgttacatgagccaattcagtaatcggtattgttcctgaggtaggtttgttctgacaaattaggttaatggacctttcatttaataacccagcaagcctttcctccagcaggtgaggtaaacattggggaaatcaattcccaagctctcagctttctgggaccaaagagtgaatcatgtaggtagtcctcttccctctttccccctcctgtctagctgaggccaaacaattccaaaaggagcaatttagagtgcgagggacaaagcaaagacagacgattgatggtcaaaaccaggaaaaggagtttacttcagtacttgacatagtaatggttgttcggtgctgctggcctgcttgtctaatttacgtctttagtggattccataactttatttatttccactctaggatatcctgtaccttcacaactctttagaggaggtaaacagtgccctagtggggtaccagagacagaatgatcttaaactcgagggaatgaacgagacagtcagtaatcttacccagagagtcaacctgatagaaagcgatgtggttgctatgagcaaggtagaaaagaaagcaaacctgtccttcagcatggtaagccttttctgatcttttgtgacatgcagtgtgttttgtctgtgcatggataacattctaccaccttttgagaacagccttctggcatatttgagaggccacacatttgtgttgtgcttaatcctcacaatgtgttgtctcatttaatcctcacactagctgtgtgatgtgaatggccaggcagtgtttgtcctgatttggagagggagatgcggagaggtcgagtcgcttaccaaggcctcaccactagttgttggcagagatgacaaggctactgtcatgttaccagtgcgccatctggtagggaagtgctggcacgtatttccgagggccttttgggtcttttcttttttaagttattaggggtgggagccatgaaaatgatagtaaccaaaaatcttttatcatttctttaagcctgaacttggctttcatatttatcctgctgtctatatattaaggggaaccttttgcgtatgtcaggaaacagatcaggtcagatcagctccccaacttaagaggtcattgagttcacctcctcattttacatgtaaggaaactgacctactaagtcactgatgctggccgactgtgcacggcttactgattttcatattgttgtgaataaaatgtgcagtttcacataaactttgtgcagggatccacatggattctttttttaataactgcagcccccacccttaaagatttcatatagcaaagacacaggcatatatttaaaaatagaaaccaaatacaggaaattgtgccataaattcaagtaaccaccaaagctggaagtaagcccacaaataaagtcaaactctggttcatggaaagcagcatttgaactggctctgccacagtggagccttggcaagttgcctggacttggctttgaagggtggagttggaagacctgttccccctcctgctttacagagttgtataatttactacaaagctgtgaagattaaaggagctttattttacgaagcccttttgaactcagctaaactaggttggctaagaattttggatgatgagtattatgccttgaaagttttcaaggcttattgtgaaaacttaccactcctaaactctctttactgtctctgccctctccccctactttatatttctccagcagagaaaataggtaatagtatccatctgtcctactgtttcttagagcagtatcgtgctcagcatggtattttgagtaaaagttctaccaccttttatccttcaaagccttaaagtttgtgactgaaacagctagaagcactagtttcaacttcgtctctggcctttctccctctctcctcccatctcccactcctctgcaatttctgttgagagtgttctgagatcctttaaataagtttgacgaatttgtttaaaagtgctaggtgttcaagttttaatgtttgcctttaatcttccctttgtttgtttgtttttgttttgccctttaagatgggtgatagatctgccactctgaaaagacagtctttggatcaagtcaccaacagaacagatacagtaaaaatccaaagcataaaggtaaataatgggaggcttaccctgaagtaaaagtaaatgcagcagcatctctgtgcttttgatctactgctactttttcaaagggcgtacttttgttctcatgtgctgaaacttcaaaacaaagcaattagtaaattagtatgttagtgaataaatgaatacttttttaggcacctaccctgtgccaaacactttagtaggagctggggggaccatagtgagcaaggcagacatgtgacccctattgtggtggagctcaaagtcctgtcagtcagaaaatcgttaacacataattgaacaggtcatgaatcatgagtatgataagtattataaaggacaaatacaggatatgataagatcaagaaggcttccctaaggaaatgacttttacactaagacagtaagttatctgtactaatgatgggggacagaggcagagataatctaaaaatggtgtctaatctaaaatttatttcctatttttgtattgcaatctctatgtattcatagtccatttaaacctcagccagttcccttcaccttgtaccttccccttttttgttcttcctagacatactgtcaagacagcaatctatgatatgctttgatattccaggaaagaaagtgtgattacagtattctctgattagagtgttaaactctgggctaagataaaagaaaagccaggaagattatgaccaagtgactaaattaccatctcaaatgcatattatgtttgagaagttgggaggatctgaggttcagagaaaatgaacttgaactggaaccacacagtaaaggcagcttttgatgtaatgctttatatctttatttttcctaccttaatagttttatattatctagataaagtcacaatatattaaggttttaatgcatcataagctaagcttttgttgagttttctaactgcttctgcagattttttttaaacctcacctagagaagacagaaaaacttaagagccagatgtaaattttgagcacaaaaaaactaataggtggtttctattagaaagtagtagcaatttcagccacagttcacattttaacaataaatatcagaacacaccagtacacatgtatacataaatttcatcttggctttactttcaggccttttttgtttttaactgtcatcgcagggtatcagttcctttgtcctacctcatccaaacatcctaaccagatacaatttctccttaccattagttcttcaaacatttagtacctagttttcactacatatgttcatattttagctccctaaataaactgagtgaactactatacagtaactattagagtagaaataagatggggcaagagaagttaacaattacttatacaagaaaagtaaatcaataataaaataaatgtgtaatgagttggtgttctaattaaacataggatcaggacctttcacactcatctaagcagttagaaatgagcctcatagaaaccagatgtctctctttttataattaaatgtatttgtatatgccactcttgatactcctgggaatgaggcagggtatgggcgaaaaaacttttttaaaagatacgagcaagcaagactttgaattagaaatattacagctccttctttatgtcttaacagtttctgccaccagttgactcatcaccagggagaaacagaggaaagatcaggggaaaacttgtggtttgtttttgttcagttgcttctttttgtaaggtggtaagagcatgaaattctgcctaaagtggtctagtcacaaggtgaagcaagatatttcggaaagttatttagttagtgtgaaatagctcctagaaaacaagatcctgcttatttaggaaatgggtgtcgcataggcacctgagcaagggtacatttcctttactgctgacacatgcattccttcccccatcaaccaaatgttcacagtgaatcagatcatctgtagcataatgttcccttaatggtttcaaatccagcaagatacttatcagtgctgaggaccaaagacatcaccagtatatgttgattcattcttttattgtctttatagggaacctactgagggtcaaacactacatgctaaacaggctctgggaatacagtggacacttagatgaagtcttactaccaccttaaaccttctataatctttgttttgtgcagaaagaagatagttcaaattctcaggtatccaagctaagagagaaactccagctgatcagtgctcttacaaacaaacctgagagcaacaggcctccagagaccgccgatgaaggtgagagcagagccggcttcttaatatttcatggaggcttgagcagcttgcctctcacatggggagcagggaaggtgttccagcagtactgatcgcaccaagcgagtgatgcctgaacgcaccgagatgaagctgatacactttgctttcatttagaaaaggcccattttgtacatgatttgtactctagtctattaagggaagaattggtaatgtttagctggaaatagaattctccatgctgtctgcatccaattataggcaaaaatgttactgtcatagagtatattaagccagccctaaaagttgtttatgagagtcttttcctttctgtaagtgcataacatgtatttaaaaataaatattcgcccttctgaaaatcgttaacaaaaataatgatgggatctttgggttggaagggtctttggctttaggtatggacctgtctaatcaatattagcagatacatgagcctccactgatttagaccctgtgaggacataaccaaggcactggactgtgttagctttgaccttttcccccacacaagtatttttctattttagaaaagcagtacaaactctcttgaattctcctttagtaggagacagaactgtggtggaatgtcttgtcctaacattgtgctacatcatcttacggttgcactcttagcaccagcttagcgggtggcacatacccctagactgggtttaaagcacatctcccaggatgtcaagatctttgatatccagccactgttcttgccacttgacagcttaagctcttaccatctaaacatgtttaatgctagcttgtactgtaagatcttctaatgggactgctgctgcaaaccttaacgtaatataatactgattggtgttcccttgcccacaaatatgtctcaatccaagcctttaacttcacatagtcactatgctactttatcttcaaatgtttctctaaattaattgtatatccaattttcctaaaaggtgaccttcgatactagtttaatttggtgttagattcaataatactaaataaaaccttatgtatttgttacagagcaagtagagagtttcacatcaaagccatcagcattgccaaaattttcacagtttcttggagacccagttgagaaagctgcccaactaagacctatctccctaccaggagtttctagcactgaaggtaaatttttataccacggggtagtaatgggaatgttcaaagtaataactttttaatgtttattttcacttgtcaaaaatatatatgatctaacatttattgaggagatatcaagtgccagatactttatatgcattatgtcatataatcctgataaccatcccatgaacataagtatttatgtattatacccattttactgatagggaaactgcctaagtccacacagcaaataattggttgaaacagaatgcaaaccaagacagtctgatgccaaagcttgtgctttttttttagacccccaggctggagtgcagtggcacaatctgggctcacagcaacctctgcctcccagggttaagcaattctcatgcctcagcctcccaagtagctgggacaggtgtgtgccaccatgcctggctaattttttgtatttttagtaaagatagggtttcaccatgttggccaggctggtcttgaactcctgacctcaagtgacccacctgcctcagcctactgaagtgctgggattacaagcacaaaccaactcacctggccgaagcttgcacttttaaccagtgtactatattatctttctgttaatgttttttagggtcttcattcactgagtgcctcattaaacctagtgctaagcaataagaatacagtataagatatggtctcattttctttcttcaaggatattacagtctaatggagaaggcataaaagcaaatacaataccatgagattagtaaaataaagtaaaagttgaccctgtttgtcagggccctccaaaaatgaaggacccttttactgaaaatcagcaaaatattagtacaaaggatatgattcacagaaaaatgtgtttgcactgcttccagcagtgcatgttctatccctcatggtgatgtttagtgcctcccgattttgtattagctggctgcctggcaaatcacttgctcctgtccaccacaccttcctctggctcttctctttagcctagataccattctaccaggaacatttccttacctccagtgactggattaggctcctcctgtgtgctcttaaattttgtttgcccctgtttagcacatgtcactctgttggaatttcctggggagatacaaaatataacttcctatgggtaaggactatgtcttgtttactcccagcccctagcacagtacctggtactcctgaatatttgttaaataaatgaatgagttacctacacattgcaattaaatgcttaaagcatagaagacttaaatttttctatcaccatttaaatgtgattacttttcttccctgttcctgactttttttttttctgttttctggggaggaggggaagtgttgtgtttaatgggaacacaagcttcctgccactttccattgttaaatcaatatttgatgagaatgaatgggggaaagctattaggtcagagtaaggaatagcagtcttaacacttgtgcttcagtcctcagcataggccttaaatacttttggatgactatacttttggaatgacctgaggcagcaatcatatttttatttgaatactgctaccaagtgcgtagtgtagcatgttgtataaactcatgccacaaaaaaaaagaaaaaaaaaaacagaactcttcagctagccacttggtgtaaggcattgggaacaagtgtcccactgctttcctgcctttcagagagcttttgacattttattagctgcattgctgcacctattgtaggagtgagagtagggccctattcaggagcttgtttataggagctccttgatggactggaccttgcactgcaactgttttccctcccttcaagctatttttattcttcctgaataccaaacatcaagaggcctattttacctaggtatggtgtggaataaatgatgaaattaaaggagtttgggaagatttttaaagaaacataaagctcattgaccttctttggtattagatattaaatcttctatttgattatggggacacaagtattttttaaatgttatgtatatacggccaggtgcagtggctcatgcctgtaatcccagcattttgggaggccaaggcaggcagatggcttgagctcaggagttcgagaccagcctgggcaacacagtgaaatcccaactctacaaaaaatacaaaaattagccaggcgtggtagcgcacaccctgtaatcccagctactcgggagaatagcctgagcctaaaagtttgaggctacagtgagctgtgatcatgccactgcactctaacctgggtgacagagggagaccctgtctcaaaaaaaaaaaaaaagttatgtatataactgaccttcctaagtgtttgtgatgaggcccttgagaaaatgccagaagaaactattgatagacattctctaatcattttggctcaatattgccattgaaataaaaaagatacagatcaactggtaatattgctctttttctttttactgatttttaaaaagtagagagcatgcactttggagagataattcctctggttcttttttattgaaatacaattcacataccataacattcacctttttaaaatgcagtgtttttaatccagtgttttttagtgtattcacaaggtcatgcaaccatcaccactatctaattccagaacattttcatcacccctcacagaatctctgtacccattaaacagtcactcccagtcccctctcctgccagtctccagcaaccactagtctcttaatcactatctctatggatttgcctatttggggtgtttcacataaatggaatcatacagtatgtggccttgtgtgtgctttttctttcaatatgattctttcacttagcataatgtttttatggtctattcatgttggagcatgtatcagtacttcgttcctttttatggctgaataatattccattctgttgacctaacacattttggtctgttcatccgttgatggacatttcgattgttctcacttttgggctattaagagtaatgctgccatgaacattcatgtgcaagtttttatgtaaacatatgttttcatttgccttgagtatatatatacctaggaatggaattaatgggtcatatgatagccctaactttttgaggaactcctacacttttccagagtggctgtaccatgttacattcccatcagcaatgtgtgagggttcaatccactttctccacatcctccctaatgcttggtaaggcctgtctttttttattatagccatcgtagtgattatgacatggtatctcattacacttttgagtcactggttcttgagctgcttaatttctggatccagagagacaagtgtcacatagtagaaagagcactggactaggtaataagaaatttgtattctaggccaggtgtggtgtcctagcactttggggaggctgaggtgggcagatcatttgaggctaggagttagagacctggccgacatgatgaaaccgcatctctactaaaaatacaaaaattagccaggcctggtgatacacacctgtcatgccagctactaaggaggctgaggcaggagaatagcttgaacctaggaggcagaggttgcagtgagccaagatcataccactgcactccagcctgggtgacagagtaagactccaccaaaaaaaaaaaaaaaaaaaaaaaaaaaaaaacaggcgtggtggttcacgcctataatcccaccactctgggaggcccaggtgggcgaatcacctgaggtcaggagttcaaggccagcctggccaacatggtgaaaccccatctttactaaacattaaaaaaaattagctgggcgtgggggcgggcccctgtaatcccagctacgcaggaggctgaagcacaaaaatcacttaaacccaggaggcaaaggttgcagtgaaccaaaatcgccccactgcactccagcgtgggcgacagagtgagacttagcttcaaaaaaaagaaaagaaatttgtattgtattccacttaagagttacatgaccgtaggcaagttactttcctctttgagctttggatttcctgtcaaaactgagaaagctatgagtgtttgggattgttttatgggcttccaagtcattcctccagtctccactcagccatccaacaagaaatctcacaatatgccacagtctgttttatgagctagctcctatcacataactcattaggcctctgcattccttttcaccccttcaacataagaataaattcaggaaaatctaaagggaagacgctggacagagagaagatgagaccattcattctcctgcgattatctgtcactgcttctactttggcagtgtctcactgtgttgcccaggctggtctcaaattcctggcctcaagcaatcctcctgcctcagcctcccagagtgttgggattataggcataagccactgcacccagccttttttttttttttttttttaatatatttttaagggatcaaaaattagtcttcctgatttagtgaaatcctaaactttaccatttggaaacaaaatttgcggagtagcttttcttttagtgttttaaattcagttgagactacttttaactaaatttagctgtatgtttagacgtatacattttttgtaattcatttttgacagatcttcaggatttattccgcaagactggccaggacgtggatgggaagctgacctaccaggaaatctggacctccctaggttctgctatgccagaaccagagagcttgagagcatttgattccgatggagatggaagatactcattcctggagctaagggtagctttaggtatctagcttcatcaggcatattttagaaatggactgcctaatatctatttacctaacaacaaaacaacccttacttacccatcagtcctctagtcctccaaactactgtagcagatactttgccaccttttaacttgtttgaagaagctatataaaagttatttttttaaagaagaagaccattttacttatgatgttcagaaatctatgatttcctacaaccagtaagatcttacattttaaaattgccagaaaaaaaattaaagccctctttttttctctttcctttttttgaggggaggagaccttatcttttaaagctgggaaatgtatatagagagagaataagccacttttatatttcacttaaatttgccttaaattagctgcactttatagagactcagaaaatgtcttttctttaaaagataggccttttctgtttgtaaatatttaaatgaaagaaagcattgtgcatattgtgtggaaagtaggaagaatggttttgaacaggatatgaacaaatgacttattaaaaattgctgatctggtgtaggtggcagctgaaactacatccatgtctccataaggtatccctcaaaggcccaggcgctgccagggggtttgtcctggtagctggaggaaccgatttcagggagtagacactggagacaatactgactccaggcatggctcatggaagtaggattctggttctttgttcctattccctcagctaatcccaacctgggaatcagagaagtcttggggatttttctcatttttagtactatttcagggtttatgagcataaaaagttatccattggggagctccattttccctgctgagtgagctagattgccttccccacccacccacttaagtctgtcttaaagccgtagctggctcccaccaccagtaccatctccatttgaatggcagggctaaattcccccagccattatctcacactgaccacccagagctttagaagagagctgtgcttctaattttgacccagaaaaccataccccttgagattttacctagaggctaaccaagagcctaatatgtttctctgggggatgactaaagccaaaaaggctgtgagatgaaacatgtgaaataatattcagtttccttaccattaccagctcagaagtagctagaggctttctacccaaaggatgccaaagtatagcagggcaggcctggagctagggccttcacatggtggtagcaagtttttcaaatctaatacaatcaagtacaatacttcctttaaatgcttctgtggacctggcatgaaagatccctagattgaaaggaataatacctccatgtctcctgtatgttgagtctagaattgctgtgttgttcttagaagcagtctttgggcaacaacttgaaaggggaaaaaaaaactacaaaaacttaactttggtataggccaagtcagggagaaagtagagaaagctgtcatgccacagacttctttagtggagatcatttcctttttaactttgttcaggttgcccttcaccatggatacagtccggtacccttaaacatttaagggctgttttttttttctttacatgatgttcagcttggtattaaccaaacttaaattttttttccagaagtattaaaatttagttaaagcaagatgaagtcttttcccatgaatgtgtccccttatctcattatagcttatgctcagtttcactttcttggaaaggttaaaacaaattagcctggcactttaggtaacttgaaaataactctcacccttctgactgccttccatccactctcaccccacacctttttttaatatatatacacccttacagattttctaacaaccaaataaaattctagcaataaattgaattatactgctatatttgtatatactgtaccataaatagtatgtctgtacctggaaggtatttttttgagaactgatttatatgaaatatacttgagggtaatgtagcttgtcctttttagtttcaaattcttattcataggcagatactttgaagacaccttaactctttgttgtgtgtattttcccttgcatcagataactatacatggagaaatccattttgttttttggtttatcttctgttcttcctaccttgtgcttgtctgactagtatcacccctgagccagtatacagtaccatcctctccccctaccaagtttggcagaggtgtttatactgcattctcagatctatgaatatttttgtcatcctgcctgagaaagtacatcttccaggcaaaagtagggtatcttgaactcctttcttctgagttgagcagactcactggcttaagcatcccataagcctattatttagtgtgaatttgggacttttatttgtatgttgtcttaacttactaagcctgtgacttgtatttagctgtagtcaagcctcaccagccatatctcatctctgagaggaagactggatagtgagtttggttttggttttggttttaaacccttttaccttttcagtctggcagctcctactgctgctttcctaagttactcaaagcactgcttcttggtccttgttttcttttgccttgtactatcttgtataatgtttactaaaagagcctccccataaatcagagaggcaaaaaggtagcatataaaaagaagaaccaaaagaagagaaaacctgacttctagatgactgtggtgtcatctaaaaggcagaggtgcctgaccctcaggaatgtgtatgatgcaacagagctgaagaatgggttcccttcacctactgctggccattgtcccttctgttggagattcctttctttatggttgctgttcataaccccttcaacacccccccttgctggtcctgccggtcacagttgaggattttggctgtgatgggctcatactcataatggcctgttgagttgtttttagtgacaggttttgtttgctgcacacctcattggcttgcttaccaacaccagctagaagtggtccctctttcatatccaaaccagaacacatttgggtattcctgagactttatagagcgtgtattgtttgttatacgaacctaacctaccttgttgttttctcatattaagaaatttaaatctactttgttttagtgaagctattttggtaatgtataagcaattttggttctgtttagggagaattcagggtttccatgacttgatttgagctttgcatatttcaaataagtaacacagccattttaatttagctaaataaaaaaatttcttttttctctcaa

SEQ ID NO: 11388 - DNA, 1754 bp, Homo sapiens
cttttttttttttcttttaatgtttcatagcatgacatccaggtgggtcctgacctctgtcaataccaccttcctgaggttagttccatttcctactctgcacctgattcctgcagctcccaccttcagtgagaggaggctacagttctgaaggaaaaggcttggcattgaagctatggtcttcctgggccagattcaggagggaatggaagagaacattcctttcaggacaggtggccaaaggataggagacagagtggttcagcagggggggtaggttgcacaagggtggggcaaagggcacctcctgaaagatgggaagtgggaatggggatctggcctggggctgctgtggagccagctgcagtgcaggttgcaggggagcaggggcttccgccttggggttgctgtcttggtcagcatggctcctgccttcggggatgtccaaatcccacagaacatctggattctggacctcagtctcagtcttggtgacagcaggggcagggcccgtgttgatggctgcattcatgccgtagcgccgtcgcttgttaatccagtacaacaatgggctgtaggtgaatgtggcagctctcatcacctccacccactgctgggcatgctcttcccgcctcaagttcttcctccagtgcagaaagataatgcaccctccagttatcacagaacacagccccaggattccaaagtacaatgagacccacactaaggcagcaagaaagaaaaagaggcatgctggctgatagctgtagcttggggcctgagctgtttctcattcctctttcacttaacccatgcatcaatcgctccatccacttaactactctcaccgttccttccctcccttattgacttgcctcatcattcccttattcagtcaaagctagatttccagggagcttaagcaccacctttaactctttacagatcacaaaagctaggtctagcgggggcatgtgctgcccaggctcagtcaagcctctgattcctaacccaggacccatccaatccatcagactgagaagtttcactatgggcaagtccatcaagaagcaaaagttcaccagcactttgtgaggcccaggtgggcagatcacttgaggtcaggacttcaagtccagcctggccaacatggtgaaaccccgtctctactaaaaattttaaaattagccaggtgtggtggtgcatgcctgcagtcccagctacttcagaggctgaggcaggagaatcacttgaatccaggaggtggaggttacagtgagcctagattgagccactgcactccagccggggcaacagagcaaaacttcatctcaaaaaaaaaaaaaaaagtgaaagttcatcagttgacagagacaccaatgtcccatcccattccattcagctgtgatagtcctgggctattgatagtatcttctctggttgatcagagcatggtctttgccttaaaataattcttagttttctagagtagactatctcctaactgcttagctctcctccaggcagccaggcactgtcccatccatgcaaagggccttccctgagtgtttgtccccaagccctaaggcacaagtccagtgacagggactggaggagcacttactcccagggaagcgcaggtcctcctgttgggaatccatacagctgagctttggtacctggccgatggctctggggagagggaactcacccacccatctgcccagccagtcagcccatctgcccagccaatc

SEQ ID NO: 11389 - DNA, 6994 bp, Homo sapiens
ggcaatggtggcttgctatccgggaaatggaacaggttatgttcgccacgtggacaaccccaacggtgatggtcgctgcatcacctgcatctactatctgaacaagaattgggatgccaaggtacttttgaataatgggagtagagtgtggggttagaaactacaggaaaatgattcagataacttagaggagagtttatattgagttcatagttgccgtatctcccactgatgaaacatttctatttccatttcataacctcctgcgacaatggaattagtcctaaagttgttaagaagaaaacaatgaagttaatttggagtggggtaggtagggtgattattaaccctacctctgggaagggtggttgatgaagggaaggtaatttgatattaggattaaggattaatttttttcagtttaattcagagttgttctgactcaatgcagaataggatatacacttttccctcccagcagcagcattgagaaagttccacaaaaatagaactgtaggctataaaaccatccccaagagagatttcccacacagtcctctccctcggggtggtatgtctcattgatggctgcttgccatggcttactatggtttgtgaatgccaaaggctttgtggcttatttttgtattatagaacttatagatagatggagatatgaagcctggttccatgcttacagacattcatctggactctgtatgctttccgaaagttaagaatgatttaggagtctgggaagtcagataacttttcaagcttatttggcttttgaaccttctgcatctcaatttcctgttcattaggcaaatactggctgtcataaagcaataatatttatccagagtcagaaaaacgaaacttgggaaaccattgaatcagtgaaaaggcctatctcttctccctgtttggtaacatgactggaatacatccattaagtctcctttaaaatcttgagaggtgctgatagagacaagagaataaagttatcagactggtaataataaattgcaaggtctggaatcatttaacaaatatttgagttcctgctagtgtcaggcgttgtattatgaagaaacattgatgtgtgaggcctgaactttactctgaatatggttattctagtaggatgaaataggttgacatgtaaaaaaaataattcaaggaagagagtggtgtatgtcataaaaggtgcagattaggtggtctgagagttcagtaaaaagagcatgtaacttccaactaatgaggtcagataggagctaagggagttcagaagagctgtaaattctaattgaaggggaagttacatgtgatgattttcttagaaagttgttaatggttagatggaaccatgtgagatcactgggcatttttttttaagtcaaaaacactcaaatattggcaaatcggtatgattcaatctaatagtactctattttacgtccatgggctttatgactgtggggggtgggagtgctttttttggtttaaggtgaataaggagatatctctagctaagtttgatataaaatttggtacgaagtggctgggcgtggtggctcatgcctataatcccagcacttcaggaggccctagtgggcggatcacctgaggtcgggagttcgagaccagcctgaccaacatggggaaaccccgtctctactaaaaatacaaaattaactgggcatggtggtgcatgcctctaatcccagctactcgggaggctgaggcaagagaatcacttgaaccagggaggtggaagtggcagtgaaacgagatcgtgccattgcactccagcctgggcaacaagagtgaaactccatctcaaattggtacaaactatgaggttgaagtaaaaatctggggtaccatgcatttggagtggtggttagcagatggcatgtttctaaatggagctgaaatatggttgttgataaactacatgagaggtaagaaataatcccccttctttgtgtctttcagctacatggtgggatcctgcggatatttccagaggggaaatcattcatagcagatgtggagcccatttttgacagactcctgttcttctggtcagatcgtaggaacccacacgaagtgcagccctcttacgcaaccaggtaatagccggagccatgattcctcttccggagcttggtgtacaaaccctagttccagagaactctttaaacgtgtgtcctgtgcatgtgggggattgaccacaccccatagctgatagcaaacttgtttggagtctacaaaaattaaaggggaaactttgcgttctttagcatatcaaacctaacctcagtttgaaagtactattaacaagttgttttctattagatgagcatattggattccaatttctcaaaagtatttttctcttctctcctttcctcccttctcttatctctctttccctttttttaaaaaacctaatgttgaactatgcctagagaatgttggctgtcacatatcaggaattctgtctggttactttggatgagtttacaagctgctaattgcaagcagagaaagagccttgagaagagaaagagtaatttgttttgactttctctttttgtcttttccttggtttgaaattggcttgggcttgctgtatccatggtccaacagttggatgttttattaatcttttctttatcatgtgcacatgaagattctcagagtaactgaacaccttagtattgtttaggaccaatctagacaatcttgacaaaaaatcttcattctcaattctgcctctcatttacctttgtctgtgtctaaagcaataagccgggcagcattggagggctatggagtgcagcttatactgagactagcattcaggggcaggaggagagaattttggtaggatgatgattaaaccctaacaagcctaattaaattaagatcacatgtgccctcctccggaagtcacacagcttagccccaaacccagttatatattaactgccaaatcggaatgtcttctagatgagcagggaacgaattctaccactgaagtcagcttttgtgttttatggggtatgtaactaaaccctgttgtttgtggcagaagtctttggttattccccaatctcatgatgactggccttacagggaaaacattagcaaatgttgatgagaagtcccttgaaaaaaactcaagtgctatagaaattgttagctacggaagtagctaacaatcattacaaaatgaaactttaaaaaaaaaccaagcatgaaatggctcccattacagtctatccaatgaatgggataaagcaaattagtggggatgcagtagaaagctctggggcattattattattcaattgcaattttgcctcaatgtccaaaactaaagaaagcaagccaagagttttaaacatactgtgatttacataagtcgtttttcaaagcttcactcaaatgtcatctcttctctatgttctcgccaccaacttgggtctcccagtctttagcagaatgactcccttctagtcctttctgtagaggctatgtttacctgttgcattattgcaaaatcacctgtctcccctacttggagcctgagatcgcagaggaagatctgatcacagggtcatttgaattcctaatgcccaagataatttctggcacatacctggaattccttatgcattttattacattgaaatagaattaaaaccagagaagttaattttaaattaaaatcagcgtagacaggccgggcatggtggctcacacctgcaatcccagcactttgggaggccgaggtgggcaggtcaagagatcgagaccatcctggccaacatggtgaaaccccatctctactaaaaatttaaaaattagctgggtgtggtagcgtgcacctgtagtcccagctacttgggaagctgaggcaggagaatcgcttgaacctgggaagtggaggttgcagtgagccgagatcacgcctctgcctggcaacagagcaagactccatctcaaaaaataaataaataaataaataaataaataaataaataatcagggtagacttctaataatagagaaaactttaaaacttttaatgtgagatttataggacatttgtgtttctagtagtaccattaaatctctttccttatatctgcttatctttcacagatatgctatgactgtctggtactttgatgctgaagaaagggcagaagccaaaaagaaattcaggaatttaactagtatgtgtttgataattttctgtgacttttgatcaagttaatccttgacttttattcaattttatgtagttttaaacatgttctgttcaatctgttacggcttagctttatatataatgacatcttgatgggttttatcctgaaaccttggccttagggctcttagaaaaatcagaaacaatgcaaggggcttcccctgagaatgcccactgaatgtatgatggtttatgatagatgggaaatagttaactttttcctattaatgttaaccagtcaaatgtaacattaaattttgcccatgatttttggcatattgcaaaggaaatataatggaacccagttatgatggcaaaatttattatattgggtgagactgtgactctcagtataacagcagggctcatgtaatataaactgaatataacagcactactcctatcccttccaaccagtattagaaggcagcatttcccaaaatacgttgcattaaaacacaaatcctgccaatttggtaaattcctggtcccaaaaatgtgggaaatgttgcatgctgtatgcctgtcttaaaaagagtcacattgctcactagcatattaaattaaggcgctaagagatcctgcagtaaggaaacatatataatattgcctagcccataacccatttggactgtatacctctcaaataccaaagtggtctccaaattgcacccaggaaatctcagtttgttttctcttccagatggcctacactgcttaactctgatatgtgagtgaggctacacttcatacaacttatgctcagcattagcccaagaggtgccaatgctggatgtaaacccaaagttcctccacagtctgtgaggcatatgggaaagatcccattgcaaagtcaagagagaatcctttggcagagctctattaggaggcttatataagatgggaagtgtttactggaggctttttggtgacatttgtgacataaaactcatcagagctgactccataccctctttattctcctttctgtccccaacccagggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttacttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagccccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtgggtgttcctgttttttttttttttttttttttagttttcctttttaatgagctcaccctttaacacaaaaaaagcaaggtgatgtattttaaaaaaggaagtggaaataaaaaaatctcaaagctatttgagttctcgtctgtccctagcagtctttcttcagctcacttggctctctagatccactgtggttggcagtatgaccagaatcatggaatttgctagaactgtggaagcttctactcctgcagtaagcacagatcgcactgcctcaataacttggtattgagcacgtattttgcaaaagctacttttcctagttttcagtattactttcatgttttaaaaatccctttaatttcttgcttgaaaatcccatgaacattaaagagccagaaatattttcctttgttatgtacggatatatatatatatagtcttccaagatagaagtttactttttcctcttctggttttggaaaatttccagataagacatgtcaccattaattctcaacgactgctctattttgttgtacggtaatagttatcaccttctaaattactatgtaatttattcacttattatgtttattgtcttgtatcctttctctggagtgtaagcacaatgaagacaggaattttgtatatttttaaccaatgcaacatactctcagcacctaaaatagtgccgggaacatagtaagggctcagtaaatacttgttgaataaactcagtctcctacattagc

SEQ ID NO: 11390 - DNA, 7005 bp, Homo sapiens
ggcaatggtggcttgctatccgggaaatggaacaggttatgttcgccacgtggacaaccccaacggtgatggtcgctgcatcacctgcatctactatctgaacaagaattgggatgccaaggtacttttgaataatgggagtagagtgtggggttagaaactacaggaaaatgattcagataacttagaggagagtttatattgagttcatagttgccgtatctcccactgatgaaacatttctatttccatttcataacctcctgcgacaatggaattagtcctaaagttgttaagaagaaaacaatgaagttaatttggagcggggtaggtagggtgattattaaccctacctctgggaagggtggttgatgaagggaaggtaatttgatattaggattaaggattaatttttttcagtttaattcagagttgttctgactcaatgcagaataggatatacacttttccctcccagcagcagcattgagaaagttccacaaaaatagaactgtaggctataaaaccatccccaagagagatttcccacacagtcctctccctcggggtggtatgtctcattgatggctgcttgccatggcttactatggtttgtgaatgccaaaggctttgtggcttatttttgtattatagaacttatagatagatggagatatgaagcctggttccatgcttacagacattcatctggactctgtatgctttccgaaagttaagaatgatttaggagtctgggaagtcagataacttttcaagcttatttggcttttgaaccttctgcatctcaatttcctgttcattaggcaaatactggctgtcataaagcaataatatttatccagagtcagaaaaacgaaacttgggaaaccattgaatcagtgaaaaggcctatctcttctccctgtttggtaacatgactggaatacatccattaagtctcctttaaaatcttgagaggtgctgatagagacaagagaataaagttatcagactggtaataataaattgcaaggtctggaatcatttaacaaatatttgagttcctgctagtgtcaggcgttgtattatgaagaaacattgatgtgtgaggcctgaactttactctgaatatggttattctagtaggatgaaataggttgacatgtaaaaaaaataattcaaggaagagagtggtgtatgtcataaaaggtgcagattaggtggtctgagagttcagtaaaaagagcatgtaacttccaactaatgaggtcagataggagctaagggagttcagaagagctgtaaattctaattgaaggggaagttacatgtgatgattttcttagaaagttgttaatggttagatggaaccatgtgagatcactgggcatttttttttaagtcaaaaacactcaaatattggcaaatcggtatgattcaatctaatagtactctattttacgtccatgggctttatgactgtggggggtgggagtgctttttttggtttaaggtgaataaggagatatctctagctaagtttgatataaaatttggtacgaagtggctgggcgtggtggctcatgcctataatcccagcacttcaggaggccctagtgggcggatcacctgaggtcgggagttcgagaccagcctgaccaacatggggaaaccccgtctctactaaaaatacaaaattaactgggcatggtggtgcatgcctctaatcccagctactcgggaggctgaggcaagagaatcacttgaaccagggaggtggaagtggcagtgaaacgagatggtgccattgcactccagcctgggcaacaagagtgaaactccatctcaaattggtacaaactatgaggttgaagtaaaaatctggggtaccatgcatttggagtggtggttagcagatggcatgtttctaaatggagctgaaatatggttgttgataaactacatgagaggtaagaaataatcccccttctttgtgtctttcagctacatggtgggatcctgcggatatttccagaggggaaatcattcatagcagatgtggagcccatttttgacagactcctgttcttctggtcagatcgtaggaacccacacgaagtgcagccctcttacgcaaccaggtaatagccggagccatgattcctcttccggagcttggtgtacaaaccctagttccagagaactctttaaacgtgtgtcctgtgcatgtgggggattgaccacaccccatagctgatagcaaacttgtttggagtctacaaaaattaaaggggaaactttgcgttctttagcatatcaaagctaacctcagtttgaaagtactgttaacaagttgttttctattagatgagcatattggattccaatttctcaaaagtatttttctcttctctcctttcctcccttctcttatctctctttccctttttttaaaaaacctaatgttgaactatgcctagagaatgttggctgtcacatatcaggaattctgtctggttactttggatgagtttacaagctgctaattgcaagcagagaaagagccttgagaagagaaagagtaatttgttttgactttctctttttgtcttttccttggtttgaaattggcttgggcttgctgtatccatggtccaacagttggatgttttattaatcttttctttatcatgtgcacatgaagattctcagagtaactgaacaccttagtattgtttaggaccaatctagacaatcttgaccaaaaatcttcattctcaattctgcctctcatttacctttgtctgtgtctaaagcaataagccgggcagcattggagggctatggagtgcagcttatactgagactagcattcaggggcaggaggagagaattttggtaggatgatgattaaaccctaacaagcctaattaaattaagatcacatgtgccctcctccggaagtcacacagcttagccccaaacccagttatatattaactgccaaatcggaatgtcttctagatgagcagggaacgaattctaccactgaagtcagcttttgtgttttatggggtatgtaactaaaccctgttgtttgtggcagaagtctttggttattccccaatctcatgatgactggccttacagggaaaacattagcaaatgttgatgagaagtcccttgaaaaaaactcaagtgctatagaaattgttagctacggaagtagctaacaatcattacaaaatgaaactttaaaaaaaaaccaagcatgaaatggctcccattacagtctatccaatgaatgggataaagcaaattagtggggatgcagtagaaagctctggggcattattattattcaattgcaattttgcctcaatgtccaaaactaaagaaagcaagccaagagttttaaacatactgtgatttacataagtcgtttttcaaagcttcactcaaatgtcatctcttctctatgttctcgccaccaacttgggtctcccagtctttagcagaatgactcccttctagtcctttctgtagaggctatgtttacctgttgcattattgcaaaatcacctgtctcccctacttggagcctgagatcgcagaggaagatctgatcacagggtcatttgaattcctaatgcccaagataatttctggcacatacctggaattccttatgcattttattacattgaaatagaattaaaaccagagaagttaattttaaattaaaatcagcgtagacaggccgggcatggtggctcacacctgcaatcccagcactttgggaggctgaggtgggcaggtcaagagatcgagaccatcctggccaacatggtgaaaccccatctctactaaaaatttaaaaattagctgggtgtggtagtgtgcacctgtagtcccagctacttgggaagctgaggcaggagaatcgcttgaacctgggaagtggaggttgcagtgagccgagatcacgcctctgcctggcaacagagcaagactccatctcaaaaaataaataaataaataaataaataaataaataaataaataaataaatcagggtagacttctaataatagagaaaactttaaaacttttaatgtgagatttataggacatttgtgtttctagtagtaccattaaatctctttccttatatctgcttatctttcacagatatgctatgactgtctggtactttgatgctgaagaaagggcagaagccaaaaagaaattcaggaatttaactagtatgtgtttgataattttctgtgacttttgatcaagttaatccttgacttttattcaattttatgtagttttaaacatgttctgttcaatctgttacggcttagctttatatataatgacatcttgatgggttttatcctgaaaccttggccttagggctcttagaaaaatcagaaacaatgcaaggggcttcccctgagaatgcccactgaatgtatgatggtttatgatagatgggaaatagttaactttttcctattaatgttaaccagtcaaatgtaacattaaattttgcccatgatttttggcatattgcaaaggaaatataatggagcccagttatgatggcaaaatttattatattgggtgagactgtgactctcagtataacagcagggctcatgtaatataaactgaatataacagcactactcctatcccttccaaccagtattagaaggcagcatttcccaaaatacgttgcattaaaacacaaatcctgccaatttggtaaattcctggtcccaaaaatgtgggaaatgttgcatgctgtatgcctgtcttaaaaagagtcacattgctcactagcatattaaattaaggcgctaagagatcctgcagtaaggaaacatatataatattgcctagcccataacccatttggactgtatacctctcaaataccaaagtggtctccaaattgcacccaggaaatctcagtttgttttctcttccagatggcctacactgcttaactctgatatgtgagtgaggctacacttcatacaacttatgctcagcattagcccaagaggtgccaatgctggatgtaaacccaaagttcctccacagtctgtgaggcatatgggaaagatcccattgcaaagtcaagagagaatcctttggcagagctctattaggaggcttatataagatgggaagtgtttactggaggctttttggtgacatttgtgacataaaactcatcagagctgactccataccctctttattccctttctgtccccaacccagggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttatttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagctccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtgggtgttcctgtttttttttttttttttttttttttagttttcctttttaatgagctcaccctttaacacaaaaaaagcagggtgatgtattttaaaaaaggaagtggaaataaaaaaatctcaaagctatttgagttctcgtctgtccctagcagtctttcttcagctcacttggctctctagatccactgtggttggcagtatgaccagaatcatggaatttgctagaactgtggaagcttctactcctgcagtaagcacagatcgcactgcctcaataacttggtattgagcacgtattttgcaaaagctacttttcctagttttcagtattactttcatgttttaaaaatccctttaatttcttgcttgaaaatcccatgaacattaaagagccagaaatattttcctttgttatgtacggatatatatatatatagtcttccaagatagaagtttactttttcctcttctggttttggaaaatttccagataagacatgtcaccattaattctcaacgactgctctattttgttgtacggtaatagttatcaccttctaaattactatgtaatttactcacttattatgtttattgtcttgtatcctttctctggagtgtaagcacaatgaagacaggaattttgtatatttttaaccaatgcaacatactctcagcacctaaaatagtgccgggaacatagtaagggctcagtaaatacttgttgaataaactcagtctcctacattagc

SEQ ID NO: 11391 - DNA, 3844 bp, Homo sapiens
ggccaggcgggtctcaaactcctcgtctcaggtgatctgcttgcctcggcctcccaaagtgctgggattacaggcgtgagccactgcgcccagcctgagtttcattttttaagtcacatagcagtagtccttatttcagtgctagaccctttgaaatgcgatgaaagctatatggacccttcgctttgttatataacatatgcacacatacccagaattttgcacatatgttcagagattcctagacctgcagacctgcctctgtgtgtcccaatttaagaacctctgttctttcttcatgactggatttgcccaattttgtgttattttgggacttaatttgtccctctttgggacatttccttatttattgccctcttcagagagtagatgtagaaaataaagagaggaaacctagattacttaatttttattttaacattttctatagatagcataccacgccaagtgtgctctgtcttgatccccttctttctagcatctgccagacattgtagagtttcgcaagcagttgtaggtttgagctgcagccagtcatttcttttattctttaaaagtacatagatttgtctttttagggctttactgaaagtaaaatatcctgacatttaaactgacagatgtaggaggtaaaaaatagagttctgaaacatttgaatttatgtgacagctgaagtcacgagatgagggatgtatgtcccccagggaggatgcagaaagaagaaaagggtactggaaacagcatgtcagtggtgccagctgagggctggaggcagccaggagagttgggagcctgggtgctgggtggagagaggttaacagggaagacatgggaagtattgtgaaggctggtgtgagcaggggactactccagccctgttggaacatagagccatttggcagattgacaatgcagtgacagctgtatataataaatgtgttgaaaggaggaaggtgaggattttcttggtgggagtttatgctgttatttaacatattttgcttccaaaggggttaagatgttttacctaaatggaggtttctaggtcagtgctatacaatatttctaatctgtgttttatagtgtgagctacatatgtaattttaaaattttcaagtagccacataataaaggaaacaggtgaaatttaatgacatatttcctttaatacggtatatccaaaatattattatgtcaacctataatcagtataaaaacctgttactgaaatattttatagggcccatctcagttcagactagccacatttaagtgcttcatagccacatgtggctcatggccatccatatttggacaatgtactttagactattgcatctgtatactcttgtgccgtcagctggggggtggggtgtgtgtgcgtgtataccaaggcagtgagcatctgagctttgaacctcaaagaccaaaatgccctgcccattttcctgcttatcagctgaggaatctttacccacattgacacatgggcttgttctgacccaagtgcatgcaggcttccagagcagattcagaggcctaacttagtcctttagctttcctcccagcacagaactcccaaggttatctgcaagtaggccttgcctagagagactgagttttcaagttgtcagttttcccaaattgtcctcaagcatcttcctctggaatcaccttactgtttagtaaacattcagaggacttgctacacatctgggcagtctgcattgtaattcatatgtgtttacacatttgtgtcttcatctgctaaagcacctttgaaccatattgtaattcataatatctgaagcaattattatgaattgtagtaattcataatattgaagcgattcataatatctgaagcaatccccagatacgggttaggcatggccctgctctgagcaggatggcaaaagtggcagtccgtgacgcagcccttgttaccccaggctattactaaatggtggtggtggttttatcttaattaaaatgacatcaccaacaatgggccctttcctgtctgccaggaaaagttttctgtagtgacgcacgtgttgtgtgtgtatgtgtgcgtttgaggctatattactcattgctacggcagttcaaaatgacttggaaaaaaacaatgaacgctggtcattgatatgtatactgacatgtttaagggaagttactgtggtctgtaacttatgaaatacataaaaaatatgatgggtggagtgacggacacatggacagatatgaagcaagcactgtaaaatattagtggtagttttgtatgcccatactcacggcaccattattcacagtagctaagagatggaagcaatatgtgcccatcagtgggtgaatgatcaacaaaatgtggtatattcatacagtggaatattattcagcctctaaaaggaagatacgctgacatgtgctgcaacatggatgaatcttgaggacatgatgctaagtgaagtaagccagtcactggaagacaaatactctatgcttccatttatgtgaagtatctagagcagtcaaatgcatagaaacaagtagaatggtagttgccaaggactgggggaggaggaaatgaggagttgtttaatgggtatagtgtttcagttttgcaagataaaaagtcctgtggattggttgcacagttaagttatgtgaatgctgtatgccaactcaactgtacactctaaaatggttaagatggtaaatcttatctttattttaccacagttttttttaaagcatggtaaacaccatttcccaggatgtaaatcggtactaaaaaaaaagtgctccaaagtaagatatatttgggaaacacagggataactaaggttagataggtgttctttattgcaggaattctaagagcatttaacaaattaatttacactgggaattttcagtgtggagggtctggctcatagcatttcacaaacattatacttcagagtcccaaagcctttaaataaaatgttaatggtagaaactccttaaggggtgttcactgtacaattctttcaacttttctgcatgctgggagtttttttggtaacaacgtgttggggaaaatggccttggaatatttcattcaaattggagccaagctaacacaaagctgttgctgctagtgggaacagccctgatgtccatgtaacaagctgccctccccaactccctccttcctgtttctccctcctcggcacccacttctaggattaacaggcagggagacgggagagcccagctctgggtacagttgggccacagcagaaggagggccagggtagaggtttgggccttggctctgatgcttgaacataaacacacctagtcagaagtacatcagtacaaagtgggccctacaaaattatagggtcagaaaacaggtaagtggttaccaggggctgggaatggggagaggagtgactacagagggacctagattcttcaacaaatacattacaagaggaaaagggaagggaagggaagcctggagattgaaagatacttgagacgtgtgaatccagtgcaatgtgtgaaccttgtttgcctcttgatctgaactagccaatcaatcttgtaaaaatgtgcttaagggacaaagcaaatttgaactctggctggatatttgatgatattaaggaaacaacatttaaacatatgacagtggggctatggttatgattggttttgttttttttttctctagagactgggttttgcagtgttacctaagctggtcttgaactcctgggctcaagcagttctcccacctcagccttggtttaagaaaaaaaaaaaaaa

SEQ ID NO: 11392 - DNA, 3844 bp, Homo sapiens; identical to SEQ ID NO: 11391

SEQ ID NO: 11393 - DNA, 3854 bp, Homo sapiens
ggccaggcgggtctcaaactcctcgtctcaggtgatctgcttgcctcggcctcccaaagtgctgggattacaggcgtgagccactgcgcccagcctgagtttcattttttaagtcacatagcagtagtccttatttcagtgctagaccctttgaaatgcgatgaaagctatatggacccttcgctttgttatataacatatgcacacatacccagaattttgcacatatgttcagagattcctagacctgcagacctgcctctgtgtgtcccaatttaagaacctctgttctttcttcatgactggatttgcccaattttgtgttattttgggacttaatttgtccctctttgggacatttccttatttattgccctcttcagagagtagatgtagaaaataaagagaggaaacctagattacttaattttattttaacattttctatagatagcataccacgccaagtgtgctctgtcttgatccccttctttctagcatctgccagacattgtagagtttcgcaagcagttgtaggtttgagctgcagccagtcatttcttttattctttaaaagtacatagatttgtctttttagggctttactgaaagtaaaatatcctgacatttaaactgacagatgtaggaggtaaaaaatagagttctgaaacatttgaatttatgtgacagctgaagtcacgagatgagggatatatgtcccccagggaggatgcagaaagaagaaaagggtactggaaacagcatgtcagtggtgccagctgagggctggaggcagccaggagagttgggagcctgggtgctgggtggagagaggttaacagggaagacatgggaagtattgtgaaggctggtgtgagcaggcgactactccagccctgttggaacatagagccatttggcagattgacaatgcagtgacagctgtatataataaatgtgttgaaaggaggaaggtgaggattttcttggtgggagtttatgctgttatttaacatattttgcttccaaaggggttaagatgttttacctaaatggaggtttctaggtcagtgctatacaatatttctaatctgtgttttatagtgtgagctacatatgtaattttaaaattttcaagtagccacataataaaggaaacaggtgaaatttaatgacatatttcctttaatacggtatatccaaaatattattatgtcaacctataatcagtataaaaacctgttactgaaatattttatagggcccatctcagttcagactagccacatttaagtgcttcatagccacatgtggctcatggccatccatatttggacaatgtactttagactattgcatctgtatactcttgtgccgtcagctggggggtggggtgtgtgtgcgtgtataccaaggcagtgagcatctgagctttgaacctcaaagaccaaaatgccctgcccattttcctgcttatcagctgaggaatctttacccacattgacacatgggcttgttctgacccaagtgcatgcaggcttccagagcagattcagaggcctaacttagtcctttagctttcctcccagcacagaactcccaaggttatctgcaagtaggccttgcctagagagactgagttttcaagttgtcagttttcccaaattgtcctcaagcatcttcctctggaatcaccttactgtttagtaaacattcagaggacttgctacacatctgggcagtctgcattgtaattcatatgtgtttacacatttgtgtcttcatctgctaaagcacctttgaaccatattgtaattcataatatctgaagcaattattatgaattgtagtaattcataatattgaagcgattcataatatctgaagcaatccccagatacgggttaggcatggccctgctctgagcaggatggcaaaagtggcagtccgtgacgcagcccttgttaccccaggctattactaaatggtggtggtggttttatcttaattaaaatgacatcaccaacaatgggccctttcctgtctgccaggaaaagttttctgtagtgacgcacgtgttgtgtgtgtatgtgtgcgtttgaggctatattactcattgctacggcagttcaaaatgacttggaaaaaaacaatgaacgctggtcattgatatgtatactgacatgtttgagggaagttactgtggtctgtaacttatgaaatacataaaaaatatgatgggtggagtgacggacacatggacagatatgaagcaagcactgtaaaatattagtggtagtttttgtatgcccatactcacggcaccattattcacagtagctaagagatggaagcaatatgtgcccatcagtgggtgaatgatcaacaaaatgtggtatattcatacagtggaatattattcagcctctaaaaggaagatacgctgacatgtgctgcaacatggatgaatcttgaggacatgatgctaagtgaagtaagccagtcactggaagacaaatactctatgcttccatttatgtgaagtatctagagcagtcaaatgcatagaaacaagtagaatggtagttgccaaggactgggggaggaggaaatgaggagttgtttaatgggtatagtgtttcagttttgcaagataaaaagtcctgtggattggttgcacagttaagttatgtgaatgctgtatgccaactcaactgtacactctaaaatggttaagatggtaaatcttatctttattttaccacagttttttttaaagcatggtaaacaccatttcccaggatgtaaatcggtactaaaaaaaaagtgctccaaagtaagatatatttgggaaacacagggataactaaggttagataggtgttctttattgcaggaattctaagagcatttaacaaattaatttacactgggaattttcagtgtggagggtctggctcatagcatttcacaaacattatacttcagagtcccaaagcctttaaataaaatgttaatggtagaaactccttaaggggtgttcactgtacaattctttcaacttttctgcatgctgggagtttttttggtaacaacgtgttggggaaaatggccttggaatatttcattcaaattggagccaagctaacacaaagctgttgctgctagtgggaacagccctgatgtccatgtaacaagctgccctccccaactccctccttcctgtttctccctcctcggcacccacttctaggattaacaggcagggagacgggagagcccagctctgggtacagttgggccacagcagaaggagggccagggtagaggtttgggccttggctctgatgcttgaacataaacacacctagtcagaagtacatcagtacaaagtgggccctacaaaattatagggtcagaaaacaggtaagtggttaccaggggctgggaatggggagaggagtgactacagagggacctagattcttcaacaaatacattacaagaggaaaagggaagggaagggaagcctggagattgaaagatacttgagacgtgtgaatccagtgcaatgtatgaaccttgtttgcctcttgatctgaactagccaatcaatcttgtaaaaatgtgcttaagggacaaagcaaatttgaactctggctggatatttgatgatattaaggaaacaacatttaaacatatgacagtggggctatggttatgattggttttgttttttttttctctagagactgggttttgcagtgttacctaagctggtcttgaactcctgggctcaagcagttctcccacctcagccctggttttagaaaaaaaaaaaaaaagttctcttg

SEQ ID NO: 11394 - DNA, 4787 bp, Homo sapiens
gaatgtaatgatgcattttttaaaataccagagcaaatactttgttttatctttgccgatgaaactgtagtacatggctagaaaccttgcaaagagaaggctttacagtgtgtgatctgtctgtattaggtggttgtctggggtgagtgtgactccactgatgactgtattgagcacaacattggcccctgctcctcagtcctggacgtgggtggggctgtgacagctgtcagcgtctgcccagtgctccacccttctcaacggtcagtctctgtgtggggcttagttttaagaggaccacttggtttcttaatatgtagccctcatgtcatttcatttgtgaattctcctagcctctgagttactgtcttttttttctttttttttttttgttttgagatggagtctcactctgtcacccaggctggaatgcagtggcgtgatctctgctcactgcaacctctgccttctgagtttaagcgattctcctgcctcagcctcccaagtaggtgggattacaggcatgcgccgtcacgcctggctcctttttttatatttttaatagagatggggtttcaccatgttggtcaggcaggtcttaatctcctgacctcaagtgatccatctgcctcgtcctcccaaagtgctgggattacaggcgtatgccaccgtgcctggcctgagttactgtcttttgcaaaatgcttatgtttctcataataatttttaaattgatagaacctaatgattcagaatgtaaaatacaggttaggaatggggctcaaagattcttacttcaccaaatctaggactataatactttctctgtaacaagcatcttcagtggaacaagggtccctacagccagctggggaaacactggctcgtgggccttgccagcagaggacacagataaatctgtgtgcagcccctgtaaagaggaggctccttgaggacacaggagagcagtgcagcatgtcctgggctgatgcctgcagagtcttttgtaaggcagggacagttgggacactgtgaagaactactttagagcaatgacgaagataacaatttcatgctaagttaatcactgttgtccccctcccttaaaaacagatacgtggttgcagtaggattggagtgtggaaagatttgcttatatacctggaaaaagactgatcaagttccagaaataaatgactggacccactgtgtagaaacaagtcaaaggtatttctttcctatttttgtttccatcagattaactagaaattgtggggtctttcatggcaaattttatgccacattttcatggagagggacatatatctgtattcgtcgtgtctaccactttgttttgtggtaatctgaaattgatacatgtggtaatctgaaattgatatattgcacttgatttttaaaagtttgcttgaccaaattgcttgcatgcataatattatttttataaacaaccatttgagatgaaagtgatttccataatggtgtgttgtagaatttgactacagtagattcttaatttgattcaaaatgtttgtgatttttaaaaatattctggattgcactttggtagtcgtatccttatgattgagccctttacctcaaaagatcctatagtggagctttcaggcatagcaaggctcatgccctgggcctcatgcatttgccacctgagctggcatagagcacctgctgtttacaacctcctccccatcccacccacctagacagtagggatcacttttaatctacccttttacaggttttattctttttgtgtgtgtgtgagacagggtctcactctgtcacctaggctagagtgcagtggcaagatcccagctcactgcaacctccgcctcccaggctcaatcagtcttcctacctcagcctcccaaatagctgggactacagacacgcaccaccatgccaggctaattttttttgtatttttagtagagacggggtttcattgtgttggccaggctggtctccatatcctgggctcaagcaatcctcctgtcttggcctcccaaagtgctggagttacaggcatgggccactgtgcctggcccacattttattctttaaaaatgcctaaatgtggctgggtgtgttggctcatggtctctaccagtgagacccctggtctctaccaaaaataaaagaaattagccaggtgtgatggtgcatgactgtgggtcccagctacttgggagggtgaagtgggaggatcacttgagcccaggaggttgaggctgcagcaagccataatcacaccattgcactccagcctgggtgagtgagagcctgtcccccccaaaaaagtataaacattcagaaagctactaatatcattctgtgttatattttcttaggctttttcaaccttcgtatatctgtactgttgaaaatacaatttcaaatagcaatttcaaatgacaatatgatgagggtgagtgcttaatggagagagatttgtgagcaatgtcttaagatatttcatccagcagatcttgtctccatgtcagccaagcatgttagtgctcattataattatatttattaaaatgagatattgccatgcccccatggcttctctcctgcctctctgggctgggtttagcagttgaactagtttgtgctgttggcttgctgaagagggaagaagtctgttgaaattccatgcttcaggcatttgaaattttctctcttcctgggcaccctttccttccactttgcctgcccacagtgctcccttcacctctaacctggtgtgaagacctcttcaatggccaccatgtgggacactggtgggaagccccttagaaagtgcaggaagggaacacgtatagaatttgagttttttgtctgaaggggttgtttttttctttggtcattatggtgacttaggatttgcaagatggaactaatgcgtgacttaacatatattatttggattgctaatatttcagttaccacgttccaagtacctttcaaatgaaagcttttgctagtaataagatttacagaggtaatataagcaaacactaccctttaggttggtttgccaaactccctatcttcttaaatatgacatgttaatattctggatttaaaggacattaccaaaaaaagaaacccactatctcaaagcttacatagccaaacaagtatgttcctcaaagtagctcccttggaaagagttataccacatatgtttatttccgtgatttcactacttcaaatccttcttttaatgaaatgagataactctaatccataataattgagattccagtgatgttgctatcacttaaaatgttcttggaacttctctgtaggaattgtgttcagaactagcttactaatgatgcaagaaaacaaattataatgccttttataatattacctgtttcaatcatttcctctttttaaagcttgccattcatatctattaagcttgccatttatatttattataaagcttacttccaggtgctttcaacagtcagattcatcctcaaaggaacatgagctatcactgagagtactcaaatcatagtctgcataatatggaagcattttctctagaataatttcagaaaacagttgaggcacagcagtcagagtgactatttgtaagggcacgcagtcatcttgttgcataggttcaggaggactgatttttaaaatgggtttcgtgacttcattcttcccttttaatcatgagaatgcatctggtgacagggactgtcagcaaatgaaagtgtaatgtgtgtgctctggtattgttttcagtgtttattgccctaaaacctacttaggtttttcactttattcctttttggtttgggaagctaatttgcaggttaaatttatagaagatgttgtattttcatagagatttattcctaacatacgttggtaacactctgggtctgcctttttaaagggctggggaggtagggggtagggagcattaatacgatggtcttgcccaaggtcacgcagttagaggtcacactggagaccaagactctttcattgtgcagtacattaaatctgtcattgtctttctttacccagtagtaaaaatgcaattccatccacctcacagggatgtcaaaatagtaaaataatctagaatatattgtaaagttaaaattgttataaatttagtaatgttatctaaaagactaacttgaatatccatttcatgaaattccattgatcattaaaacaacattcatttaaaaaaattttattttttgtttttttttaaacaacatttgacagagattcattgtctgtgtcttgctcattttggtgatgttattgccagtgagtaagattaaaatttagtcttgcagttttaagtaaatatagtaaaatattttccaggttaaaataaaatggctaaaatgttaatgatgcgattttaaaacctgtacatttcaattttcaggttttaacttccattcatgtttacaccattaattggaaaaacatttcatgatttctctatctttgttttagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataa

SEQ ID NO: 11395 - DNA, 98 bp, Homo sapiens
tgtaatcccagcaatttgggaggctgaggcaggtggatcacttgaggtcaggagttcgagaccagcctggccaacatggtgaaaccccatctctacta

SEQ ID NO: 11396 - DNA, 98 bp, Homo sapiens; identical to SEQ ID NO: 11395

SEQ ID NO: 11397 - DNA, 4786 bp, Homo sapiens
gaatgtaatgatgcattttttaaaataccagagcaaatactttgttttatctttgccgatgaaactgtagtacatggctagaaaccttgcaaagagaaggctttacagtgtgtgatctgtctgtattaggtggttgtctggggtgagtgtgactccactgatgactgtattgagcacaacattggcccctgctcctcagtcctggacgtgggtggggctgtgacagctgtcagcgtctgcccagtgctccacccttctcaacggtcagtctctgtgtggggcttagttttaagaggaccacttggtttcttaatatgtagccctcatgtcatttcatttgtgaattctcctagcctctgagttactgtcttttttttcttttttttttttgttttgagatggagtctcactctgtcacccaggctggaatgcagtggcgtgatctctgctcactgcaacctctgccttctgagtttaagcgattctcctgcctcagcctcccaagtaggtgggattacaggcatgcgccgtcacgcctggctcctttttttatatttttaatagagatggggtttcaccatgttggtcaggcaggtcttaatctcctgacctcaagtgatccatctgcctcgtcctcccaaagtgctgggattacaggcgtatgccaccgtgcctggcctgagttactgtcttttgcaaaatgcttatgtttctcataataatttttaaattgatagaacctaatgattcagaatgtaaaatacaggttaggaatggggctcaaagattcttacttcaccaaatctaggactataatactttctctgtaacaagcatcttcagtggaacaagggtccctacagccagctggggaaacactggctcgtgggccttgccagcagaggacacagataaatctgtgtgcagcccctgtaaagaggaggctccttgaggacacaggagagcagtgcagcatgtcctgggctgatgcctgcagagtcttttgtaaggcagggacagttgggacactgtgaagaactactttagagcaatgacgaagataacaatttcatgctaagttaatcactgttgtccccctcccttaaaaacagatacgtggttgcagtaggattggagtgtggaaagatttgcttatatacctggaaaaagactgatcaagttccagaaataaatgactggacccactgtgtagaaacaagtcaaaggtatttctttcctatttttgtttccatcagattaactagaaattgtggggtctttcatggcaaattttatgccacattttcatggagagggacatatatctgtattcgtcgtgtctaccactttgttttgtggtaatctgaaattgatacatgtggtaatctgaaattgatatattgcacttgatttttaaaagtttgcttgaccaaattgcttgcatgcataatattatttttataaacaaccatttgagatgaaagtgatttccataatggtgtgttgtagaatttgactacagtagattcttaatttgattcaaaatgtttgtgatttttaaaaatattctggattgcactttggtagtcgtatccttatgattgagccctttacctcaaaagatcctatagtggagctttcaggcatagcaaggctcatgccctgggcctcatgcatttgccacctgagctggcatagagcacctgctgtttacaacctcctccccatcccacccacctagacagtagggatcacttttaatctacccttttacaggttttattctttttgtgtgtgtgtgagacagggtctcactctgtcacctaggctagagtgcagtggcaagatcccagctcactgcaacctccgcctcccaggctcaatcagtcttcctacctcagcctcccaaatagctgggactacagacacgcaccaccatgccaggctaattttttttgtatttttagtagagacggggtttcattgtgttggccaggctggtctccatatcctgggctcaagcaatcctcctgtcttggcctcccaaagtgctggagttacaggcatgggccactgtgcctggcccacattttattctttaaaaatgcctaaatgtggctgggtgtgttggctcatggtctctaccagtgagacccctggtctctaccaaaaataaaagaaattagccaggtgtgatggtgcatgactgtgggtcccagctacttgggagggtgaagtgggaggatcacttgagcccaggaggttgaggctgcagcaagccataatcacaccattgcactccagcctgggtgagtgagagcctgtcccccccaaaaaagtataaacattcagaaagctactaatatcattctgtgttatattttcttaggctttttcaaccttcgtatatctgtactgttgaaaatacaatttcaaatagcaatttcaaatgacaatatgatgagggtgagtgcttaatggagagagatttgtgagcaatgtcttaagatatttcatccagcagatcttgtctccatgtcagccaagcatgttagtgctcattataattatatttattaaaatgagatattgccatgcccccatggcttctctcctgcctctctgggctgggtttagcagttgaactagtttgtgctgttggcttgctgaagagggaagaagtctgttgaaattccatgcttcaggcatttgaaattttctctcttcctgggcaccctttccttccactttgcctgcccacagtgctcccttcacctctaacctggtgtgaagacctcttcaatggccaccatgtgggacactggtgggaagccccttagaaagtgcaggaagggaacacgtatagaatttgagttttttgtctgaaggggttgtttttttctttggtcattatggtgacttaggatttgcaagatggaactaatgcgtgacttaacatatattatttggattgctaatatttcagttaccacgttccaagtacctttcaaatgaaagcttttgctagtaataagatttacagaggtaatataagcaaacactaccctttaggttggtttgccaaactccctatcttcttaaatatgacatgttaatattctggatttaaaggacattaccaaaaaaagaaacccactatctcaaagcttacatagccaaacaagtatgttcctcaaagtagctcccttggaaagagttataccacatatgtttatttccgtgatttcactacttcaaatccttcttttaatgaaatgagataactctaatccataataattgagattccagtgatgttgctatcacttaaaatgttcttggaacttctctgtaggaattgtgttcagaactagcttactaatgatgcaagaaaacaaattataatgccttttataatattacctgtttcaatcatttcctctttttaaagcttgccattcatatctattaagcttgccatttatatttattataaagcttacttccaggtgctttcaacagtcagattcatcctcaaaggaacatgagctatcactgagagtactcaaatcatagtctgcataatatggaagcattttctctagaataatttcagaaaacagttgaggcacagcagtcagagtgactatttgtaagggcacgcagtcatcttgttgcataggttcaggaggactgatttttaaaatgggtttcgtgacttcattcttcccttttaatcatgagaatgcatctggtgacagggactgtcagcaaatgaaagtgtaatgtgtgtgctctggtattgttttcagtgtttattgccctaaaacctacttaggtttttcactttattcctttttggtttgggaagctaatttgcaggttaaatttatagaagatgttgtattttcatagagatttattcctaacatacgttggtaacactctgggtctgcctttttaaagggctggggaggtagggggtagggagcattaatacgatggtcttgcccaaggtcacgcagttagaggtcacactggagaccaagactctttcattgtgcagtacattaaatctgtcattgtctttctttacccagtagtaaaaatgcaattccatccacctcacagggatgtcaaaatagtaaaataatctagaatatattgtaaagttaaaattgttataaatttagtaatgttatctaaaagactaacttgaatatccatttcatgaaattccattgatcattaaaacaacattcatttaaaaaaattttattttttgtttttttttaaacaacatttgacagagattcattgtctgtgtcttgctcattttggtgatgttattgccagtgagtaagattaaaatttagtcttgcagttttaagtaaatatagtaaaatattttccaggttaaaataaaatggctaaaatgttaatgatgcgattttaaaacctgtacatttcaattttcaggttttaacttccattcatgtttacaccattaattggaaaaacatttcatgatttctctatctttgttttagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataa

SEQ ID NO: 11398 - DNA, 4788 bp, Homo sapiens
gaatgtaatgatgcattttttaaaataccagagcaaatactttgttttatctttgccgatgaaactgtagtacatggctagaaaccttgcaaagagaaggctttacagtgtgtgatctgtctgtattaggtggttgtctggggtgagtgcgactccactgatgactgtattgagcacaacattggcccctgctcctcagtcctggacgtgggtggggctgtgacagctgtcagcgtctgcccagtgctccacccttctcaacggtcagtctctgtgtggggcttagttttaagaggaccacttggtttcttaatatgtagccctcatgtcatttcatttgtgaattctcctagcctctgagttactgtcttttttttctttttttttttttgttttgagatggagtctcactctgtcgcccaggctggaatgcagtggcgtgatctctgctcactgcaacctctgccttctgagtttaagcgattctcctgcctcagcctcccaagtaggtgggattacaggcatgcgccgtcacgcctggctcctttttttatatttttaatagagatggggtttcaccatgttggtcaggcaggtcttaatctcctgacctcaagtgatccatctgcctcgtcctcccaaagtgctgggattacaggcgtatgccaccgtgcctggcctgagttactgtcttttgcaaaatgcttatgtttctcataataatttttaaattgatagaacctaatgattcagaatgtaaaatacaggttaggaatggggctcaaagattcttacttcaccaaatctaggactataatactttctctgtaacaagcatcttcagtggaacaagggtccctacagccagctggggaaacactggctcatgggccttgccagcagaggacacagataaatctgtgtgcagcccctgtaaagaggaggctccttgaggacacaggagagcagtgcagcatgtcctgggctgatgcctgcagagtcttttgtaaggcagggacagttgggacactgtgaagaactactttagagcaatgacgaagataacaatttcatgctaagttaatcactgttgtccccctcccttaaaaacagatacgtggttgcagtaggattggagtgtggaaagatttgcttatatacctggaaaaagactgatcaagttccagaaataaatgactggacccactgtgtagaaacaagtcaaaggtatttctttcctatttttgtttccatcagattaactagaaattgtggggtctttcatggcaaattttatgccacattttcatggagagggacatatatctgtattcgtcgtgtctaccactttgttttgtggtaatctgaaattgatacatgtggtaatctgaaattgatatattgcacttgatttttaaaagtttgcttgaccaaattgcttgcatgcataatattatttttataaacaaccatttgagatgaaagtgatttccataatggtgtgttgtagaatttgactacagtagattcttaatttgattcaaaatgtttgtgatttttaaaaatattctggattgcactttggtagtcgtatccttatgattgagccctttacctcaaaagatcctatagtggagctttcaggcatagcaaggctcatgccctgggcctcatgcatttgccacctgagctggcatagagcacctgctgtttacaacctcctccccatcccacccacctagacagtagggatcacttttaatctacccttttacaggttttattctttttgtgtgtgtgtgagacagggtctcactctgtcacctaggctagagtgcagtggcaagatcccagctcactgcaacctccgcctcccaggctcaatcagtcttcctacctcagcctcccaaatagctgggactacagacacgcaccaccatgccaggctaattttttttgtatttttagtagagacggggtttcattgtgttggccaggctggtctccatatcctgggctcaagcaatcctcctgtcttggcctcccaaagtgctggagttacaggcatgggccactgtgcctggcccacattttattctttaaaaatgcctaaatgtggctgggtgtgttggctcatggtctctaccagtgagacccctggtctctaccaaaaataaaagaaattagccaggtgtgatggtgcatgactgtgggtcccagctacttgggagggtgaagtgggaggatcacttgagcccaggaggttgaggctgcagcaagccataatcacaccattgcactccagcctgggtgagtgagagcctgtcccccccaaaaaagtataaacgttcagaaagctactaatatcattctgtgttatattttcttaggctttttcaaccttcgtatatctgtactgttgaaaatacaatttcaaatagcaatttcaaatgacaatatgatgagggtgagtgcttaatggagagagatttgtgagcaatgtcttaagatatttcatccagcagatcttgtctccatgtcagccaagcatgttagtgctcattataattatatttattaaaatgagatattgccatgcccccatggcttctctcctgcctctctgggctgggtttagcagttgaactagtttgtgctgttggcttgctgaagagggaagaagtctgttgaaattccatgcttcaggcatttgaaattttctctcttcctgggcaccctttccttccactttgcctgcccacagtgctcccttcacctctaacctggtgtgaagacctcttcaatggccaccatgtgggacactggtgggaagccccttagaaagtgcaggaagggaacacgtatagaatttgagttttttgtctgaaggggttgtttttttctttggtcattatggtgacttaggatttgcaagatggaactaatgcgtgacttaacatatattatttggattgctaatatttcagttaccaagttccaagtacctttcaaatgaaagcttttgctagtaataagatttacagaggtaatataagcaaacactaccctttaggttggtttgccaaactccctatcttcttaaatatgacatgttaatattctggatttaaaggacattaccaaaaaaagaaacccactatctcaaagcttacatagccaaacaagtatgttcctcaaagtagctcccttggaaagagttataccacatatgtttatttccgtgatttcactacttcaaatccttcttttaatgaaatgagataactctaatccataataattgagattccagtgatgttgctatcacttaaaatgttcttggaacttctctgtaggaattgtgttcagaactagcttactaatgatgcaagaaaacaaattataatgccttttataatattacctgtttcaatcatttcctctttttaaagcttgccatttatatctattaagcttgccatttatatttattataaagcttacttccaggtgctttcaacagtcagattcatcctcaaaggaacatgagctatcactgagagtactcaaatcatagtctgcataatatggaagcattttctctagaataatttcagaaaacagttgaggcacagcagtcagagtgactatttgtaagggcacgcagtcatcttgttgcataggttcaggaggactgatttttaaaatgggtttcgtgacttcattcttcccttttaatcatgagaatgcatctggtgacagggactgtcagcaaatgaaagtgtaatgtgtgtgctctggtattgttttcagtgtttattgccctaaaacctacttaggtttttcactttattcctttttggtttgggaagctaatttgcaggttaaatttatagaagatgttgtattttcatagagatttattcctaacatacgttggtaacactctgggtctgcctttttaaagggctggggaggtagggggtagggagcattaatacgatggtcttgcccaaggtcacgcagttagaggtcacactggagaccaagactctttcattgtgcagtacattaaatctgtcattgtctttctttacccagtagtaaaaatgcaattccatccacctcacagggatgtcaaaatagtaaaataatctagaatatattgtaaagttaaaattgttataaatttagtaatgttatctaaaagactaacttgaatatccatttcatgaaattccattgatcattaaaacaacattcatttaaaaaaattttattttttgtttttttttaaacaacatttgacagagattcattgtctgtgtcttgctcattttggtgatgttattgccagtgagtaagattaaaatttagtcttgcagttttaagtaaatatagtaaaatattttccaggttaaaataaaatggctaaaatgtataatgatgcgattttaaaacctgtacatttcaattttcagggtttaacttccattcatgtttacaccattaattgggaaaacatttcatgatttctctatctttgttttagccaaagtcatacactggctatcagaaaattatgctggaagaattgcagtgggaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataa

SEQ ID NO: 11399 - DNA, 1502 bp, Homo sapiens
catgattacactaatgcattccagccttggcagcagatcaagaccctgtctcaaaaaaataaataaaaataaaataattgctgtgaaatttctattaacgtttttgggaaaaccagaggcttctgtgtgacatgtgaatcacagaggagaaatcatgaatctttatagccttgtgttaacatgacttccttttgttgatagagtggtttattagtctcaagacctttgaaatggcacatgaattgcttggacagattatggagacatccacccttctttagagatttaagtaagtagaaccagttagtgtgcctcttctgtttctcaccttgctcaatgcagaatgaacttggtgtatatccaccagaagcacctgcttatctactgtttgctgtcgttgcaggtatctgttgagattagctgtaacgagttgtatgtaattttataactaactgaattaagaaaagcctttgtaagattcagtatctgcttcaggtcattgaaatgtaaaattagaaagtaagctgagggcaggggatttttttctgttttattccatttattccctcaccacctttgccatccaccaccaacagtttcttttaaatttagcatccagagtagacctttgacaacgcaaatcagatcacttcatttgttcattaaaaaccttcaacaggtttcacattattcttaggattatatttaacatccttatacagtaatctccaagcctctccttgatctggtaccctctttccatctctaatctcttctttaacactcctatacttacttactcagccccaggcacattggcatatttgctgttgcctgaacatgcaaattccttgaacttgctgtttccttgcctgaaactctctttcctcagatatctgcctggccttcctcttaacctccaagtcttgtctcaaatatcattttttcagtgaggccttgcttggccagccctttccctcactatatcctgctccccaacaattgatttttacttatccatataacttttatccccctgtgtgctatatattttacttatttcttggttcattggctgtctccaccaaaatgtaagtgccatgaggacaggaattttattaatatcagtttgttcatttctatacctttagtgctttaaacagtatttagcacacagtaagcattcaataaatatgtattggactgggcacagtggctcatgcctgtaatcccagcactttgagaggccgaggcaggtggatcacctgaggtcaggagttcaagaccagtctggccagcagggtgaaaccccatttctactaaagagaccaaaatcagccagtcatggtggcatgtgcctgtagtcccagctactcggtaggctgaggcaggaagatcgctagaatccaggaggcagaggttgcagtgagtcgagatcaggccattgcactccagcctgggtgacagagcaagactctgtcttcaaaaaaaaaaaaaaaaag

SEQ ID NO: 11400 - DNA, 645 bp, Homo sapiens
aaagatagcattcacagcttccagggattcagtgtgaatacttttgggggccattttttggcctgccagaagtataaacactatcaactctagtatataagaggcaaaacagtattatctgcacatgaccatgctgtttaagctctgtgcctacttgctctcctgcaaagcacagatatcaatagtacctatttccaaagattgttgtgaggattgatatgtaagtacccagtagtttctatgacataagtattcaataaatatcattacactgttaaacaatgcctactgaacatttcctatgtgccaagcttcgtcccaagtacatgtcatgccttagccaatttagtcctcacaacaatcctatgagtagagactgtctcttgctgaaggtcatatacctagtaagcggtggtgagattgaaacccagacactctgctccagaagtctgtgctcttaaccgctccagatgtggcctttctgaatgatgctactgttgttttaaaataattgctctaggctcggtgtggtggctcacacctgtaatcccaagactttgggaggctgaggcaggagaattgcttgagcccaggagtttgagaccagcttcagcaacatggtgagaccctatctctaccaaaaaa

SEQ ID NO: 11401 - DNA, 10286 bp, Homo sapiens
cttgaagaaaatgaaatcagccccagtctttatgctgccccctggttcctcacattgtttgcctctcagttttcattaggatttgtagccagagtttttggtaagagatacctgtaattaaatggaacagtattatttattccaaggactatacttctacttctagccatatgatgcccctattgttctatcatgtgttatacagaatagcaaattgctaatggaatttaataaatgtgcctggctgtgttctgacagtaacttaaaatcatacttgtcttacataaaattgaaattaaaaaggaaagaggaattgggctcctgtatttgagtcagctgtaatggagctcttattttcatttgtgcctaaaaatcagagagtatactcctaaaatctggactagggacagactgtgtataattttccagatttttatatacatgtttctacccccattgtcttcttcatcttgcattcaaaacacagagaaatatgttcttaactgtatcaatgttgtttctaatggcatttcttaacctgactttttgttgttaacagaataactttacatcctgtttcattgctcatgtgactcttctttcatgccaatgcagtgctgggggacagtctctaagactggtggctcagggaaaacactaagtacagtcagtagagctcagggcaagttactgagtaactgccttgctctaagcacagtgtttggcattgggaataaaaagagagtgtaacatggtttatgtcccctttggaggcccttaaatctattcacaagtctttatactagtctaagtctgttatttaaaaagcaaaaattaaaacaacaacaacaacaaccaactcttcatcagaggtttgttctaatgatgttgtttaggacctcagtagccttagaaagggctcccttaatttttatgttctgataatctatttagtagacatgggcaaagcagtcagtattcactcacaactgcacttctgttaaattggagctttttgtcaaattgtattggcgccattgtaggtcattgccagtgtttgaaaaaatgaaacagcatttagtgaagatattagggaatattacaaatagtaaggaaatatgttgtttggagaaatttgttttgaggatatatgtgtaatgtatatatataccagattacaacatatgatatctttcttattgagggctgtggtttaaaagttaaacactgcattagtgttactacaatttataaaatgcagcaaaagagtaaagtgaaaatgcgctgaatcaaatgttcaccagatttctcttgtttattgaatatacactattgcttttctacagtgacattttctctggagcttgggttcctattaatgggtattctataaatccttttgtttatatacatttttcttcccagagaatagtgtatcaaatcaaaatgatgtttcagggcacctctcttttacttacccttggaagcttgatatcaagagttcaagaaacaaatgtcctcagtatcagttttttgtcatgagaatacaaatgatgctgttggctatacaatagctgttcaactctcttctttgaatttataaaacaatggagactggcaggaaatggaaagatgcatgagcaagaagaattactatgaaataatgattctatggttccctcttcattagagactccctgttgtatattattgattaaagaatgacatagattgagagaaactttcataaaaaagtactaagtacttgatacttttatttctttctttttttatttttctaagactgagtcttgctctattgcctaggctggagtgcagggcacaatatcaattcactgcaacctctgcctcctgggttcgagcgattctcctgcctcagcctcccgagtagctaagactacaggcatgtgccaccacactcagctaatttttgtatttttcgtagagacggggtttcaccatgttgaccaggctggtctgtaactcctagcctcaagccatccacccacctcagcctcccaaattgttgggtttacagatgtgagccaacacgcccggcctagtacttgatacttttcaaaagtattgcatgtttgtatttgtaggaaagcagggcttagagttagggtagctcttatatttctctcctgattgaggttgtatgtttttcatttgttttaatttttctgttaatgtttttttttttttaatttcctggtgtggtatagatttaattacatagctggttcatttactttttattatggtaatgagagtttgaatagtactcattggttatgttaatttgtttttgtattcctgttgtgaagaaaaatctaaatatcaattgaataactgtccttgaggtttacctagtctccattaaatttggcattaaaaattacaagtagttcatggacagagatatatactttgtccttttttaccctggctttatctgagattcttaagaggaatattaaaacatctgcttatatgtttagttatattgcttttttaaaaaaaagctagatgcttttgaccagttttcttctgcaaaatacataaaacaagtaaacaaaaacctttagcacaaatagcgtgctttttacaagagtggatgcatagttttgatcatgaaaattatatctcttcttttagatattatttttcttcagggaactgaagttatattcaaggttgcactcagcctactgagcagccaagagacacttataatggaatgtgagagctttgaaaatattgttgagtttcttaaaaacacgctacctgatatgaatacctctgaaatggaaaaaattattacccaggtatgatttaaatgctaatagtattatatagcagttttctctactaaatatatattaaatgctttagcctaaaaatgtagctttgcttgacagatattttcatcagatacattttatttagaaaggggactattgtgaaatttctacactgtgacattttctatctggctatgcacaaaaaatgctgtttagtgctacgtaatgagtttttcaggaatcctttcaatttaaaccaatgctaaaactgaagatagaactgacagagtcaagaaggcctgagaataaaatcagatcctcttgcctttgttatattgttaattattttgtaaaataaacgaagaggacacgtggcaggagtacaggctttggaattagaaggtattgggtttgcatctacttctggctttttaattggttgtttggcttgcacacatcagcctaatcatccaaaccctagttgtccagaatgggacagtactggacaagttccagaatgggatgatactgatctgagaggttttatgaagcttcagtgaggagacttggtgtatcagtctttgtccctacaggaaacattctccctccgatgattcaaatgaaggaaccatctataaaggtgtgggtaggcgtaaggcaatccaacacagctgtccaggtgcgaaggaactagtaacatagggaagctgttcaaacccctgctgcagaggagctaagtggaggatataatagtgttactaggcccagggagagctggaaccgtggaggagggttctgtgctggttgttgtggtcttgttgaactaggcagagaaggatcagggaagaaatacccaacccttttctcctgccccttctgatcttgtgctggcatcttctatttgccaaagtgaaccagaagccagccagaaagtaagtgtggggaattgtctgcctgccagggtacaatagaatggatgagggcagagaattgatctgagaagcaaattgagagtaatctgcacaccgtatgtgtagtccttgactcttcatagggaccaggtgagtggtagctatatattgctgccgttcagatgcagtggacaagcttaagagcagcttgatagatttgacaattatgctttatgagcattgataaagtttaccactttcctgaaggcacttttgatggcagaaagacgatagggtttagagaaagggagtttggaaccttgttctggtgcccagccatttactagctgtgtacctatgggcaagttacaacctctctgagtctcaacctcttcctctacaaaatgggaataacaaaagtagattctattatagttttgtattattttaggagcaaatataaccaatatgttaaagtattttgtaccctgtaattcatactataatatgaactcttattatattaatacatgtaaaattttatttccattacatggaatctaaatcacaaatatctataaatagtttgtatttgttaaaatgctctgtaagctgaaaagtgtagcttttatttatatattcacttgtttataaatttttcagaaatatctttcttgactggaatcagatattatgcttttagagatctgaaatcagatatcacctcccttctaaaattaatgaggaaattgcctggctttatagattactattgggattaatgagtagaatttataggcaggtaaatttgaacttgatattggagagaatttcctaacaattagagttgattactgtggaatgaaatgctgatattaagggagactttgatgaactttatttatggacactggaaaaaaatgcaaataatgcagaaaatcacaagaaaataaaagtaactataaatctcaacatctagagataatctttgaaactttgtattacatgtttctttgcttatatatacatataaaaatatataaagttgtacataaatgaaatcatactatatatactattgtggaacctgatttataattaaaaatataaagtattagattttttccagtaactataaatccatattatcatttttaatggttgtataataatccattgtatccatacccactaagtaaggaaaagatgatggttatttgaggataaccagttagtctagaaattctcttattaaaattcgaatgtttgagtatctctattagtaagtagtagagtaagtcaggttttttgtggtttcttttctcttctcagtgttagtatagacaccattgcttgaatagcagctgttgtctctccttccccctaggaagtttggagtaactgtcctctagcttcaaagcaaacgaccttcctatttagtggtgacatgggagagcagtagcagccctaattaaaccttacagccctggacagtgctcacagtgtgcaattttgaggattctctgtgtggtacaatatgtaaatgactcttaagaggcttacagggaatagcaaatggatgcaaaattttattaagatctttctgctccattggcaaataaattagaaatgcttttggttgctttattacagtaataccctatgcaattttgcttactaatcagcagagattatctctaacataataattactcaataactaatgttgtttatctagtatactacattttgggagacagttactagattatgaatatcttagctgccaaatacacttggacattaatttattctagggacttagcttcatgagaatgtttcaattgcatagaaataatctatctgttctgtttttaaagaaaatcttctttcacagaaagagctatctgtttttatgttgacagtgtaaactatatctaatttattcttgtattgacagttacactttttttttgcttttttatgctttaatgttcttcattaataagtatttggaaatatacatgaaatataccaagataaacaggctgtatcttgttatacataccaaaggctagcctaacccatgatactttcatggcaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtaaagaaataaagatttgagcaaataagtacttcaatgcctcctgcatgcacagaactacctcaggaatgaaagggatatgtgcgtggaatgaaccattgctaaccaagagcccatgtatcagactgtccaagtgctctggggctacaaatgacatgttaaattaaacattacttggaaaaaaatgcaccctcacaaaatagctaaatggcagttcaaagtggaatctgcttaaatacctgttgcatgttatagatatttggttaagttaaagggaggaggaattgaatgtaggaaattgatgaagttgtgaaggacctgggcttgagctggaatctggagggttggtggaagaaatgagtgaggagggtctttaagtcaggctgagtaggagggtggcatcaatcagaaggacatggcagagcagcaaagttagcctagtgtcaatttaagatagaggttggggagaggtagggtaaatatgatagaggcagaatcgtaagtgactttcagtgtcaagccaaagaacatggctttaatcctgtcaagagggaaatctctcaaagtttttgggccatgctgtagaaagatcaatctgggaaccttgacgaggacagattgagatgggagagaaggtaaggaggcctgctaaaagtcacttgtgaaaatctgttgcggatgatgagagttgtctagactaaaatggaaattggaagagagggagacatgtctaggtaaattgaatcccatgcaaatgttacatgtaatattaatacatcattcctgccatcagggagttcacaattatttgagaatataaaatactatatatctgtctctaagcgcacacttatacatgcaataagaaatttattataaagtcatattcggtatttgcaacttgtatgatgtgtgctatgtagccatgccctgaggggaggggcttaagagtgatcacaggatgggggctagcaggtgacccttctgaagtcttcggggagatgacttcaggggagtttcagtgtctaatggctcctcggtttccacttactcctcctctccatttccccaacaatgcacctggctacaaactggaaaacactaaaactctgcttctatatggtgagtcccctgtcaagaccagtcaagagagacaggttagaaatgagggatcgctaaagtagttgcttcccaagaatgggaacactaaacttccttcgctttctcttacattggctctggctcatagaaaatgtaaatctttttttctattcaaaaaagggcaacatactcttattttcaaaaagaaaactaaatggttagtatattgtccatttttagttggataggtcaatggcgattaattatttgccccttattagggaaggtgggtttgtacctgttttataatgattcgtctgaactgttgtagactttttcactgacagttcagtgtagtcatcatcagttacttggccacccctcacatctataaatactgatgaaagcccaagtgtatgtttagagaacgccgtatttcagtcagagaaggaaaatctcttttagcactgcaatagtgtcaggaatctcctgtttctccttcagccaggccagatcccactcactcaggggaacaccagtgggtgtagaataaggattcctactgttggtgaggggggtgatttagtattgaattattcgtgtgttcagtgagaagagatgaagcatggtagttccatagttacatctttgtgaaacctaataaatcatcgtttcctgtaggttttcagagtatttgcttcacataatattttattaagtaatttgaagtaattggttaatatgtgtaaggactgtctcctactataatgaatcatttgatttggaggatttttttcccccccaaacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagccaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagctcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgatatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagttcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagttccttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagtttggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagctttctt

SEQ ID NO: 11402 - DNA, 36352 bp, Homo sapiens
gtcgcccgggctggagtgcagtggctcaatctcagctcactgcaagctccgcctcccgggttcacgccattttcctgcctcagcctcctgagtagctgggactacaggcgcccgccaccatgcccggctaatttttttttttttttttttttttgtatttttagtagagacggggtttcaccgtgttagccaggatgaccttgatctcctgacctcgtgatccgcccgcctcagcctcccaaagtgctgggattacaggcatgagcaccgcgcccagcctactattacttttttaaaagcacattattttgaaattttaaattcagattaggcatccatttccaggaccactatcctgaattactgaaaacaggttactatttttaagcaggctgagaaaaaggagccaagatctttttaatagttggttagtagatttatttgcacataactgaaatgatagaggagagggaatgtgtgtattttttcttttacctcactttgaattaatttttcaaaatttaatgttatttcattgtttagtaaactataattttatataatgttatggtaatttttataacatctgcttattaaatattatcacagacatatttgttactttttacagtgcttctcaggttttaagcctgtgcttaaaaatttatttatgttgaaattcattgctcagaagtaaatgacagtcaaaaaaaagtaaatgatagatactacttctattcactgataaaacttttcaatgagaaaataaaatctttgatgatgaagtactttgtggtatagtttttgttctatatttctcttgtattcagtgaaaaaaaaaggtataattattcattgtggttcattattgaagtaaccttaccatgacttattgatgacttattggaatgccttttatcctgaatcctgatttggacatatttgtgtgtgctaattccattccttgttttcctgttgtaccagacaagacactgcttcagaatcaaggtgattagaggtctacgtatttttatttaaaaaaaattcacagattcttccaactgaacatcatccttagtttaaaaagcagttttgtttgtctcctgaatgcatgccatctttctgagtgctctgagggctatatagtagggaaaatgtgacccttggtgtaatcaaagaccatgaattaccatgtaaaatgttgattgcagacagaaatcctgtttctactctattccatgctgaaatttccttagagctgtgctgtggccttcaaccaaagcctaattttaattttaaattaatagaagtggatttgctagttagggggtacatatgtgcctaagtggagtttattccaaatgccaagaagatgcagaaatgagcatcctaaaagaaacgtactcacaaaattgaatctgcctttcaactgaagaggattattcgtctatttctgttcacctaaattcctgtcacgttggtcactttgagacactgctaaagccgttcagacctcccatttgtctggacacaggaaacacctagttccttattatggaagtttgaccacatctgtgttgacatctcttgactcacatgctttttttgtggtgaacatctagaatcactgctaacaaccactgcaaataactgtcctctgctttattccagtttctacatgttgcttttatcatgagcccagtgaaaaagatacatgcccatcttcctatttggggccactatttagatttctttgtagctagagtgaaaatataatattaagtatcgcactagactgagatgttcaaggagaaaaaatcctcagaaaattattttagcaacaattataagattaaaaagtgacttttttgagactggtaattggcaagtctcagtcatggttaggtgtaagaccatttaaataatacttcttacctattcttaaaagcctaatggaaatgttagttctgccttgtgtccttttaggtatggaattagctctgtttattactttagagttaatctagtctatgatttccttattttacacatggatagattgaactccaaaaaggttttatattttgcttgattttttttcagcttaggtcataaggatataaataaacatatgagatacccagagatgttttaaattccaatatactaaacttattttcttaaaatctgcagtgtgtagagtttaggaaataaaactctttgtttttctgcttctttcatctacacgttgttccactgactaatctatctcttttgactcataggtcaaatactatatattgatttccactagaatagtttaatctcaattttacttaattagtaaagattttccataggataacagacatgtatgcagttaaaagccagaacctatataaactgttagtgcacctgatgcaattatgagttaaattatactgtggatcctgtagaaaaaatatggtttcatttctatgaaatgaaattgttttacttagcatttcttaaggcttacaaagagaaagctttttcagctttcggttcaatagttgctatcacactaatgaagttttggtatctatcttatgttgaattcattgtgatttagatacagatttagacagtgttttgtcatttatttggacttcagagatagagtcttgctgtgtcattcaggctgaagtgcagatgctgggagtttcaactgggtgccagagggttgggggataggaggcaggttgctgctcagtataacaccacctttgcaagactggtcctgacagaagagtttgcctttgtgcaaagtatatctgtgttgccctggcaggaagtaaaatatgactacatccttcttaaagttgagtctctgtgagtggtcattagagcatctccattctgtacaatagtcaatgaattcttttaaagcaggcaagtagacattacaattctatgttaaaataagaagtgggatgttaatttaagagttgatctggtgaagactatacctgcttgttcaaggatatgttaaaagattatcttgaagctttgacaagttcatattatagcatttgatggatcctatatacaaaggacttggaaatagccttcctaccctatattgggggatatatgtaatacgggacattttctccccatatgaagtctgaatttgtgttcacaaactgtggttcttaattaactggtgagtggtaagagggagtatatatacaatataccagtcaaaaatgggtgggagttctccaagttatgtttccttcctagatattcattttttaactttgtcaatttctgatagaggtaatgctggcacagaatacttttcctgaatatgtatcttgggaaggagttttataatacacatgcttagattccaaaatacaaaagaagaaggaaaaaattctatggaaacataagggaatggttataacttgcttcatcatttaagaaatgtaaagatgattaaaataccagtgtatgtatattcaactatatttaggtgtttttttatttggtccttctatttacagttaaaagtgtatacattttggaatgtaattatttcaaagcaaagaaaaggaagtgagacatttacataaacgagcacctgatagtactctgaagttatttctctgttgatataaaattaatccattaaaaaatggaaagagaagtacccaatcaaaaggcttagtgctaattggagacttaatttttcaccagaaatgcagaggatcctgggggtcccaacagctttgtttttgtggtcctatagagctttgttcagaactaatgcaaggagtatttacactggcaggatcagctgcagtgcctaatgctggattctggaccacctaggtttgcatcctggttccttcactttattatccgtgtgactgtgggcaagttacttagcctctttctacttcagtattgcaccaaaaatggaagtagtaatgacatctaccttgcaaggttgctgtgaggatgaaattaattcatactcgtaaaatgtttagaacaatcgatacctggcatgaagtatgtgctgagagtcttagctttattattattacagtaaacaccacgtgttgttttatttttgtttttactcaaaaagtagacattatgctttcttacctaagtttaatcaaaggaaaagttaatgtgataactaatgttgtaataaaaacaaacaaacaaaccaaaagaaataaactccctccacccccatcccagtgtagtttccaagttgggttataggaattttgatgcagtgtttcatttggttttgattcttgcaattgccaccttaagaatgtcagattgctgactaaaagtaaatcaaacaggaaactgctataagttgcataatagcactgactgcttaaatgtttattgggaacttgacttctgaatacagatcttctcttattaaaagcagagctgcttttgccatatctcagcaaccaactactttttcaagatgtcgatttttagtacaagataaagggtcaatggtttgttatgtaagttcttcttttcagtatattattatcttctattttgactgctaattttttggcttattactagtcagtaaattccagacatgggagaaaaatttgtcattgggcagtttatattataggatttaaaattttaggtttatgaaatttttgaatatcagtgggctaatgtaaatactgtatgcgcctcttttataacatattgcccccaaaactttgtattttataggcaatcatgaaactgatatgggtacaactcagttttatttttagtacgttctaaacacttgatatgtcattagcagtgaattggaaggtgattcttaaaagctgttttaattccagcattaaaatataaacatttcggagtcctctgatttggtcaactctggtttgttagagcactaaaaaagtcaagctaaattaatatttgttgatcttttgccctgtggagcattgacatagtgcttttaaataagtatttcatttagctttcaaagcttaaagtataaattagatggctttatgtaggaaaggaataacacttactagaaaaaatatgctttttgttgtttattaacaacattgtcatggtcaatacctaccagtgccatcaacagttcagaacatactttagaaaaacaaagctattaggacttgactcccaataaagggttttaagaaggtagatcttttatttattcctgacatgttagcctagccagtatttttgtctgtttcacttaaacttctgagttaatatttcatttagttttataaaatattaatttattcagtagatattattcagtgcttattatttacctgttactacactacaagctagaaatatacctatgaactgggcatttagcaaataactgccatcaaggtcgtgttacaaaaatgaagataatgagtacttcaactgtatttattgggttgtaactattatatatagaacatttgaatcatatttttaaaagggaaatacttgcattaatgttttccaaagtgcaagtaaaagcaaatatatatatatatatgtgtgtgtatatatatatatatgtgtgtatatatatatgtgtgtgtgtgtgtgtgtatatatatatatatatattcaatattcaggaaggttttttgttttgttttgttttgttttttgggacagagtcttgccctgttgctcaggcaggagtgcagggatgcgatctcggctcactgcaacctttgcctcctgggttcaagcgattctcccacctcagcctcctgagtagctgggattacaggtgtgcaccaccacacctggctaatttttgtattttcagtagagacaggattttgcccatgttggccaggctggtctcaaactcttgacctcaagtgatctgcctgcctcggcctcccaaactgctggaattacagatgtaagccattgtgcccagcctcagggagtttttctaaaaaaaaaatttaattataattttattttgacatggagcctcgctctgttgcccaggctgaaatgcagtggtgcattctcggctcactgcaacctctgcctcccgggttcaagagaaccttgtgcctcagcctcccaagcaactgggattacaggcacctgtcactaatgcccagctaatttttttttttttttttgtatttttagttgagacagggtttcaccatgttggccatgctactcttgaactcctgacctcaggtgatccgcctgcctcggcctcccaaagtgctgggtttacaggtggtgagccaccgtgcctggccactgcctcaggagttttgaacaatggacacatattagggttatagtgttatccaggatgcataataaccagagtttgactatattgagatatatgtatcaagtactgtactttctaaagtatcacgtcataatacttactctctgcatagcagctcagaagtcttttttttaactttaatttagccaatccagaagtaatgtttccataaaatagatccagactagaatgaactgaattgcctgagtaaataaagatacgataggcagatgctgaattgctcttctcactattaattgcctcaacactattgagttcctttgagtatctgagagtggctgttctgtctgagctttatttctgacctcagcactgaccttttgattccatcaaaagtcttataccttcatttgttggtatcatcacctgtaaatattggtatccttattgttctctcaggcaaactcagactgtgaaacttaaaaatgtaagatattcctgccactaacagcaacaattattgtgaggtcttccagcagcaaatataattggtctcaaaaatgattttgagtcataccgacctttttttgcagataggcctagcataactcaaagtggtcttttttaggaaatgaaattttgacaatagaggagcattttcttatgcactaatatagaatgatgtgacactactccctgtcccccaaaaattgagggaggtgattctagaatcaattaatttcaataagttggggaatttctatacactgtttccctgttggagaggtacagtgcatgccagtgtattaacagtctctaacaagtactgctataaagaaatctgttaacattttttaacaggctgggtgtggtgcctcatgcctgtaatcccagcactttgggagctgagacaggagaattgcttgagtgcaggagtttgagaccagactggacaacacaatgggacccggtctctacgaagatttttttaaaaaaatagccaggtgtggcggtgtgcacctgtagtcccagctgcttgggaggctgaggtgggaggatctcttgagcctgggaggtcgaggctgcaatgagctgtgattgcgccactgcgctccagcctgggtgaaaaaatgagaccttatctcacaaaataaatgtcaataaaaatataaaaagatctattttttaacttagccatccaatcttatttgaccccagttttttcttagtatatcacctaccaataatcccaaggttgactgttctgcttatattcaggttatcatctgccatgattcaactgttggtagctgaccattcagagacacatcttaacagtcgtaggcaattagaaacagtctttattgacctgttctataagagctctaacaaaagctctttgtgaggcttttatggaatatttaccttgtttcaaataagctattcatgttatttccttagcaaagcatgaattcatgacttaagcaacctgtactcctccttataagtgcttctgttcctcagattagaactaggactggttggctgctaaggaatgagtagaaacaggggagcttctcttgactgggctgtggcctagattgctgtttccccaggatgtggtggcctgggtgactagtgtgcctggtgatgcattgctccatgttgcctgtggcttgtgcttgcccgtgacagaacttgtgaatggcttgtgctaccagttggttgtgaagtgccatgatgtgcagctctccttataagtgatatgtttatttgctttcaacagtgatggagaagggagaaaaaggacctcatctacctgcagcaatgagtccctaagtgtgggaggaacctctgtcactcctcgccggatctcctggcggcagcgcattttcctcagggttgcttctcccatgaacaaatctccctcagcaatgcaacagcaaggtctgtgttgcactccctaaggaatttatccctctgagtgtcagaaattagctaatggaatgcacgtgctgtgtataaagagatttaagtgattacagtgtagaaatatctttctgtatgtgatacagtggtttctctttcaggtatcattagaaaacattaggcattcaatacctgcttgttgaatgaatgaatgagtgagacagtttccaaaaacctgtacttgggcctactccacaaggtagacggaactgtgatagtgctaggaaagaagctgtatgtcctttttctttctttctttctttctttctttttttttttcccagagattgggccttgctctgttgcccaggctggggttgcagtggtgtaatcatagctcactgtagccttgaactcctgggctcaagcaatcatcttacctcagcttccaaagatctttttattattagaaaagcaacatagccttttataagagccacacataaaacaaactgacatagaaatattgagcaataaaggaatatatacaatatactaggcaaatactgagcaaaagagagcacaggcagctctctttgagtaattgacctattaaactaaagcaaaagcatccaaagaggcaagcacatgtaacagtaaacaaacagatagaacaatcatgagaacatacataatgatgtagctttgagagctagaaaataacacctaaaagaattctggagtgaaatcgataaattaatagctcctgtgggagattttaacatactcatctttagaaattaaatataaataatatttgagtaacacaaataaataagcttgacctaatatttatagagaacttcgcctcctatggagaaaactcattcatttttagcacacttggaacattcataaaatgtaattatgtacctgtccacaaagatttttaagtaaatctttttgaaatccaaataatcataatcatttatacaaatattctctgaccacaatgccaaaaaaagaaagaaatcaaggattagaagacaagtagaatgacatgtgtttgggaatagaaaactactcttagaagctagaaggaagaaaattcaatgcttagagccttacctattgaaacggatctagggagcagttaaaagccatgaatatattgatataaaatcaagaaggccaaaaattagttacactgagtgttcaactcaaaaagctagtaagagagccaggtattaaaattttaaaacaacaacagtaaaacgtatggaagtaaataataaaagtaaaggcagaggtcaatgaatatatataaaaaaagaagaaaatagaagaaaacaactggtattactaaagatgaagttaactctgcccgaggtggtcagaaaaagcttcacagaacaattagatgtttatttaaactcgttgctggaagaaccatgctttagaaggaaggaatgacgaagctctggagtcatttgagtgaactttgcagatcagagaatcatgagaaattcagcatgatgaatgcaaagaatagaagattgagatatgaggctggaaatctgagtggagaccagaatctgaaggaacttaaatgctagtcccaatttgttcttgcgatataagcaaccattgaaatgttttaagagatgtgattatggttgttaataggaaaatcattggcagtaggaagggagagaatgagtcacctgttaagggagtgttgcacatggaatactgcacagccatgaaaaataatgaaatcatgtcctttggagccacatggatgtagctggaggttattatcctaagaattaacacaggagcagaaaaccaaatactgcatgttctcacttataagcgggatctaaacattgagtacacatagaaacaaagaagggaacattagacaccgggacccccttgagggtggagggtgggaggaggatgaggattgaaaaactacctctcaggtactgtgctcactacctgggtggcgaagtcatttcatttgtacattgtaccccagagtcacgtaatttacccatgtagcaaacctgcacatggaccccttcaacctaaaataaaaattgaaaaagaaaaagaaaaaggtgttgcaggaggaatgagcagagggagtactgtgctcagccaggagaggcccagcattgctcagtggctatgctcctgacggattttgatgatcgatgtgaccctttgggagatccctgatacctagccacttaatctcgttcctcacagccagagaatatacgtaagtaaattgcagaagtgttggactcaggagaggccagttagttttggggcacctctcttacagagctctttgggtggaaagaagaagtggtgaaatgacctatgcttctgtttcatcatgacagggaaatctggaaggggaattcagtctagtgaatttacttaaatattagctgcagaaactaagttacagggaaagcggctttgtgacatttttaagtgtagaagatcagatgagaatgtgaattctacagaaacttgggtagtctgggttactgctaaggaatgcctctcactgtgttcttctctgcagatggattggacaggaacgagctgctgccactgtcccccctctctccaaccatggaggaggaaccgctggttgtattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaaggttagccattttaacagactaaatgctatgatgctatgattgaagggtgtatgttaaacctacctttctctccccatacatactatccgcactcagttttggactgtatgcacactttaagaagaatacctactgattataattgttgatttccattttgtgaggtggttataacatgggaaaggtcagcttaagatatttgtggttttgttttaaatgggtttgcattttaaatagatttaagacttaagaaactcttagagtatatttaggtaaaatagaatgtagataatatggaatcaatgtatttgatgtgtctgaaagttcattatcttagtgtcacttctaaaaaatccttaaatatgagaaagcaaattttcttttctttgaatgtgattttcaagtttcaggttaattacattcataatgggagaaatatgcctacctcaagtaaatcctacttacattgtattcaatttaactatttaattataattatctgttatcaagccaaacctattcctattttttgttaatgctttataaattttctatttaacaaagtcgtattcaaatcattatatttataatcaaataatttataatagattttgccccccttgtggtgccttattgctaagattatgattaccaaatgctttggaatgtgtttttcagcctttgaaagaatgatataatttactccagtactgatagaaccacatacaaggagatgctaagaaatccaaaaaaatgtataaatttcattattttgggaaaatcacttaacctgaaagggtctcatttttacacttgtaaaatgaaacatttaacataagtggtccgtttgacttttaagattattggcacaagtataatttagatatttctctcacttgcctttattttgtggtctttcatacagcttttttagtataggtattccacatttctgactttatcatctaccttaagattcttgttactacacctatgattcaatttaatttttttattttaacaatatatagtttgcaagagcacattttttaaaatcgctgttagcagagtgaaaagtacataggattttaaatatcctttggaaatacatcttcttttcttcaaaattaaaaatgctattacttgtcgttagcataattttaaaagttcagtttgataaatggtctgcccacttgaggtttcgcaggcttcaaaagaaattgaattcatatttgtaagcaagtagttatattttgaactaactcagaaaaagaggttgaaaaaaaggtggtcatcctttcctcaaaaaatttaatgcatgaaactgtatttcacttgggagtatgtacaaataaaatctgatattaaatatcaaaaggtggtttcagaatcatagactatttgaagtagaaatagccttagagattacttagctagattcttcattctacagtagaagtagtgactggcttgggaaaggtagagaattaacctaaggtcaaatagtgacatactggcagagcaagtaccaaaactcaggtttattcatcgtggttctcgggctttccccagcaccccacagtatttctcagctgtgtatgttaatataaggaaatggaatgttttacataaatggctgctgtgtattctgagatcagttatactatatgattttacaggttaagaaaggaggtgacatttagaatacattctcagaaaccttcatcggttctctgtttctctgcctacataacaaagataaaaaatagtttaacctatgaaaattctaaccaatggataattatttcttgatagttctttagtcttttctagttaaacagttaagggcagatattaactgtccctgttcaccattttatcctcagggtgtgcggctggcacataagcagatgctcgtgattattttaaatgatcaataatctagagaagattagagaaaaactctaaggaagtaattatgttttgtccatcatgaagaaaataattagtaaagttatatataggagtatatttgtttttagccttaataaagccacaccttttaaaaaattacttggttatcagagaaatataaagcaaatagccaaacagccaagctagacagtgttagaaagccatctgtggtatccggaaggaatagttttgtactgtgatttatctttagattatgtttggacttttaagtaggaatttttactgccttgcttgaataacagtttgttataagatattttaagtcttttgaaatggtttcaaacacactaagtaaagagtaactttcattctgctgttgtttttgtgctgtcgaggacttgggatgcatgacaaagatttgtgttgcaggaggtaaggtggccgagcgctgtgagcatgcatgaatacagattgctctgagatgttcctgtccaccgtgatcctaatgaagagaagaagtatactcttgtgtctgctcttccttctcttttgaaatcagtttttcatgataaagaacaaatcaagatactggttgcttttatagacatttcttttaatgagctctgggcggatatgttagaccatcaaattagagagaactctatattattttaaaaatagaattagtgttaacttcagtgaaaggaatttttctttttaagtttattacaaatgaacacaggagggctgggtgcagtggctcacacctgttatcccagctctttgggaggctgaggtaggaggattgcttgaggccaggagtttaagaccagcctgggcagcatagcaagaccccatctttacaaaaaagtttgtcaaattagccaagtgtagtggcgcatgcctgtagtcctagctacccaggaggctgagatgggagctcaggaggttgaggctgcagtgagctatgattgcaccactgcactccagcttggggtacagagtgagaccctgtctctaagaaacaaaagcaaaaacaaacgaaagagaaaataacgaacatgggaacacataagctagttttattagttattaagggcagtatggataactctggaaacagttataaaaatgtatcatgttatggtcatatatttttcaaatcaagatgagcatgagtctttgtcttctcatgtatggcacatataaaatattaacacttcagtggtgtcaaaaaatggaaaattatagaatgatcaacacggtttactttttatacttagcagagtcgccatatgtaagatacagagtaaaacctccttaggaggttattcctcattttttttctcacatgaaatgactcaaagcttgggaccctttcatgtatcctcaatttgttttaaattttctttttgagatacactaccagttgattcctgaaagtcatttggtatggttttacaaatacaatcaaacgtctaaagttttacatttgaaaaacacattggtcttacgtaaattgtttttttccttagcaagcagagatgaactccagtccagaaaagttaaattagactatgaagaagttggtgcatgtcagaaagaggtcttaataacttgggataagaagttgttaaactgcagagctaaaatcagatgtgatatggaagatattcatactcttcttaaagaaggtatttgggataatctcagtaatttttgttttttaaagaaaagcctgggggattttttttttttgtttgatttgtggagctcagattttgcttagtaattttgtccttgtgttttgcttagtaaaaaaagagaagtaatttgtttcttcctgtagtttagtgactgtctctgaggaggtagcacaaacctattttcagcatggtggtggtgtttaccaaggaagaagtgcatgcattgatacaaatctttgatcactgccataaaaatattaataattcagtctttcaaacttgactcattttcatcatttggtcagaagtattcatttacatatatgtgtatatttacatgactgtgtatatatacttgtatgtatttatatgtatagatttatattctggctaagtaatcaatcaattttctttcatccattcatttcttcactaattttggagaagttgcttttatttagccattatatcgcatttattcttttattgctgctatgccatataagatgcctgatatttaagaattttaaatttaaaaataaaactaataagtcaacttttagttgcagtttctgtgactcagattaaatatattaaaattagaatctccatagcctgcataaactgtgggtgtaaaataaaaattccaaaatacccaaagaaattctataatgattgttgttttaaaagcctatgctaatgtgtgagactgttgagccacagttaagtttaaattaagataagtgttattttgaaagctgctgcattgacaaacttaatatagtgttctttatccttgaagatatggaaatcctaaagatttttactgaatgctttatttgggagacacaataatggttaacagaatgtctatgagatgtagatcacaccattttttggcatgactttcaaagatattttaggagtgcttatcttcctatttcttattggatacagtttaaacttcttggccctgtgcccaaggcctttgtactagtccatttttaggctgctgataaagacaaacccaagactgagtaatttctaaagaaaaagaggttttatggactcacagttccacgtgtctggggaggcctcacaatcatggcggaaggtgaaaggtgtgtctcacatggaggcaaacaaaagagaatgagaaccaagtgaaaggggtttctccttaacaagccatcagatttcatgagacttactcactaccacaggaacagtatgggggaaactgcccccatgattcaattatgtcccaccgggtccttctcactacacatggaattatgggagctacagttcaagatgagatttgggtggggacacagccaaaccataccattgttctataatatctacttcctcctttctgatctcattttgttatctctccttaccttgtattgtgtgctctattttactttgagcactgatatgtcctttgctatttcttgcatggaatgttccagccctccctattctccttcttccttacttctctacattctcatttcccatctccctttctttccactccatcctcttctcactcctctttcttccgccctttcctctgcccgtctcagggcctttatgcggtcctctcctggagtgactgctgcctgcgctttaagcccagagcatcctattatccctcaggtccctcaaataccatttcctcagagcaccacccctgccccccgaccaaaatcagttcattgtactttatcattctttttcgtgatttattatacttaatcataatttacagtttaataattatgtgtgtatttgtttaatgtttttcttaccccaccactgcacacctagcacctaagacagtatcttgcactcattactagatgaatgaatggatgaatgaatgaatgagatgattttcctgagaatggatttattcatcactcaatgatgaggcatcctgactgccttgctttattctctgttacatactggatgctcaataaatgtttgtttgactggaatgaagttgctttttgtacatttattattggttggataataaaactgcccactcatgttatcagtgattcatttagtgggctgatagttaccttctaaaaatgacattttctatgctgtcattgattcattcaacaaatgtataagcagcaaggtatattcttggattttatcatacagagatgaaaatatgcttgctattctcaaggaccatttaagccgggaaaagagacaaaacttcaatatagagctaactgtaatctaatatggtaatgttacagtatgagtcaaatggtgtgtgaaaagggactgattacatctcgagatgttagggagagcttcaaaagaaaaggtgacactcaagctcattcatgaaagatgaatagacgtacaatgggaagtcaagcgagggagcttggaattccataaaggcaacaggaggtgcaagaaactggagaagtgaaaataaccacaagcgtctagtatacatcagggactgggaagtaatggtgcttaaaaaggtagtttggagctatattgtagaggcctcataagtcatgccaacgagcctcagtttcacctgtcggacaataatactttcagcttgtacaaactctggcaatcagtcagaagagattactgtcattaagcatttccttaaccagctggagcaaaggaacccattgccgattcaatgtgtccaaactgaaaactcttagtgagtgaaataaagttgcctgcactgtgcagaattgaattctgtccctcccagtgcttacttcatttcccttggcataaaaaacatagtcatagtgtccttgaactgcttgtgatacattttggtgttcaagcatactagagttaatgtttcattatatgtgctaagcattttcttttcaaagcccgaatgttgttctggagcatatcagttacgccttcttattgtttactacttatattatttcttttttttttagacagagtctcgctgtgtctcccaggctggagtgcagtggtgagatctcagctcactgcaacctgtgtcccccaggttcaaacgattctcctacctcagcctcgcgagtagctgagattacaggtgcatgccaccatgctcgctaatttttgtatttttagtagaggcagggtttcaccatgttggccaggccggtaatgaacacctgacctcaagtgacccacccaccttggcctcccaaagtgttgggattacaggcatgagccaccgtacctggcctattctttcatttttaatgcccatataagaatgctatttgattctctattataaagttacttgttgatgacaaatatttagagttgtaaattaggtttagcatttgttgctatcctcaagccagataaagagtgaaaataggcagtaatacactttgggatatcaggatttggcctctgaaaccagacttttggagttctaattctaaactgccacttcctagccatgtgaacttggggcaattacttcatctctttctgcctcagctttctgtctataaagtggacctaatagtaattgcctaccttatagttgagttgttttctgagtgcatgtgcttagtagctaggcaccctcaataaatgttttattaatgctcagtcagcaacgggtgatgttattgttaatattgtcattatcgtaagtgttgcgtgagggttttcttttgcaaggcatcaagagctataggattcagcttgtcaaaatatgcttctgtcaattatattgtgtggtcttagggtggcatgcagtacatacagctgcctgtttaccagaattatatagtgaatcagctgggatctatcaacttcattccagagttcaaggccttggttatttatctccttcattgtaggagttcccaaaagtcgacgaggagaaatttggcagtttctggctttacagtaccgactcagacacagattgcctaataaacaacagcctcctgacatatcctataaggaacttttgaagcagctcactgctcagcagcatgcgattctcgtggatttaggtatgtttgtcatgtggattataatttacaaaagtaaacagctgatccctctgttaagtttttttggtttttgtttgttcttggtgctgataaagagcacctgttggcatatgcagagccgttgactttgtcctttactgagggcaagttggccttatacctgattgacgatcccataaatgcctgcgtgttaaatgaagttttcaccccaaaactttgcctctgcaaagggagccatcttatatttaaattattataaaggtcatattatggggtgctctcagttactgcattttgaacaactgactttttagggcagatagttgtatcttaatcaatgctggttttgaaatagcttagaataggttaaaaatttaacaaaggtgtactaggtattcctggacacactgctgaaaacaatcctttatatgtcactttaaaaagcagcatgataaatggttatgttggtggaaattatgactatacacctatagggtgagtgaaacattagttgcactaatagtgtaggaatgggtactcatgacctggcggagaatttccagtgacagaatcataaagcagtcttttttttttttttgagatggagtctccctctgttgcccaggctggagtgcagtggcacgatctctgctcactgcaagctccgcctcccaggttcatgccattctcctgcctcagcctcctgagtagctgggactacaggcaccagccaccacgcccggctaattttttttttgtatttttagtagagatggggtttcaccgtgttagccaggatggtctcaatctcctgacctcgtgatccacccgcctcggcctcccagagtgctgggattacaggcatgagccaccgtgcccagccagcagtcttcttaaatgctgattttcaaataacttatggaaataaaaatgctttgatttttaaagattgtattgtctctaatttttctctaacatactttattatttaaaaatatctacattattagattaaatattatatattggcatttgaccactttatttgtactcctaaaagttgatatatgtcaggtggccagatatgttatttgggcccatttgggaaaatacaagattaccttatgtttggggtcatcttatattagggcatatgaaaaatcactagccaaaccctagtttttacctctgttccttttggatgacaaatggctcttactgggaaaggacccagctcagttaattatttttttgagcccagcggaattaaaaaggggattttacagagaaactgaaaatgagtttttgtgctgattgtgccactaattgtggtcttagacatattaccttccttctgagcgtccatcctctctactaagtggggacattgaacaaggcaatccctatgttcccaagcaaatctgtggttctctgaccataaattgatgatacaatcagggttagtcacgatgtcctattaaagagagaaaatgagatcatattacagtcagacaaaaatggagctagaatcaagttaatggatagaaagtgtatttatagttttccttagtaaaaattttaagtgagaaagtaaaaccataattttaaaaattgcttatttggctctgcttgtagccatctgtgtttcttcagcatgcaattgttattttctcatatcttcctcttactggctctgcagaattaatcttattggttcctagaaaaaaaaatcacttttaagcatatgtgggagaaaacattttaaaacctggcactcttgcaagttctaaatgacatgagtaatcatttcacaaggaagctaacatcccccttcatttttgtggccctagaaaaatgcccataccaatatagacagctttgatgtgaagacggatttgtttctgtgtatagaactctccttttagtgatgcaggactcacattgccagctcaagtgtctctgtggtaattttatacctagaggtatattttagaggggaatttatttgaaattgacttgaccctttattttccttgatatttttagatattgaaaaagaaaagtggtttacatggctcatggaggtattttaagagcagagagcgaacgatagttgaaaaagcagttttcttctgaatgacagtctgaatgtaaagtcaaacaaacccaaaaagtccctccagtgtcataagaaaagcagaaataaacctgtttatagactatgaagattttcttttaaataatataatatgtcttacagacttctggtttcatttagaaggtagtctttatatgaattagaatttgccttgctttatagtcagaataaaatttatattccattttcctggtatttctcctgggtacatcattggtttgtggatttttattgtatttttttttttttttttttttttttgctggaaagaagtactggttagcataaaatgtttcctcccatatcgtatatgtgaagatggtatggtggcctggcagaacttggggtgagagagggagagactcttagttacatggtgactctaagcaactctcactggtttgggaaagagtgtctgtttattcttggaggtcactgaattgcaatttcactgttgtctccaaggcatgaggacatttcaaaaaatattttccttcttttcctctgcaggaaggacgtttcctactcacccttacttttcagtacagcttgggccaggacagctgtcactgtttaacctcctgaaagcctattctttgctggacaaagaagtgggatactgtcaggggatcagctttgtggctggagtcctgcttctgcacatgagtgaagagcaagcctttgaaatgctgaaattcctcatgtatgacctcggcttccgcaagcagtacagacctgacatgatgtcgctgcaggtgaggcacttgtgcttcccgaggaaggtgtgagactattaccagaaatcctggccctcttctcaattattacagttcagatttaaagaaatgtagagccattgtcttagaacttgggtaaagattggggcatgttttagttcacttagtgtgggatttgctatttaggtaaacttctaagtgtatgagacccagaggcagaataccttttccataaaattcctgaagtaagtaaataagtaatttaagaaaggtaggtgatgaggacccagtcctttatgccctaagtctatgggttacatggagaaggtatcaaatcatctttattcactttttctcaacttctcagttgaaaaggctcacagatcttttgtttacaatctgaaagtatctttatccctttacttttgagtacacaaatagcagataccatgttatggttctttttgaacttatcattgatatctcccctcctttatcttcatgtaagataggcctttacagaggaaaaagtgtgaaagccagtggtgccttttcagtctgctttgtgtgtgtgtgtgtgtatgtgtgtgtgtgtgtgatggaatcttgctttgttgcccaggctggagtgcagtggcacgatctcggctcactgcaatctctgcctcccgggttcaagccattctgctgcctcagcctccccagtagctgggattacaggcaggtgccaccatgcctggctaatttttttgtatttctagtagagatggggtttcaccatgttggccaggctggtgttgaactcctgacctcaggtgatccgcccgcctcagcctcccagaatgctgggattacaggcttgagccactgagtctgcttttcttagcaggctctgaagaagcaccattaagattttccaggtattttgagtggggtattaactgccactgctgtctttagcctacctcagactccctgtttgcacatttctctcctagttttcacttctctaagtgggttggttgctaataagcagtttaaattttgtctatagatacttaaacaaccactgcctggcaatttaaagctttcagtggttaaaaatataaaagaagactttaaagaggattctcaggtttttcctcccttgaaatgaggtatgcatgactcccagttcatcataatactgtgctttagataagaagtaatagtttaaagatgcttttaaaatatactatttttttctgtttcccagagatgagttttttgcctttaatatctcagttgccaatgtataacaaaagaattgtatttttagtctgagcgttatagtaaatgatattttttgagagtatgaatggagatgaagtattccatttttctttactttctgaaggtaaaattttgactggggagatagggctttgctatcaacattaggttttctggtgtgagttcatatgatttgattcctcattgatgactattcgtaggtttaacaagtcaaataacaactgtggaaagttttattttttattcctaaagagtttacctgtatctttttatctttttatcgttttttttttttttggagacggagtcttgctctgtcacccaggcaggagtgcagtggcgcgatcttggctcactgcaacctccacctcctgggttcaagtgattctcctgcctcagcctcccgagtagctgggattacaggcatgcactaccataccctgctaaattttttgtatttttagtagagttggggtttcactgtgttgggcaggctggtctcaaacttccggacctcaggtgatccacctgccttgacctcccaaagtgctgggattacaggcgtgacccactgtgcctggtcacctgtatcttaatatcagataggaatcagatggtcttgtaaggaattcaataattctgattttcagaaacaacggtttggtagctattattagaatttcaaagatacagggaagtacctgtgagtagtgtttgatctgggtccacagataaaaggataatagctatcagtttaaaaatacaatgatatttcaacttaaaaattattcatcaatttgacattacaaaaattcatgtaaatcggatttatacattcatttaatatggactgtaagtaccaagaagtattttatgtctataattttgaaaatgcagatgtttaaaaatctttggtgacagcattgctgtaggccgcagtattggggaccttattctgggagagtaggtccttttgcattttaaagtgagatataacacttttccactttctagagcaggaggtactgttttgggtatagccaataggatgtttagaagtgtgcttaaatgcctcttgcagtgggtttggactcactccacaggatttctgatttcttgcttctctcttggtggcttgggtgctccaggcttcagttaccttatctgtaaaatgtgtaaaatcttgcttcagttaccttatctgtaaaatgtgggggttgaggtctttttcaactttaaatacatgtatcttgtcacgtttgtttctgctgctttctgtgttaagcataaagacattatatcttttcctctgaagtttttggtctctacttttttttcatcttctctcccctacccttatctctctctgtgcatctttccttctccagttcacctctttaatctgcaggtttgccttggtatctataaggtggaattgaagaattatttgttcttagaaaatagaattttatcattaaagctttctttgaaggaagcctgaattgtgttcttatttgcccaaatatcccttgatggaagaaactctcttaactcccatttgagtatgtgcggcagggtaggtgggaaataagattctctttaaaaaattacatgttgaagtattgcttctttttataatcacaagtgaacaagaacagtgtgcttttgatgacgtgctttctttttatgctgctaattagacttttttgatttttgtgcttaccaaaatactaactcttttgttgatagatgctcagaatttctcgtttctacgatgtaaatggtctaaaggaaatgtatgttttttttcaacatgattttttgagataataatctcattaaaaaaaaactttgactccagctaagcttcttattttatagctatgacttcctgtggctctttaactcccttttatttacagtttgtgtggaaacggagtttctaaagatatttgttgtggataaggattgaacaaacaattttttgtatttttgcatagtttttgatttttttccaaaggagtctgttgatttttagttctgtactctagaaataattgttgaattcacaacataattggttatttttatgtattgtcatagagctatttaagagtgatgttttaataatttcttctagtgaaagaagttctgctagatttaataaaacattttatacatttttacaccaaaatatcaagccaatataactgatcagggaaccatcacttatctcttaactgtgtggataaaaatttaaattaaaacacaattcacaaatttgtttgttacttactactgctttatctgtagtatcacagatatgagtttaaaagtttctgtatgctgtctttatgatgttttctgaaatgccaataaccaactcagtagccaaatgaaataattttttcttttagttctagaaatattcagaaacaactgcactttttgccttaatcacgtttgtcatgaaaaatatgctgctggaataacttgaatattagaaataaatctcaagcttctggccctgtaacattcgaagctttaattctctcctagcagtgcagattgtctggagagccagaactctttcataaatcacatgctggtctcagtaaatagaaataagcttctgcactgaacatggtagattctttagaatggaggcttttctggaattagtctgaaattagaagggattttctatgaggttcctgagccaggactgttctcattaaattccaaaagcaatgcctccctacagaagaaaaaattccatttctttgtatgtatgtgatgctcaaacacacgtgatagagaaacttgctcagtcttcttagatagactttcagtgacttgctttatgaattcagttaagtgaacttggattttagtatcaactttaaaatcataaaaataaagtaatactacttatatatgtgaatttgttattaaatattagaataaaattaaaatcagtgtgtttgatgcacatgcagataaatgcataatattttttttcttctccaaattaactttagattcaaatgtaccagctgtccaggctccttcatgactatcacagagatctctacaatcaccttgaagaaaatgaaatcagccccagtctttatgctgccccctggttcctcacattgtttgcctctcagttttcattaggatttgtagccagagtttttggtaagagatacctgtaattaaatggaacagtattatttattccaaggactatacttctacttctagccatatgatgcccctattgttctatcatgtgttatacagaatagcaaattgctaatggaatttaataaatgtgcctggctgtgttctgacagtaacttaaaatcatacttgtcttacataaaattgaaattaaaaaggaaagaggaattgggctcctgtatttgagtcagctgtaatggagctcttattttcatttgtgcctaaaaatcagagagtatactcctaaaatctggactagggacagactgtgtataattttccagatttttatatacatgtttctacccccattgtcttcttcatcttgcattcaaaacacagagaaatatgttcttaactgtatcaatgttgtttctaatggcatttcttaacctgactttttgttgttaacagaataactttacatcctgtttcattgctcatgtgactcttctttcatgccaatgcagtgctgggggacagtctctaagactggtggctcagggaaaacactaagtacagtcagtagagctcagggcaagttactgagtaactgccttgctctaagcacagtgtttggcattgggaataaaaagagagtgtaacatggtttatgtcccctttggaggcccttaaatctattcacaagtctttatactagtctaagtctgttatttaaaaagcaaaaattaaaacaacaacaacaacaaccaactcttcatcagaggtttgttctaatgatgttgtttaggacctcagtagccttagaaagggctcccttaatttttatgttctgataatctatttagtagacatgggcaaagcagtcagtattcactcacaactgcacttctgttaaattggagctttttgtcaaattgtattggcgccattgtaggtcattgccagtgtttgaaaaaatgaaacagcatttagtgaagatattagggaatattacaaatagtaaggaaatatgttgtttggagaaatttgttttgaggatatatgtgtaatgtatatatataccagattacaacatatgatatctttcttattgagggctgtggtttaaaagttaaacactgcattagtgttactacaatttataaaatgcagcaaaagagtaaagtgaaaatgcgctgaatcaaatgttcaccagatttctcttgtttattgaatatacactattgcttttctacagtgacattttctctggagcttgggttcctattaatgggtattctataaatccttttgtttatatacatttttcttcccagagaatagtgtatcaaatcaaaatgatgtttcagggcacctctcttttacttacccttggaagcttgatatcaagagttcaagaaacaaatgtcctcagtatcagttttttgtcatgagaatacaaatgatgctgttggctatacaatagctgttcaactctcttctttgaatttataaaacaatggagactggcaggaaatggaaagatgcatgagcaagaagaattactatgaaataatgattctatggttccctcttcattaaagactccctgttgtatattattgattaaagaatgacatagattgagagaaactttcataaaaaagtactaagtacttgatacttttatttctttctttttttatttttctaagactgagtcttgctctattgcctaggctggagtgcagggcacaatatcaattcactgcaacctctgcctcctgggttcgagcgattctcctgcctcagcctcccgagtagctaagactacaggcatgtgccaccacactcagctaatttttgtatttttcgtagagacggggtttcaccatgttgaccaggctggtctgtaactcctagcctcaagccatccacccacctcagcctcccaaattgttgggtttacagatgtgagccaacacgcccggcctagtacttgatacttttcaaaagtattgcatgtttgtatttgtaggaaagcagggcttagagttagggtagctcttatatttctctcctgattgaggttgtatgtttttcatttgttttaatttttctgttaatgtttttttttttttaatttcctggtgtggtatagatttaattacatagctggttcatttactttttattatggtaatgagagtttgaatagtactcattggttatgttaatttgtttttgtattcctgttgtgaagaaaaatctaaatatcaattgaataactgtccttgaggtttacctagtctccattaaatttggcattaaaaattacaagtagttcatggacagagatatatactttgtccttttttaccctggctttatctgagattcttaagaggaatattaaaacatctgcttatatgtttagttatattgcttttttaaaaaaaagctagatgcttttgaccagttttcttctgcaaaatacataaaacaagtaaacaaaaacctttagcacaaatagcgtgctttttacaagagtggatgcatagttttgatcatgaaaattatatctcttcttttagatattatttttcttcagggaactgaagttatattcaaggttgcactcagcctactgagcagccaagagacacttataatggaatgtgagagctttgaaaatattgttgagtttcttaaaaacaccctacctgatatgaatacctctgaaatggaaaaaattattacccaggtatgatttaaatgctaatagtattatatagcagttttctctactgaatatatattaaatgctttagcctaaaaatgtagctttgcttgacagatattttcatcagatacattttatttagaaaggggactattgtgaaatttctacactgtgacattttctatctggctatgcacaaaaaatgctgtttagtgctacgtaatgagtttttcaggaatcctttcaatttaaaccaatgctaaaactgaagatagaactgacagagtcaagaaggcctgagaataaaatcagatcctcttgcctttgttatattgttaattattttgtaaaataaacgaagaggacacgtggcaggagtacaggctttggaattagaaggtattgggtttgcatctacttctggctttttaattggttgtttggcttgcacacatcagcctaatcatccaaaccctagttgtccagaatgggacagtactggacaagttccagaatgggatgatactgatctgagaggttttatgaagcttcagtgaggagacttggtgtatcagtctttgtccctacaggaaacattctccctccgatgattcaaatgaaggaaccatctataaaggtgtgggtaggcgtaaggcaatccaacacagctgtccaggtgcgaaggaactagtaacatagggaagctgttcaaacccctgctgcagaggagctaagtggaggatataatagtgttactaggcccagggagagctggaaccgtggaggagggttctgtgctggttgttgtggtcttgttgaactaggcagagaaggatcagggaagaaatacccaacccttttctcctgccccttctgatcttgtgctggcatcttctatttgccaaagtgaaccagaagccagccagaaagtaagtgtggggaattgtctgcctgccagggtacaatagaatggatgagggcagagaattgatctgagaagcaaattgagagtaatctgcacaccgtatgtgtagtccttgactcttcatagggaccaggtgagtggtagctatatattgctgccgttcagatgcagtggacaagcttaagagcagcttgatagatttgacaattatgctttatgagcattgataaagtttaccactttcctgaaggcacttttgatggcagaaagacgatagggtttagagaaagggagtttggaaccttgttctggtgcccagccatttactagctgtgtacctatgggcaagttacaacctctctgagtctcaacctcttcctctacaaaatgggaataacaaaagtagattctattatagttttgtattattttaggagcaaatataaccaatatgttaaagtattttgtaccctgtaattcatactataatatgaactcttattatattaatacatgtaaaattttatttccattacatggaatctaaatcacaaatatctataaatagtttgtatttgttaaaatgctctgtaagctgaaaagtgtagcttttatttatatattcacttgtttataaatttttcagaaatatctttcttgactggaatcagatattatgcttttagagatttgaaatcagatatcacctcccttctaaaattaatgaggaaattgcctggctttatagattactattgggattaatgagtagaatttataggcaggtaaatttgaacttgatattggagagaatttactaacaattagagttgattactgtggaatgaaatgctgatattaagggagactttgatgaactttatttatggacactggaaaaaaatgcaaataatgcagaaaatcacaagaaaataaaagtaactataaatctcaacatctagagataatctttgaaactttgtattacatgtttctttgcttatatatacatataaaaatatataaagttgtacataaatgaaatcatactatatatactattgtggaacctgatttataattaaaaatataaagtattagattttttccagtaactataaatccatattatcatttttaatggttgtataataatccattgtatccatacccactaagtaaggaaaagatgatggttatttgaggataaccagttagtctagaaattctcttattaaaattcgaatgtttgagtatctctattagtaagtagtagagtaagtcaggttttttgtggtttcttttctcttctcagtgttagtatagacaccattgcttgaatagcagctgttgtctctccttccccctaggaagtttggagtaactgtcctctagcttcaaagcaaacgaccttcctatttagtggtgacatgggagagcagtagcagccctaattaaaccttacagccctggacagtgctcacagtgtgcaattttgaggattctctgtgtggtacaatatgtaaatgactcttaagaggcttacagggaatagcaaatggatgcaaaattttattaagatctttctgctccattggcaaataaattagaaatgcttttggttgctttattacagtaataccctatgcaattttgcttactaatcagcagagattatctctaacataataattactcaataactaatgttgtttatctagtatactacattttgggagacagttactagattatgaatatcttagctgccaaatacacttggacattaatttattctagggacttagcttcatgagaatgtttcaattgcatagaaataatctatctgttctgtttttaaagaaaatcttctttcacagaaagagctatctgtttttatgttgacagtgtaaactatatctaatttattcttgtattgacagttacacttttttttgcttttttatgctttaatgttcttcattaataagtatttggaaatatacatgaaatataccaagataaacaggctgtatcttgttatacataccaaaggctagcctaacccatgatactttcatggcaggtttttgagatggatatttctaagcagttgcatgcctatgaggtggaatatcatgtgctacaggatgagcttcaggaatcttcatattcctgtgaggatagtgaaactttggagaagctggagagggccaatagccaactgaaaagacaaaacatggacctcctagaaaaattacaggtaaagaaataaagatttgagcaaataagtacttcaatgcctcctgcatgcacagaactacctcaggaatgaaagggatatgtgcgtggaatgaaccattgctaaccaagagcccatgtatcagactgtccaagtgctctggggctacaaatgacatgttaaattaaacattacttggaaaaaaatgcaccctcacaaaatagctaaatggcagttcaaagtggaatctgcttaaatacctgttgcatgttatagatatttggttaaattaaagggaggaggaattgaatgtaggaaattgatgaagttgtgaaggacctgggcttgagctggaatctggagggttggtggaagaaatgagtgaggagggtctttaagtcaggctgagtaggagggtggcatcaatcagaaggacatggcagagcagcaaagttagcctagtgtcaatttaagatagaggttggggagaggtagggtaaatatgatagaggcagaatcgtaagtgactttcagtgtcaagccaaagaacatggctttaatcctgtcaagagggaaatctctcaaagtttttgggccatgctgtagaaagatcaatctgggaaccttgacgaggacagattgagatgggagagaaggtaaggaggcctgctaaaagtcacttgtgaaaatctgttgcggatgatgagagttgtctagactaaaatggaaattggaagagagggagacatgtctaggtaaattgaatcccatgcaaatgttacatgtaatattaatacatcattcctgccatcagggagttcacaattatttgagaatataaaatactatatatctgtctctaagcgcacacttatacatgcaataagaaatttattataaagtcatattcggtatttgcaacttgtatgatgtgtgctatgtagccatgccctgaggggaggggcttaagagtgatcacaggatgggggctagcaggtgacccttctgaagtcttcggggagatgacttcaggggagtttcagtgtctaatggctcctcggtttccacttactcctcctctccatttccccaacactgcacctggctacaaactggaaaacactaaaactctgcttctatatggtgagtcccctgtcaagaccagtcaagagagacaggttagaaatgagggatctctaaagtagttgcttcccaagaatgggaacactaaacttccttcgctttgtcttacattggctctggctcatagaaaatgtaaatctttttttctattcaaaaaagggcaacatactctattttcaaaaagaaaactaaatggttagtatattgtccatttttagttggataggtcaatggcgattaattatttgccccttattagggaaggtgggtttgtacctgttttataatgattcgtctgaactgttgtagactttttcactgacagttcagtgtagtcatcatcagttacttggccacccctcacatctataaatactgatgaaagcccaagtgtatgtttagagaacgccgtatttcagtcagagaaggaaaatctcttttagcactgcaatagtgtcaggaatctcctgtttctccttcagccaggccagatcccactcactcaggggaacaccagtgggtgtagaataaggattcctactgttggtgaggggggtgatttagtattgaattattcgtgtgttcagtgagaagagatgaagcatggtagttccatagttacatctttgtgaaacctaataaatcatcgtttcctgtaggttttcagagtatttgcttcacataatattttattaagtaatttgaagtaattggttaatatgtgtaaggactgtctcctactataatgaatcatttgatttggaggattttttcccccccaaacaggtagctcatactaaaatccaggccttggaatcaaacctggaaaatcttttgacgagagagaccaaaatgaagtctttaatccggaccctggaacaagaaaaaatggcttatcaaaagacagtggagcaactccggaagctgctgcccgcggatgctctagtcaattgtgacctgttgctgagagacctaaactgcaaccctaacaacaaagccaagataggaaataagccataattgaagaggcacggcctcagcagaaagtgctccttagaatactacagagaggaagagcctgcatgtcgctggcccaaggctggaccctgaagctgatggaaccacctaatactggtgctgagcgcctagtcacagcaggtggacctcgtgctcatcagagcatgccaatcctaagccattggacatatgtagactggtttttgttgttgctatgtacatataaatatatatataaaatgaacatagttcatgctttcagataaaatgagtagatgtatatttagattaatttttttagtcagaacttcatgaaatccacaccaaaggaaaggtaaactgaaatttcccttggacatatgtgaaatctttttgtctttatagtgaaacaaagccagagcatctttgtatattgcaatatacttgaaaaaaatgaatgtatttttttctccaaagaacagcatgtttcactcaatggtgaaaaggtggaaacatttatgtaactttatgtgtatctgtcttgatatctactgacattgtctatatgaggaaaatgattactggtcatgctcctgtgagttttttgggaaggtagggtcatttctccctgcctgctttgtgccaactagcatgttgcatctacatgcattatgagtctggttaggcattactttaaacatacataaagagacagtaggacattgtggctgagtctacccagctcaaggtaaaggagaatgttgctaattttttagcaaactagaccagcattattactcaaactaaaaatatcacacctgaaaaatttaatttaggacctaaaatgtctagattagctttctgctttttttatttgaataactcattcagttgtgaatgaattcctctttatttggtgccacagtcaccaaatgacaaggatttgccactttcccaccaaattgtgagtgcttgtaatttaggtctctctaccttaaattcagtataaggaaacgtaattatgattgattttttccaaagatgacaagctgtgttgaaatacattttttcttttgaccaattgacagaatctaataagctttaataatcttccccttttatgtgaaaagttttgagaactgtgaaatgtttaggaacaaactgttgaaatccattggaagggaaaaaagaaagtggtaccagtgttaccagctcaactaaaacctgcaattctgcatttcaactcttcacttcctcagcctacaaatagctcattagatgacattcacgcatgctgggtataggcaaggaaagtaattttcaaagtacatttgcagttctctttttcagagatgattctatgatagtgcctctgaaagttgatgcagcatttttgcctttccaaaaagtatttatcctcactgctttttgcagtacttgtattttcacagatggattatctggggtaattttcttcaaagggagtttgttatacacagtgaaaatgtattatagagtagaatagtaaagctctaggggtttcagaaagctttgatgaacagatgacaaacatctgaaaccccctccgcactgttacccagtgtgtatataatgacttgttatagctcagtgtgcccttgaatccatacagtttcttaaaagacaataaaatcttattaataaagttaatgtaacttctaagttctagaaaatgctgattctgtctgccccattcaattgggggctactaattgatttgttgcttggatttcctgagaatttctctatttgtaggaggggttttttctttttacggtctgttgatgacaattactttatgggtgtgatgcaccgatggtagccaaggaatctgttggggaagttcggaaagaaaccttttctttcttttattcagtttaaagtaaactttatcctggatgtttagaatcaacattaagagttatattatggtgttcagagattaagctgacttggatacaatattttcttttgaaaatgaattttctttttcatttgtgatttttaaaaaatgttgcaccagttatgcttcatgcatcgttacatcttcatcaggttaatgtaatgtctagttcctttgcaataaatatattgctgcagctttctt

SEQ ID NO: 11403 - DNA, 7513 bp, Homo sapiens
aggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgcccagaatgcacagcgatggtaagagacaccgtggatattcttcatcagaagctttaatcaaagaagatgagcagaagacaatcactggctccctgttaccagaaagccaaattttataatgcgggtgaaagaaaaatatagattaaaattgctgggcactgaaaaggggtgggagttggaaatcagaaagaaagagaaatatttcattatgttaatgaagaaaagagaaaattgaagcataaatgtatttttgaagtagttattcggtagctgagaacttattaagggatttaggaatttaacctcctgatgtggattcctcaaagacttgatcggagaatactcttgtttcaccattatgttggtacagtatagtaccattattttatgttgtgccagtgaatccagttgccagaaataagtctgaatgttttcatgcatctttttcttaaatgcaagagcttctactgactcttaacaagcatgcttacccaaattttgttgcatgcttttaagtagcattagctatgcacacttgacatttttaaatatccctttcctagtgtaccagccttcacaggataagaggactgggaataaagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaaaaaaaaaaaggacacagatcaaaaaaacacccaaaggcttaacagaacatggaaagttcccactaagttgtgtgtgaggaaatcctcatcttgtattttaagaatctgcagatggcatccatagatacagtacagtatttactgtcaatgcaaaagaatcagtgaggttaaagtagtggaagttttccctatgagcctacagtctgtattgtttacattaagaaactctctattattgtgttgctattttccatggagtcacaggcacactatgacttctgctcccaaatacatatgaccatatgtaaataccaccttgcatttcattgttcttcacaagtgctttgtgcccctttaattaaaaacacatgaaatgaataacaaaacaagacccaaatagagtttattttattctcagagtttggactacaattttctaagatgtttctggttcaagactgtcattttctatttcaaccgaaaagtaagcatttaacccggtgaataaatgtagatcctgccattcattggtattttaaagaaccacttgaaatcggatcattttatttaaaaataaaaaatgttaatgccagttggcctactataaaaagccaggaccatgttagaattaggaaaagtaaccagcattactgcacctcttgttagactctgtgcattaataaaacacacctagagtctgttgtcatttcactaataggataagacaaattttttgctttgaaaaaatttttctgcatgcccaggtgtctgtctctggctgaggttttgtctattttacagtgtttcaatccagccataaaaattaacttgtgattttttttttcccaaagtcatgcttttccttaattatatttttattttattattttagtgtcttgagaaaaataccaagagatataatgtttcttttaattgtctatgcttaatcatctttaaacactttttaaatttctaaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacatttagaaaaaattttctaagttagagacaagtttaaaagtaaaaaaaaaaaaaaattagccactgctagtctactgtttaggtaatcggaatcaccaattattttattagaatgatggcttgagtaaaaagctgtggaaagaattaaaggattatgagctaagctgtattttgcagaatatggttctattttagtagagcagagatgagacatatccccaccggccacccagccagaggtctcctacctgggggccctaaagggatgcagaggtctggcccaccctccgtgcataggcacctctgtccaccaccagcgtttcagcaatccaaccagtaagcatatgctgtataggaaaaataaaagtgtgtgggaattggatttcttttgttgtaacacaattccaggtttttggctatttaaagtttgacattaggctgacatcgaggaagtaagtgggttttcctgagttcccaagatatgattaaggaagaaaacaaacccatctccaggaagatcccaggcaggaaagaactagacagatgtagaaaccaaagtgaccattttagtttttttattggagaataaaacattaatattagggtattaagaagatgctcagcaagcttgatcagaatcttcatggtcattaccaatcagtctgacaaaatagttctctggtagtcagcattcatttaaggcagcttgcctgataatttcctgtgttatgtgaagtgtcttgcactttcacatgttagctataattccttaaattacttaactgaaatctgtaatagagaaccattttggcatttgaacagctattttacatggagaaaaagcaaacacatctgtttgctttacccagaaaaactgactttctggtttcatcttcatattgtttagtagcataatgagagtagtcctttatctttctctaatgttagtaaatatattctgttagtaggaagttctgaaattgaagggaaaatatatttaaggaaataaaggaattcaatacacccttcaaaagtcaccaaatactgaaaataagagatgagtccttaaaacctgagtcaaaaaaggtccagttttacagcctgcaattaattcagggctgcgttggcattaaaaaagaaaatatatatatatatatatatatatatatatatatatatatatatgtatattatatatacagtagcttacacttaaaagaggaaaaatttgcattaacattgcatattctgatatgtaccatattaacacataacaggcattttatttatgcttcatagaatcagacagacacaactttcaaaaatcttactgtattcacaatagaaaagggtagtcttgtctaccacagaggagtatgtccacacttaataatgaaaactttcttcctttcctgcccaaaaatttcttcagtctgttattatttttaagtgccccttgctgcaaatttcaaacagagcaagaaatcttcctcagagtaggtggtatgaaattaaactagtacaatatatatgaattcatgtcatttacccctgagtatggtagaattgttaaagcattcttaaattccaattatatgaagcctatcattactaggaaaagtatattctttgggataagaattaatttcttcacactattagagcatgttgtgagtagtaaggaactacttagatgcaatttatttacagaattgtcccttgacctcttgaaatggctagatctttcactactgtgtaggtagtctctacttactggtaggatagattacattgctttactggacaaagcagaatgaacttatataactaaaatatgtcctatattggctgggtgcggtggcttacacctgtaataccagcactttgggaggccaaggtgggtggatcagttgaggtcaggagttcgagaccagcctggccaacatggtgaaaccctgtctctactgaaaatacaaaaaaaaaaaagtatctgggcatggtggcttgtgcctgtaatcccagctacttgggaggctgaggcagggaaatcgcttaaacccgggaggtggaggttgcagtgggcccagatcgtgccactccactccagcctgggagacagagcaagactccatctcaaaataataataatagtaataatgaataaaataaaataaaatatgtcctccagggaaaagcaatgacagagtaatcaccaaattaataggaacatctttctagagaaagtacatgcccagttagttcaaacccaggtttcaaagaagtagcactgggctctactgtaaaggcaggcagtgaccaagaggtggtggggagagaggtagagtaccctcaaatcattcccattttcacttccaatttcccttttgtaatcattaagcttaagctatgtatggaaatgcaaagcaccattagcatttctagaaagcagctggaaccttacccaccaatgcttttttgaagacagtatcatcccaaatttaaaaatcctattgtatatgttgtaaaatttctggcaaagaaatggaggatcctgtggcagctattcccacctaaagccaaccctataaggatgggtcattttttagccatgctaggatttactgcacacacaaaaaatgtcatttagcttgtcacattgctagcacagctgcacatatgagcaaagcactgttggtctgtgtttctcagtgggggtactcttggcatttggagctggataggtctttgctgtacagaatcatcccatgcattgccagatgtttaatatcccaggcccctgctgactaaatgtcagtagcattctcagtcattgtaaacaccaagaataaaaagcattcccccaggttcaaatgccctccctgggaggttggtatcacctcccctgaatgccactgtctactgcattttgaggacacagggagaaaaagtgcctatcctcaaacattgtctctgctgccttgcatttctttgggccctgaatggtttttctcccttcatttttcgagcctttctctcagtgcagctgttcttcagggaggaggttactgggcagccttggccattcagtgggcatggggacttggcctagtccctatatatatatacttaaagtccctatatatacttaaaggagagatcatacatgaagaaagcttttttttttttttttttttttgccttacaacttttctttagaaccacattattggtcataatccttgttactgtcatgaggattgttgcatgggttaaacacaaacacagactagcaatgcacttgaacaaacctggtggtctttggaaataaatcaccattagatttcacctggttatgctgcatcccataagttccaaatgaatcacctgcttatcctattaacgaagcatttaattcacacacaaatgcttgaatttcccctgtataaatgtagtcatgcgattcaacttttctaataagatttgtgaatgctgcatcatgatgaaaatgtggattaactgtgggttgcatgcctgttgttcatacttcagtgatggtcacacacaaaacaagatgagttttacttaggtgaaacattattaaactgtactaacaatacagaaacatattctctttgtcgctttttatcaccaaaactgaatggcaaatatgtcttgacattacttggatgaactgtggctagcaaaatggaattaacttagccactataattttttaaaacattaaagtttctaaattgtttttggggccgagtaacgcagagtcaataaaggtggttatattgtaagcttttagatggtgcttaagaattcttatctttttaaatagcagtattttttttttaagaataaattgtaaggagcaaataaggcagaatgccactctaccctcaggtcaattttatggtatatgaaaatgccagtaatatttgtgccacttgccaactcgggggaggaggggcttttcccttactggatacttttgttatagtttgactatgtcattatgttgtttagagagcctccacaatgagaagttgccactgcagggctaactcgccttcagaaataatcagaatgattcaagggtcaaaccactttcatcccttaaaatatagggactaatatttctttttcttttttttaaaaaaaacatttcttctgtggcttagaaatgtgccagtgtgttcaaaacatttacaccaatttcaccagatttaggacctattaaaaattcaaacaagtttcttttttttttttttttttctgtgtaacagggatttttaaataacggactatatgcattcttttgttatttcacacttcagttaaagtgataacaatggtaaactgtgatcattatcagactgactgaatgctttctgatttccagtgagtgatctagttctacgtattacacaggtgtaatatctgtgagtgtaaataactggaactgtacactgattaacatgacagtttctcttttgttgttcttatctgtactgtattatagtatgtgggtataaatatctacaagtatacacacatatgtacttgtattccactattgtaacctgaaagaaagactatgtattcccttttttaattccgtactggtatttgtgttatttaaaaagcaaaattctgctctatttagttgtataatattagaggatactttgctgtgcacaattccaagtgccttagaacattgtttagctttcctaagtatatataaatgcatatatgtataaaattgggaaaagttacctcaataaaatcattgggaaatccccagttttagtttgttccagtttctcttatatttggatagtgctcagcctttttaaatgaaaaaagaaaaaagagtaagacaacttccctaattgcctgttatttcagcttcacctaagtttttaacacctctttgtatgtaaggtcttgagacatgtaaggcctggtactttttatttaaaatgtctgtctaaagaattactgctcttaaaagaaacttccagtattttttttaacttgctatctttttatgtctgaggtatttgatattgatgtttttattgccattattatatgtaaacataaaagatagtccatttagagtttataatatagaaaataaacagacttcctcatt

SEQ ID NO: 11404 - DNA, 152 bp, Homo sapiens; identical to SEQ ID NO: 8280

SEQ ID NO: 11405 - DNA, 96 bp, Homo sapiens
cccgaaaaaaaaaaaaaaaaaaaaaaaaaaaaaaaaaaaaattaaaaaaaaaaaaaaaaaacaaacaaaattaaaaaaaaaataaaaaaaaaaaat

SEQ ID NO: 11406 - DNA, 130 bp, Homo sapiens; identical to SEQ ID NO: 7216

SEQ ID NO: 11407 - DNA, 116 bp, Homo sapiens; identical to SEQ ID NO: 7991

SEQ ID NO: 11408 - DNA, 151 bp, Homo sapiens; identical to SEQ ID NO: 7218

SEQ ID NO: 11409 - DNA, 202 bp, Homo sapiens; identical to SEQ ID NO: 7316

SEQ ID NO: 11410 - DNA, 158 bp, Homo sapiens; identical to SEQ ID NO: 7318

SEQ ID NO: 11411 - DNA, 125 bp, Homo sapiens; identical to SEQ ID NO: 7993
  misc_feature (33)..(33): n equals a,t,g, or c
  misc_feature (49)..(49): n equals a,t,g, or c
  misc_feature (61)..(61): n equals a,t,g, or c
  misc_feature (90)..(91): n equals a,t,g, or c
  misc_feature (116)..(117): n equals a,t,g, or c

SEQ ID NO: 11412 - DNA, 126 bp, Homo sapiens; identical to SEQ ID NO: 7221
  misc_feature (9)..(10): n equals a,t,g, or c
  misc_feature (14)..(14): n equals a,t,g, or c
  misc_feature (20)..(20): n equals a,t,g, or c
  misc_feature (95)..(95): n equals a,t,g, or c
  misc_feature (107)..(108): n equals a,t,g, or c
  misc_feature (110)..(110): n equals a,t,g, or c
  misc_feature (118)..(118): n equals a,t,g, or c

SEQ ID NO: 11413 - DNA, 151 bp, Homo sapiens; identical to SEQ ID NO: 7219
  misc_feature (4)..(4): n equals a,t,g, or c
  misc_feature (45)..(45): n equals a,t,g, or c
  misc_feature (89)..(89): n equals a,t,g, or c

SEQ ID NO: 11414 - DNA, 440 bp, Homo sapiens
agtgaacagcatgttcaaaagcaccgggctacaaaaatgcaaggaatgttcaggaactcacaaggagggaaaggaagccagctggctggctaacaagcataccgtaaaagtagtgccagcaaaagatggaactttaatgattccaagacaggcagttgaggcaggacttggtgactaataggaaatgctggatgagggagagaaatgaattgctaatctgaggtttctagaccaaaaatatttttaaagatagaatattaaataagacaaagtgcaaaggcaggttaacaaggaaagctttgtatagttgtggacatgcttagtatatacctgtggaacatctggggggaagcgccctgtgggcttttggaaattcaagtgtagaaagtagatttggagtcgtcagcaggagatgatgagaggctgaagctaatgaaaaa

SEQ ID NO: 11415 - DNA, 118 bp, Homo sapiens; identical to SEQ ID NO: 7220

SEQ ID NO: 11416 - DNA, 77 bp, Homo sapiens; identical to SEQ ID NO: 7322

SEQ ID NO: 11417 - DNA, 7411 bp, Homo sapiens
tattggttgaggggggcggggggattgaggaagacggaaagccgcgccgagtcgccgggttacctccggggtgaaccatgttgagtcctgccaacggggagcagctccacctggtgaactatgtggaggactacctggactccatcgagtccctgcctttcgacttgcagagaaatgtctcgctgatgcgggagatcgacgcgaaataccaaggtacggccgggtgatggatgggcgggggcggccgcctccttcccggcgggtccgggcgcgccgcggagccgggccggtcctgccgtggaccggaggaagcggccggctccgcagcggcggccctcggcaggggcaggaacaaaaggtctggagcgcctttgattcgccaaggtccttgtgtgcaaagcccgggacacggaggaggaaggaggcgcgagaggtctcgctgcaaggctgcgcgaccaaagcgctctttgtagtgaagtgatgaggcgggtgctgcgggggagggggcggcgggtccaagccgcgtcctctaggagggggtgcatattacggcgcgagatggagggatgtgccggcgcctggggctatagggcgccgagacggggctgcaggagaagggcggctgtgggccggggtttccgcggacccggtgcctcggtcccgggcaacgccgttcctctggcccttcttagtcgccccccactcagtcccgaatctgagtgttacataaagtaccgggtagtactccgctcggggtaggtcggccgcccccgcccagccccctccggccctcacttggagctggacaccgagtaggggccgactgcgaggggcgacgccgccggttgtagtttgcggaggacgagggcttttctctgtgtgccgtagggaagggaagggaaggggaggagcggaggcggggaaggcgcccatctgcgctgcgctcgggggggcgcgggcagatcgctggcttggagaggactgtggcaggtgagaggacctgtgcgtcgttctctgcagacctggccgccccgggtgtcagagagaggtggcgagttcgtgtccgccgggaattgttggctgttggggaaactttcctgcgaggtcagtcaaggctttgggggctctgttttgaatgtggatcaccactcggagtttactaatgtttacaaggctgcgcagtagggaaacggaagagttgggtgggggcaaaaaaaaaaattgaccgctatccccgaaagtactagacgcctctgccgggaaggcgcccctgcgcgttctatccgagacgtagcttcgcagcgaattttataggaacttcattagcatattatggaacgtcccgcctcagccccccagtagttggctgtgatgtccttcgtggaatgtccttatcattcccctgcggaacgattggtcgctgaggcggatgaaggcgggcctagcgcaataactggtatgggtctgtgtttccgctgtcttcttttttctttttcggggaggagcggggtggagggtggacgagttgatttgaacgtcttcgggtcgctcggcctccagccttggattggttcttctcgctgctggggcgggccgtgctcttccgccctgcggtgtggttggttctcctcctggcctccgccctccaaatcggcgattcccataggcggcggctctcggggtgcggggcgagtctcccgctggcctcctccccattggctggaggcctggcgggtgtcgcccctgcccctctccccgctcagcccggccactttcgggcgcggatttatagcagtagcagtgatcccgggcctgtgggctcggggccggggctgcagttcggaccgcctcccgcgacccgcggggccggctcggagacagtttcaggccgcatctctgctgacccgagggtggggccgcgcgtggccgtggaaacgtgagtgactggggctgcgtccacgagggggaccctcggcgcagaaacttttctggaaggtgctgtcctcgggccggacgggccccgtggggtgaccctggggctccggacggaaggaaggcaggggctgagaccactttgatcgttcgacgatagaaaaaagtagcgcggggcggggtgcagggttccagctgtccagacagcaaagttcatggagccactttgtcctcctgtcgttgctggggagagcctggcttgctgcttgcttcatgttcacctagggtgatgaactttttggcttcaggaaagatcacagtcctgcccccccgggagtactggagcggcgcagctgggagcgccgagaagcgagcgaatctgtcgcaagggtcacagctccttggacttcggtgtaaatgctgagctctgccgcgtagttctgaaagacttccacagacctactctgtaggaagtcaaacgtcttttgcttagtaggcatcagttgtatgttaattcataaacttggattataattagtttgtcgatttaaaatggtgtttgaggttgcttgaattatttttcaaacattatcataaaaatacccacccaccccctgggaagttcgcttcataaagaacttcagtgcaacccgtatgtaaaattaaaatacatttaaaataattggacaaaccaatttaaatgttgctacaaccccatttaatctgtaaattgcatgtgctgctgctttccatggtaatgttggtgtggaatatgtttggaaaaaaggcagtagtgtctgaagctgagttgctggcattgaaaaagcagagtgtctggaaggatggcttcctatttagcagtggtgttgttcctgtttataaatatttgtacttagtggctttgttgataaaatactttgcttggagtatcaaagaaatattaggtaacagaaatacttcttggtaattttgcgatgggatatctgtttctcttgcccacaaattaggcttcacctggatggaagcttgcttgtgatgtaaaataacttctgtgttattaaattttaaatttatatgatacagttttctgtgaaatgacaatattgtctttagaactttgattactgatgaaaagaagtgataccattttgtaaccctaaatccatttaaaaataaatggtacacatattttaacattatgataaataagttgaataaattggtattacttggatacgttgaacacagctatttatttttataattaattactatatgagactagggctttcctcctggtggcaggcagcctgcattgttcctctaggagtcttcaaagctgtctttagtttgagaatatactctggaaaatattaccatttagagaagcttcagcgttggcctgagttcttatgtttactctagtgttaggtatatgtcttataactatttggagataagatctggaaaggaagggggtaacattttagacaatccctcccactctcagcccctcccctagtttacaagtagtattgttggccaggcacggtggctcactcctgtaatcccagcaccatgggagaccgaggcgggcggatcacctgaggtcgagagttgggagaccagcctgtccaacatggagacaccctgtctctactgaaaatacagaattagccgggcgtggtattacatgcctgtaatcccagctactcgggaggctgaggcaggagaatcgcttgaacctgggaggcaggttgcagtgagctgagatcgcgccattgcactccagcctgggcaacaagagtgaaactccgtttcaacaacaacaaaaaaaggtagtattgttgccttgtttaaagagactgcaaaaaggttttaggagaataatctggtactgtttaatttaatggttactgtttgaggaaaaagaactctggaatttctgtgtatttaagtagcctttttagcaaggctgtttacttcaactagattttttaatagcttttgtttcttgagaaattgcctaattacacttgccaaattacactttaaaatcatatacactgtcctctaacatgcccaggaaggtttacatttaaatactgaagaggttttcttttgtttttgataacattttaaagtccattgactttaacagatgtgaagatgtttttgtttaagcagtagatgcaaaagtaaaacctaccagcttcgctttaaagcaaggctagtgcattcactgcagttaaaaaataataataatagcccatcacagtggtgcttctgtagtcccagctactcaggaggctgaggtgggagggtcccttgaacctgggaggtcgaggctgcagtgagccgagattgcaccactgcactccagcctgggcgacagagacggaccttgtctccaaaataataacaagtcgtaataataataaagcaaagctaggttttctggattattgtggcagaactgttcttgctgtcactaatacagagggataacatgctagaataaatgtggggactgaaactgaggacctaagtcacaaagtatcctggacctttactgttaacccggttctttaaatcatagagagctattatataaatttatacacattctctcatttaacagggtattctagatgttggtatattaaaataaagaaaataaagaccttttttatttgaaatattcaaataatttataatatattttattaatgtttgtatattgtgtataaatgtaataaataccatgtttatataatgttatatgtatattaataattgtattcaaatagaaacatttgagtaaaaatgatggcagtatagacatagtcattaatagaaagtattaataaatgttgggtcccgagcactgcacctcatttaaacgtttcctcttaatggcttcgggcgttgtcacccgtgcgtgcctgggaactgttctcaggttccctggggtggctggagcggctcctgccgctgtggaagctgggccggcatttgtgttgtgttgtgttgtgttgtgttgtgttgtggttagcacaggaacagataggcccgggagagcctgtggctggtgggctttgttctgggcaagccgtgcgctggcccctaggctccctgccagccctctccgtagacccgtccggggccgtgtgggttgtcccggtgtcctgctcgcgagtgacgcctgtccttcttgcccccagagatcatgaaggagctagacgagtgctacgagcgcttcagtcgcgagacagacggggcgcagaagcgggggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaactaaaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagtaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaagattatatgaagtttaaattctagtgtccataaataaagtttcagcggaacacagccgtgcttatgtgcgtatgtattgtctgactgcttttgcaaaacggcagagttcaatagttgcacctgaaaccatttgacttgacaagccaaaactattttctggccctctgcagaaagggtttgctgacctctgatttagactagcatctaacattgatttgcccacatattgaaagggtcagtggagttttcatttattattttttatttttttgagattgagttccaggctggagtgcaatagcgcactcttggctcaccgcaacctccgcctcccaggttcaagcgattgtcctgcctcagcctccccagtagctaggattacaggcatgcaccaccacgcctggctaattttgtattttcagtagagacgcggtttctccatgttggtcatggctggtctcgc

SEQ ID NO: 11418 - DNA, 8487 bp, Homo sapiens
gcggccgcagctcaaaggacaccgagagggtgccagtgcgcatgcgccgccacttccgcccgtgcccggccctccccttccttccgcctcccggaggacttgggtttctagtagtaagagtccggggggcattactcacggtctccccgcctcctcttcatcgtgattgggctgtcaaagtgatgttggcaagtagattggctactgcggttgccagttctgtttcgggccctacttatactgctctgtggggcggggacgaagagtcaggggctgaggagcgagttgcggtagttgctgtgtaccatggtctcggaggtttctgtcccgcggcccgttaggtcctggtcgggttttcagcgaagcaggccgctcccctgcgtttcccagcgggcgtgctgtgccgcccaacaggctctgcctccaagtgccaaaaactcctagtaaagtttgcgcctcgcccgccgtccacaccccagcggccctgacgctgtcccctccgcgaccctcgcctctggaaaaagtgacaggcaaggccacgcccccgcgagggccggcctggagcccgcagcccccagggcctgggacggtgaggggcgtgaatgcggcggggggcggggccgttgccgggggagggggccggggcgcatgcgcgctgcgcagcggggctgaatgtttcccaagtgtttgaaactggtatttgggttttccacgttggacaagtgcggctcggcggccagcggagcgcgccccttcccgctgcccgctccgctcctctcttctacccagcccagtgggcgagtgggcagcggcggccgcggcgctgggccctctcccgccggtgtgtgcgcgctcgtacgcgcggcccccggcgccagccccgccgcctgagagggggcctgcgccgccggccggggcgtgcgcccgggagccaccgccaccgcggcccgcgccctcaggcgctggggtccccgcggacccggaggcggcggacgggctcggcagatgtagccgccgggccgaagcaggagccggcgggggggcgccgggagagcgagggctttgcattttgcagtgctattttttgaggggggcggggggtggaggaagcggaaagccgcgccgagtcgccggggacctccggggtgaaccatgttgagtcctgccaacggggagccagctccacctggtgaactatgtggaggactacctggactccatcgagtccctgcctttcgacttgcagagaaatgtctcgctgatgcgggagatcgacgcgaaataccaaggtacggccgggtgatggatgggcgggggcggccgcctccttcccggcgggtccgggcgcgccgcggagccgggccggtcctgccgtggaccggaggaagcggccggctccgcagcggcggccctcggcaggggcaggaacaaaaggtctggagcgcctttgattcgccaaggtccttgtgtgcaaagcccgggacacggaggaggaaggaggcgcgagaggtctcgctgcaaggctgcgcgaccaaagcgctctttgtagtgaagtgatgaggcgggtgctgcgggggagggggcggcgggtccaagccgcgtcctctaggagggggtgcagattacggcgcgagatggagggatgtgccggcgcctggggctatagggcgccgagacggggctgcaggaggagggcggctgtgggccggggttcccgcggacccggtgcctcggtcccgggcaacgccgttcctctggcccttcttcgtcgccccccactcagtcccgaatctgagtgttacataaagtaccgggtagtactccgctcggggtaggtcggccgcccccgcccagccccctccggccctcacttggagctggacaccgagtaggggccgactgcgaggggcgacgccgccggttgtagtttgcggaggacgagggcttttctctgtgtgccgtagggaagggaagggaaggggaggagcggaggcggggaaggcgcccatctgcgctgcgctcgggggggcgcgggcagatcgctggcttggagaggactgtggcaggtgagaggacctgtgcgtcgttctctgcagacctggccgccccgggtgtcagagagaggtggcgagttcgtgtccgccgggaattgttggctgttggggaaactttcctgcgaggtcagtcaaggctttgggggctctgttttgaatgtggatcaccactcggagtttactaatgtttacaaggctgcgcagtagggaaacggaagagttgggtgggggcaaaaaaaaaaattgaccgctatccccgaaagtactagacgcctctgccgggaaggcgcccctgcgcgttctatccgagacgtagcttcgcagcgaattttataggaacttcattagcatattatggaacgtcccgcctcagccccccagtagttggctgtgatgtccttcgtggaatgtccttatcattcccctgcggaacgattggtcgctgaggcggatgaaggcgggcctagcgcaataactggtatgggtctgtgtttccgctgtcttcttttttctttttcggggaggagcggggtggagggtggacgagttgatttgaacgtcttcgggtcgctcggcctccagccttggattggttcttctcgctgctggggcgggccgtgctcttccgccctgcggtgtggttggttctcctcctggcctccgccctccaaatcggcgattcccataggcggcggctctcggggtgcggggcgagtctcccgctggcctcctccccattggctggaggcctggcgggtgtcgcccctgcccctctccccgctcagcccggccactttcgggcgcggatttatagcagtagcagtgatcccgggcctgtgggctcggggccggggctgcagttcggaccgcctcccgcgacccgcggggccggctcggagacagtttcaggccgcatctctgctgacccgagggtggggccgcgcgtggccgtggaaacgtgagtgactggggctgcgtccacgagggggaccctcggcgcagaaacttttctggaaggtgctgtcctcgggccggacgggccccgtggggtgaccctggggctccggacggaaggaaggcaggggctgagaccactttgatcgttcgacgatagaaaaaagtagcgcggggcggggtgcagggttccagctgtccagacagcaaagttcatggagccactttgtcctcctgtcgttgctggggagagcctggcttgctgcttgcttcatgttcacctagggtgatgaactttttggcttcaggaaagatcacagtcctgcccccccgggagtactggagcggcgcagctgggagcgccgagaagcgagcgaatctgtcgcaagggtcacagctccttggacttcggtgtaaatgctgagctctgccgcgtagttctgaaagacttccacagacctactctgtaggaagtcaaacgtcttttgcttagtaggcatcagttgtatgttaattcataaacttggattataattagtttgtcgatttaaaatggtgtttgaggttgcttgaattatttttcaaacattatcataaaaatacccacccaccccctgggaagttcgcttcataaagaacttcagtgcaacccgtatgtaaaattaaaatacatttaaaataattggacaaaccaatttaaatgttgctacaaccccatttaatctgtaaattgcatgtgctgctgctttccatggtaatgttggtgtggaatatgtttggaaaaaaggcagtagtgtctgaagctgagttgctggcattgaaaaagcagagtgtctggaaggatggcttcctatttagcagtggtgttgttcctgtttataaatatttgtacttagtggctttgttgataaaatactttgcttggagtatcaaagaaatattaggtaacagaaatacttcttggtaattttgcgatgggatatctgtttctcttgcccacaaattaggcttcacctggatggaagcttgcttgtgatgtaaaataacttctgtgttattaaattttaaatttatatgatacagttttctgtgaaatgacaatattgtctttagaactttgattactgatgaaaagaagtgataccattttgtaaccctaaatccatttaaaaataaatggtacacatattttaacattatgataaataagttgaataaattggtattacttggatacgttgaacacagctatttatttttataattaattactatatgagactagggctttcctcctggtggcaggcagcctgcattgttcctctaggagtcttcaaagctgtctttagtttgagaatatactctggaaaatattaccatttagagaagcttcagcgttggcctgagttcttatgtttactctagtgttaggtatatgtcttataactatttggagataagatctggaaaggaagggggtaacattttagacaatccctcccactctcagcccctcccctagtttacaagtagtattgttggccaggcacggtggctcactcctgtaatcccagcaccatgggagaccgaggcgggcggatcacctgaggtcgagagttgggagaccagcctgtccaacatggagacaccctgtctctactgaaaatacagaattagccgggcgtggtattacatgcctgtaatcccagctactcgggaggctgaggcaggagaatcgcttgaacctgggaggcaggttgcagtgagctgagatcgcgccattgcactccagcctgggcaacaagagtgaaactccgtttcaacaacaacaaaaaaaggtagtattgttgccttgtttaaagagactgcaaaaaggttttaggagaataatctggtactgtttaatttaatggttactgtttgaggaaaaagaactctggaatttctgtgtatttaagtagcctttttagcaaggctgtttacttcaactagattttttaatagcttttgtttcttgagaaattgcctaattacacttgccaaattacactttaaaatcatatacactgtcctctaacatgcccaggaaggtttacatttaaatactgaagaggttttcttttgtttttgataacattttaaagtccattgactttaacagatgtgaagatgtttttgtttaagcagtagatgcaaaagtaaaacctaccagcttcgctttaaagcaaggctagtgcattcactgcagttaaaaaataataataatagcccatcacagtggtgcttctgtagtcccagctactcaggaggctgaggtgggagggtcccttgaacctgggaggtcgaggctgcagtgagccgagattgcaccactgcactccagcctgggcgacagagacggaccttgtctccaaaataataacaagtcgtaataataataaagcaaagctaggttttctggattattgtggcagaactgttcttgctgtcactaatacagagggataacatgctagaataaatgtggggactgaaactgaggacctaagtcacaaagtatcctggacctttactgttaacccggttctttaaatcatagagagctattatataaatttatacacattctctcatttaacagggtattctagatgttggtatattaaaataaagaaaataaagaccttttttatttgaaatattcaaataatttataatatattttattaatgtttgtatattgtgtataaatgtaataaataccatgtttatataatgttatatgtatattaataattgtattcaaatagaaacatttgagtaaaaatgatggcagtatagacatagtcattaatagaaagtattaataaatgttgggtcccgagcactgcacctcatttaaacgtttcctcttaatggcttcgggcgttgtcacccgtgcgtgcctgggaactgttctcaggttccctggggtggctggagcggctcctgccgctgtggaagctgggccggcatttgtgttgtgttgtgttgtgttgtgttgtgttgtggttagcacaggaacagataggcccgggagagcctgtggctggtgggctttgttctgggcaagccgtgcgctggcccctaggctccctgccagccctctccgtagacccgtccggggccgtgtgggttgtcccggtgtcctgctcgcgagtgacgcctgtccttcttgcccccagagatcctgaaggagctagacgagtgctacgagcgcttcagtcgcgagacagacggggcgcagaagcggcggatgctgcactgtgtgcagcgcgcgctgatccgcagccaggagctgggcgacgagaagatccagatcgtgagccagatggtggagctggtggagaaccgcacgcggcaggtggacagccacgtggagctgttcgaggcgcagcaggagctgggcgacacagcgggcaacagcggcaaggctggcgcggacaggcccaaaggcgaggcggcagcgcaggctgacaagcccaacagcaagcgctcacggcggcagcgcaacaacgagaaccgtgagaacgcgtccagcaaccacgaccacgacgacggcgcctcgggcacacccaaggagaagaaggccaagacctccaagaagaagaagcgctccaaggccaaggcggagcgagaggcgtcccctgccgacctccccatcgaccccaacgaacccacgtactgtctgtgcaaccaggtctcctatggggagatgatcggctgcgacaacgacgagtgccccatcgagtggttccacttctcgtgcgtggggctcaatcataaacccaagggcaagtggtactgtcccaagtgccggggggagaacgagaagaccatggacaaagccctggagaaatccaaaaaagagagggcttacaacaggtagtttgtggacaggcgcctggtgtgaggaggacaaaataaaccgtgtatttattacattgctgcctttgttgaggtgcaaggagtgtaaaatgtatatttttaaagaatgttagtaaaggaaccattcctttcatagggatggcagtgattctgtttgccttttgttttcattggtacacgtgtaacaagaaagtggtctgtggatcagcattttagaaactacaaatataggtttgattcaacacttaagtctcagactgatttcttgcgggaggagggggactaaactcaacctaacacattaaatgtggaaggaaaatatttcatttagcttttttattttaatacaagtaatattattactttatgaacaattttttttaattggccatgtcgccaaaaatacagcctatagtaaatgtgtttcttgctgccatgatgtatatccatataacaattcagtaacaaaggtttaaagtttgaagattattttttaaaaaggtaaatggttaaattttacatgacagatattttatctattggcctgttccccaaatggccattttaaaatgcttgggtacacttctcttaagtggtctagtcaaggaacctcaagtcatgcttttgctatcaccaatcatagtgtacccatctttaatttatatcaggtgtataaatgtacatttccaaatgaacttgcacttgttatattataattggaagtgcagtcagcagatgctgttgtgaagctaatgtcacaattatgtgcaaaggtgtgcttcctgctgtatgtgagctgtaaaaatgttacgtgaagaaataaatgaaacttggccagtttgttcctctagtagtatatttaattttgacataagtaacttttaaaatttgtcttaaaaatttatacaccagcaatttagacaaagccttaagcaaattttgtattattgttctcacttattattaataatgaagtagaagttacttaattgccagcaaataaatacgtgtcaaaaaagaatctgtattcagaccctgggtcaggaaattactgcccacttgtcaagttcagcccaccatctgtttgaagattatatgaagtttaaattctagtgtccataaataaagtttcagcggaacacagccgtgcttatgtgcgtatgtattgtctgactgcttttgcaaaacggcagagttcaatagttgcacctgaaaccatttgacttgacaagccaaaactattttctggccctctgcagaaagggtttgctgacctctgatttagactagcatctaacattgatttgcccacatattgaaagggtcagtggagttttcatttattattttttatttttttgagattgagttccaggctggagtgcaatagcgcaatcttggctcaccgcaacctccgcctcccaggttcaagcgattgtcctgcctcagcctccccagtagctaggattacaggcatgcaccaccacgcctggctaattttgtattttcagtagagacgcggtttctccatgttggtcatggctggtctcgc

SEQ ID NO: 11419 - DNA, 307 bp, Homo sapiens
ggacgccggccgaccgggtgtctgcatactgtgggcggcctttccaagtgtggggagcggcctccgagaacggtgtccatgacacagggcgggaagagataaggcctagggaaggcgcccctcgggcctatccacctcttctggggctcggcactaggaagcagcttccctctcaggcccctttgtctccaagccgttccaaactgagtaccgggagacgacacaaagggagggcggtgacggatggcgcaggcgcgggagccgcctaggctgctgggagtggtggtccggccgcggaatgggtagg

SEQ ID NO: 11420 - DNA, 764 bp, Homo sapiens
tctgagatggagtctcactctgtctccaggctagagtgcagtggcccagtcttggctcactgcaacctctgcctctcgggttcaagcgattctcttgcctcagcctcccgagtagctgggactacaggtgcgtgccaccatgcccagctaatttttgtatttttagtagagatgggttttcaccatgttggccagtatggtctcgagctcttgaccatgatccgcccacctcggcctcccacagtgctgggattacaggcgtgagccaccgtgcgctgagtgatacgtggttccctttaacttcgcacatggtaaaatcagtttctttccatgatctgtttcacagtctctgtgaagctacctaccacaaagaagtagtgagtgatgactttctagaatctaagtatatggcatgtatttattataagtaaaacattaagtttgctgattgtttacttgtgataaacaattattgtgaactttatttgtgctggacataagtgtctgttttacagtgaaattccattatagagggttacttggtagagaaatgcaaattgtagttggtcatatactaaaatttgaactttttacatatcaatacttacaaataggtgtttattttcccacaaaactccagaacatttaagagtctcgggtgtttaaatttgatgagatttacccaaacaaatagtgaacaaaaggtttatgaaaataagttatgaaactaaaatacttaataaacatccagtgacaataaaaat

SEQ ID NO: 11421 - DNA, 1182 bp, Homo sapiens
ccagctccaacccacagcaattacacttctccccctggtgaaggaaacacttgcataagaataagaggttcttccacaggcattttaaaaccttttttctttcctcttctccacaatatcagcatttaagtttaagcaagtttttttatttctagaagacattttactaggcaaggaatgataagaatccctgtgtatattctctattaagctttaattgtgaaaaaggatttgtagggctagtcttgggctgtggccaatctggtatgcttcctgtgtctgtatggtttgtgctgtaagcctccatcttgttttacacatcctggggacatggcccacaactgcttgacaggactttgtttagcagtcctgccttaggggatcagccctctctggccaatatctgcatgttttcctactcctgtctcttaaagggccccacccagcgactggattttcttctgcctctctgtgtgggtactgtgtgtgatatctgtaaaaagtgcgctaattaatttggcctaaagaaagacaagaacttggatcaaattttttttaagggaagttaaaagctgtggtacctttcagttcacatgactttaatctctgagaaataaaaacagccctaaagactattggtaaaatgcaggtgagatgcaaggttttctaagtgttttgaggttaaaaactgctttttgggttttgagaactatttgacttgaaggcttcacaattggtaaggcctggggacatatggaaataaccacgctcttaattatgctgggagtcaaaccttggctgcacctagcacacaattaaacaacttaccaagtttttaccttaaaagttaaaaattgctaggagttactattccgagatgtaattgagactacaggaaatagatttatatgcaagatgtgtaagaacagtaaaatgtggtgaaattttgtaaaatattataagaaggcatggaaatgtatacttttgcttagggttaaaggattgtttaaattaggaaaaagctgaaggttcaaacaagtggtggagaattgtggaaattaatcttgcagaagaggttcaacatattaactaaattcaaaagggttataaggttataaaaggtttttgcttctgtgaaatttctgagtcatcctttcggcaaaataaataacttaatggcaa

SEQ ID NO: 11422 - DNA, 2766 bp, Homo sapiens
gagctgagaccatgccactgtactccagcctgggcaatagagcgagattctgtctcccaaaaaaacaaaaaacaacaacaaaacttgctaccacccagggattttctgctatttaaaaggtgaatttcttttctggtactaaactgtagctgcttaacttagtaaaggctgtgtttggccaggcctgtgccagaggctcacctggagtgctccacccactggcaggcaagtcctattcctattcacccaggatccccaaggctgggctgggatataaatgttgggataggaaagaaatatttcctttttagaggaaagcaagaagaaacattgcctgaaaggtgattttctagtcatttccaattagtacagaaatgttactgcctctgggtgcagtggttcacgcctgtaatcccagcactgtgggcggatcacttgagcccaggagtttgagaccaacctgggcaagatggcgagaccccatctctacaaaaaaatttaaaaattacctgggcatggtggcacacacctttattctcagctactcaggtggctgaggtgggaggatcccttgagcccaggtggtcaaggctgtggtgagctatgatcatgccactgcactccagcctgggtagcagaacaagaccctgtctcaaaaaaaaaaaaaccccaaaaactgttactactaggttggagtagcctaaggcagtagggcaaggaggtgggcccaggctggtctgtggggagctggagaatggtgactcgagtgaccagtggacaggcaggacccaggccagcattacaagcggggatgtcaggcaggagcaggggagcttctcgcttggcagctggtttatggtacacttttgaaaagtaagctcccagggcctggccctcacatgctcagtgaatatttgactgaagggtcccctcatagcttgggagtattcacaggcctaaatgttagttatactattagctaagcctggtcctttgttacgaaatttaaaaatgaaattgcaacattcttgtggaaattcaaagacatcattttctttcaacaaattcacacattcgttcatgcttcttctataccttttacccctaaagtcatccactcctgagttcctcctgctggtttcccaaactgcgcaatgactgccccatcataggcagtggtccgtggagtcggcctcactttcgcctttccccgcatctacttgtttccaaggccagtggtacttaactgggtcaagttgcctgtggaccttcaggaacagaattgccatgttcctcactgcctgcaggaaaggctccattccaagcccagtgaagatgtgtgcctatccagccgcccaccaaggatgtcatctgtagaatgggtggagggcaggggtttatttggtgtatatttttacattaaaatgcacttaatatcactttgtaaagcccagatgagtgcaaatgtgcctgtaacttcctcctttaatctgtccaggtagtatttagtctttagtcttacattttctttctccctttatttcatgaaattccttgagaaaacttcaacagtaaagaaagaaatttcattcatctcacaactcttccaaacgaggaaacttagtgaaatatttcagagcttctagatgtgaggtacaaaacttgggatcaaatggaatcttgattcactaaccaatttaagatctgacttctaattttaggaactttgggttatgaacgcttccattttatacctgtgtctagttagtttctgcctatctatccaagaagcttttatcaagggtccaccatgtgccagccactgaagtagatataaatacaaggatgtgtaaggtatggatgatggtatacgaactgtcatcttactggatttgtccgctctgttaaagatacggttccgaaaactttttaaagccctagagagggctttaaggcaatgtagcatcatatatagaggcatcaacctgttcatatctttctatttaacagaactgtgcacctgggcacaagggtgtgcacaacaggatgtgtacagcagcactgttaaagtgtagcacatccatactacaggatcttatgcaactgttggaaagaatgaagcgatgctgcactgtggtcatgcagtgatctctaagacatattaactagaaagcaaaaggtttaacaatgtatagcagctgggcgcagtgactcgcgcctgtaatcccagcactttgggaggctgagtagggcggatcacctgaggtcaggagtttgagaccaacctggccaatgtggcgaaacgctgtctctactaaaactacaaaaattagctgggcgtggtggcgcgtgcctgtaatcccagctactcggcaggctgaggcaggagaatcgctttgaactgggaggtggaggttgcagtgagccgagatcacaccactgcattccagcctgggtgacagagggagactccgtctctaaaaaacaaccccccccccccaaaaaaaaaaatgcatagcaagctgtaatgctctttgtgttttagaatagtagaggtctggaaagttgtttgcttttccccagtttttttttgctgtgttacctctgaagggaattgaggtagaggggagagttagaaggaatattcggcttttctattttatatcctcctaggtgaaatttttacaacaaacatgtactggtgtattttgaaatgtttttaaatttttgtatttcaaaataataaaatataaattcaaactgcaa

SEQ ID NO: 11423 - DNA, 513 bp, Homo sapiens
ctttgggaaggtaagcaacaaatttacatgcttacttttcctactgactactagaaaggcgtgagaattcttattttagcaccacgtgtggtagccagcatccaggatggcccctaacaacgcctgcttcccatcctcatattgtcctcccacagtgtaccagagttgttttgtgtgaacacagcagaagtgatggtatgtgacttccaagatgaagctgtaaaaggctagaacttccatcttgggctatctcttggaacaccactctgggggaagccacgtcacaagcagccatatggagaggcccagatgacaaggaactgaagcctcctacaaacaactatgagcttggaagcggatcttccagctccagtcaaatcttcagagactgcagccccagctgacagctgagagtccctgagccagaagtcccccactaaatcacttccagattcctgaccttcagaaattacgtcagataactgttttaaactaagtgttggggtgattaca

SEQ ID NO: 11424 - DNA, 14803 bp, Homo sapiens
ggagagaaggaggacgaggacgaggatgtgaagaagagaagggaaaagcaaaggagaagagacaggacgcgggaccgtgcagccgacaggtgaggcgcgggcacacgaccccacaggaggaggtggactcgtgcggtggaggcgctgccgagctcacctgtcctcgctccacaatgctgggggcctggtggcctgactcctctggccaaaccagtgggaggcaaaacagtaaacaattgggagtgcagaaaagaccatcactcgtgctcccagcacacgagctacctgtcttctaggatggctgggacgttgctttggtggttaggtttctgttcttgctttagaggattggtgtttgactcctgtgtctctattcctctggaatcccagccttgctggtgggtctgtgtggtccataactgctcagcagcgggctctgttactctcctgcaggcctgaggggcatccctgccccctagcctggtgtctggcatctcagacactgtcctgtgttcaccttatccaaatccagaccacccctggagtttgacacagctaggagacaggtagagagatgatcctaccatcaagattttgtcccacaatagaaaaggattgcaaaaatgttgagcccaaaggatgtcattgtgagcacaccatgtgcctgcctctccctgccaggagttaagtggcttctgactagaaactgaaatcaccagtgatcatgtgatgctggggaatccttgaccttaaggttcacatgggacagtgattttctttttgtttgtttgtttctgagatggagtcttgctctgtcgcccaggctggagtgcaatagcataatctcggctcactataacctctgcctcctaggttcaagcggttctcctgcctcagcctcccgagtagctgggattacaggcgcctgacaccacgcctggctaatttttgtatttttagtagaggtcgggattcaccgtgttggcaaggctggtcttaaactcctgatcttgtgatctgcccgccttggcctcccaaagtgctggtattacaagcgtgagccactgcgcccagtctgggcagtgattgtcgtgttcaaagaaatgcttagtaaaaggggccagatgccgtggctcacacatgtaattccagcactttggaaggctgagctggcggatcgcttgaggccgggagttcaagaccagcctggtcaatatggtgaaacccatctctactaaaattacaaaaattagccaggcatggtggcaggtgcctgtaatctcagctactcgggaggctgaggcaggagaatcacttaaactggggaggtggactttgtagtgagccaaggttgcaccactgcactccagcctgggcgacagagcaagactctgtctcaaaaagaaaaagaaacgggctgggggcagtggctcacgcctgtaatcccaccactttgggaggccaaggcaggcggatcacctgaggttgggagttcgagaccagcctgaccaacatggagaaacccagtctctactaaaaatacaaaattcgtccggcatggtggcgcatgcctgtattccccgctgctcgggaggctgaggcaggagaattgcttgaacccaggaggtggaggttgcagtgagccaagatcacaccactgcattccagcctgggcaacaagagcgaaactctatctcaaataaaaactccatctcagtgagccgagattgtgctactgcactccagcgtgggcgacggagcaagactccatctcaggaacaaaaaaaaaaaaagaaaatcactgttccatgtgaaccttaaatcaaggattcaaaaaaaaaagagagaaatgcttagcaaaacgaagccaggaaccaaacgcagaactgtttcttcttaagtggtacaggaacattgaaacccttgttattttaaacagataaatggatagagtagatgacttttcatgtcacatggaaactgagatgacattttctttttaattatttttaaacttaaataatctaataaagagataggggtctttctctgttgcttgggctgttgaactagcctcaagagatcttcctgcgttggcctcccagagtactgggagaagggtatagagatgacattttttttttactactttttgctttttttttttttctttttgcttttttttcatcttgtatgttcttccaatgaacaggtgactttttttaaaaaaaaaaaaagaaaccttcagagtgtgcgctagtgactgaggatctttttctttttttttttttttatcctttgagatggagtcttgctgtgtcacccatcctagagtgcagtggcacgatctcagctcactgcaacagtccacctcctgggctcaagtgatcctcctacctccgcctcccaagtagctggaattacaggcgcccgccaccacacccagctaatttttgtacttttagtagtgacggggtttcaccatgttggccagactggtctcaaactcctgacctcaggtgatccacgcaccttggtctcccaaagtgctgggagtacaggcatgaaccaccgcgcctggccatgactgaggatctcgaagggacttggaggaattctcacggggaggcagaggtgtagcagggaagcacacagctcatcagtagcttcctgacagtgctgtgtatgagccccgggagattgtcccctccccgcctacgtaggggctgtctgcagaagcggaggtgtcttcatgttgcttgtcagaggtcagaagccaggcatgtggagttggcagaggtgaagtcctgagtgccacagggcctgcacccctacaccagaaggggcaggagcctccaggagagagccagggagggagcaccccagtgtggtggcctgggggcctgcaggctgctctcccttgccatgcagcgtggttgcatttggggagactttgaaagcctgtgacaaagaagcctcactttttatctgtagaatttgatgtgacatgtctttacgtgtagtctcatggcagaactgatactgggttttgtgttttgaattgtgcgaggtgttttgtctgcacgtaaaatgaggttgccttatgtcatcccagttcctgcagagaggaactcatctgagaagctgtgaagctagatgctgggccccaagagctgccagccagagcctagggcgtccccagttccaagcagttgcagctttctggtgttttctcaggggctttggggccagaggggctgcagtgccagcagattactatgcgagtcattttcctgagatacctgcaagcctgtgttcccattcttcagctggggaagtttgggtaactgccattctgttgccctttgggaagtcggaactcttggttcagcagccactttccctggctgagtgcggtggcatgcacctctaatcccagctacttgggaggctgaggtgggaggatcgcttgagcccaggagtttgagaacagcctgagcaatacagtgaaatctcatctcgagaaaaagaaaagtctgggtgcggtggctcacgcctgtaatcccagcactttggggaggctaaggcaggtggatcacctgaggtcaggagttcgagaccagcctagccaacatggtgaaaccctgtctctactaaaaatacaaaaaaaaaataggctgggcgcggtggctcacgcctttaatcccagcactttgggaggctgaggtgggtcaatcacgaggtcaggagttcgagaccaacctagccaccatggtgaaaccacgtctctactcacaatacaaaaattaactgggagtggtggtgggcgcctgtaatcccagctactcgggaggctgacgcaggagaatcacttgaacctgggaggcggaggttgcagtgagccaagatcgcaccactgcactccagcctgggcaacagagggagactccgtctcaaaaaaataaataaataaaataaaataaaaatacaaaaatttagccaggcttggtggcgggcccctgtaatcccagctactcgggaggctgaggcaggagaatcgcttgaacctgggtgttagaggttgcggttagctgagatcgcaccattgcactccagcctcggcaacaagagcaaaactccatctccaaaaaaaaaaaaaaaaaaaggaaagaaaaaaaattactgaaaatcctgtttctttttttttttttttttgcccactgccaatttatttatttatttatttatttatttatttatttatttttattgatcattcttgggtgtttctcgcagagggagatttggcagtgtttgtgtccctgggtacttgagattagggagtggtgacgactcttggcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtatagaacaaaatgaaaagtctcccacgtctacctctttctacacagacacagcaaccatccgatttctcaatcttttccccacctttcccgcctttctattccacaaaaccgccattgtcatcatggcccgttctcaatgagctgttgggtacacctcccagacagggtggtggctgggcagaggggctcctcacttcccagtaggggcggccgggcagaggcgcccctcacctcctggacggggcggctggctgggcgagggggctgacccccccacctccctcccggacggtgcggctggccgggcggggggctgaccccccccacctccctcccggacggggcggctggccgggcaggggggctcctcacttcccagtaggggcggccgggcagaggcgcccctcacttcccggacggggcggctggccgggcggggggctgacccccccccacctccctcccggacggagcggctggccgggcagagggtctcctcacttcccagtaggggcggctgggcagaggcgcccctcacctcccagacggggcggctggccgggcggggggctgatccccccacctccctcccggacaaggtggctgccgggcggagacgctcctcacttcccagacggggtggctgctgggcggaggggctccttacttctcagacggggcggctgccgggcggaggggctcctcacttctcagacggggcggttgccaggcagagggtctcctcacttctcagacagggcggccaggcagagacgctcctcacatcccggacggggcggcagggcagaggtgctccccacatctcagacaatgggcggctgggcagagacgctcctcacttcccagatgtgatggcggccgggaagaggcgctcctcacttcctagatgggatggcggccgggcagagacgctcctcactttccagactgggcagccaggcagaggggctcctcacatcccagacgatgggcggccaggcggagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcgcgcctgcaatcgcaggcagtaggcaggctgaggcaggagaatcaggcagggaggttgcagtgagccgagatggcagcagtaccgtccagcttcggctcggcatcagagggagaccgtggggagagggagagggggagggggagagctgaaaatcctgtttctatttcagctctcctcagaggtgagctgatgccccctgcttcactcgctgatgctccctgcttcactcccctccttgttttccttctacagaattcagtttgcctgttctgtatgcaagttccgtagctttgatgacgaagagatccagaagcatctgcaaagcaaatttcacaaagagaccctgcggttcataagcaccaagctgcccgacaagaccgtggagttcctccaggtaaaggaaacctgggccccgtcaccgcgtctcttgcccatcccgcaggtgccggatcccttgaaggaggaagggaaatcagaggctatacttggccaaggtttcctttcccagatagagtagctgtgtaagtccctgagtcacagggacaaccgggagctccagccatcgtgctgtgctgccccacgcagctgctctgatagctgcctgcctagccctggcagttgagaaatgcccacatgcgcccacctctcattttactttatgccctctccaatcccacctaggaatacattgtaaacagaaataagaaaattgagaagcggcgtcaggaattgatggagaaagaaaccgcaaaaccaaaaccagatcctttcaaaggtgagttgtcatcccaggatgagtgctttcctggatggtagtaaggcatgtgacaggacccgtaaaacgtggcacgaggccgggcacggtggctcacacctgtaatcccagcactttgggaggctgaggcaggcggatcatgaggtcaggagatcaaggccatcctgtctgacacggtgaaaccccgtctctactaaaaaaatacaaaaaattagccgggcgtggtggcgggcacctgtagtcccagctacttgggaggctgaggcaggagaatggtgtcaacctgggagtcagagcttgcagtgagccaagattgcaccactgcactccagcctaggcgacagagcaagactctgtctcaaaaaaaaaaaaaaaaaaagtggcatgaagccagcccaagttggctgagaaggtgatgacgagacccgtgggaagagcgctcagcagcaatggaaagaaaccttcggatgtggccttgcatagattgcagcttatatcagtgacattaagcactttcatatcttttcctccttggtttgaaaagaaacaaccaggaggaacagaaaagctgaaaagtgcagaattcacagctatagaggccgatgtgctgacccatactccccatagaaaggcaggctgtgcccttctgattccttagagttgcagggagaaaacgtgggcccagatggggagtaggaggaaagcatcacttgctgtcccagatcctacaagacatgcgtttcctggcagggattggccaggagcacttcttcaagaagatcgaggctgctcactgcctggcctgcgacatgctaattcctgcacagccgcagctcctccagcggcacctgcactccgtggaccacaatcacaaccgcagggtgagtcttcctccccacactgcctggggtgctcattgcagggctgcggctcagagcctgctgtgtcttatggggaataacaacatctttaggggttcttgctatgtttcaagtctatcacttccatcgatgggtcgtaagattcgtctcaatttttataaaaatgtgagaaaatgtgttgcttagactcgattaaatgcagtagctgagattctcctgatagtgtttccacgttggtcagttttcccactagcggaaggcctgggggcttccataagctgagaccgaagggccattgaaagctgagtggcccaggggacttggactaaaggactggttctgtccttacctagctgctggggcttcaggctaaatgttgagcccaggggtcaagtgttgaagatgctggaaaaataccttattttgtaaagagtcagatcatgagtatttttagcattgcagaccatagaggccctatccagcaacagctctacctgctgtcagtgcagaaaagcagacagtgaagagtgcctgtggctgcgtttgctctgcagcctgtcactttctggccctgggttagcagctctctccttagtttactcagctattaaatggggaggtcaagagctgctcacccatctcacagtactgtgttttggttttggttttggttttggttttttggtttacgtttttgtttttttgttttttttttacggagtttcactcttgttgcccaggctggagtgcagtggcacgatctcagttcactgcaacttctgcctcccaggttcaagcaattctccagcctcagcctcctaagtagctgggattacaggcgcccaccacaatgcccggctaattttttgtatttttaatagagacggggtttcaccatgttggccaggctggtcttgaactcctgacctcaggtgatccacccgcctcagcctcccagagtgctgggattacaggtgtgagccactgcacccagccccagtactgttaaagatcagctgaaaagcagtatacaaacaagggaccattgtgcaaacaagtcaggctctaaaacagagacttggtgcagtcatggttgtgtgtttgttttttgtttttgtttttgtttttaattttattttttgagacagagtctcactccattgcccaggctggaatgcagtggtacaatctcagctgattgcaacctccatctcccaaattctcatgcctcagtctcctgagtagctgggattacgggtgtgcaccaccacacccagctaatttttatattttgtagacagggtttcaccatgatggccaggcttgtctcgaactcctggcctcaagtgatccacatgcctcagcctcccaacgtgctaggattacaggcatgagctgccacacccagcatattcatacttttgttgttgaacttatgaaatcaatgtaaccccaaaaactgaaaagaaagagcttgtccttttcctccactgagtccacacagcctttcatttgtaaatgctcttgtttcacccccaattctgcatgtgctacatgggtatcagtggtgcatctttgcatttatctcttaagattgcctagcttttccagtttgttagtcttggttgcacagtctctggagccttctattcttggaggctggcgttttgagattcgcttctctgcatagggctgatctcaggatgactcggcagagcctggctggtttattctcttccttaatctttgccatttttaagagctcacatttggttccctttgcagttggctgctgaacagttcaagaaaaccagtctccatgtggctaagagtgttttgaacaacagacatatagtgaagatgctggaaaaatacctcaaggtttgtgcttgcaagtaccacagacaggaaaagctttcaaaagggaagatgaaccccaggagcagggagttgaatccagagtgcagcatttagcatttctgagtcttttgacagttgagggacactggaatgcatcaagctcaggaacatgacaactgggatttctaatgagtcagtgcttgcctggggactctggggatgtggcgctgcttgattaatcagtgcgtaatggatttttaccatgaaaaatcctgattgtttagccttaaaattctgagcaaatgatggttaggtgattttttaagaaaaacccaaggctagccctactcgggaagctgggatgggaggattgcttgagcccaggaatttgaggctacagtgagtgatggtgttaccactgcacttcagcctgggtaacatagcaagactggtcttgaaaataaaggaaagcggggaaccgggaattatggctcatgcctgtaatgccaatagtttgggaggctgaggcaggaggatccctgagctcaggagttagaggagttaacgattgcgccactacactccagcccaggtgacagagtgagaccccatttcaaaaaaaaaaaaagaatccaaggtacatgagaattttccaggagagaagctaaaaagagatttcattgatagagccaactgacagtgaggttgaaggtgaggggtagtgaagaaccagagccttcatgatgggagcagcatatcgaagtcccaaagtgggtgctcatggagagaaggctggttggaagagctcccagttcttccttgtgaaacccattttgctcagtgttcatcccaggactttagcatttggggcaggtggctaagtcccagcccacaacctgacttcaggacctttgccctcctctcagttactaaacacttccatatttgacagttccatctattaaaggcacagaatctaaataaccaattgaagaaacatgactgggccgggcgtggtggctcacacctgtaatcccagtactttgggaggctggggtgggcggatcactttgagttcaggagttcaagaccagcccggacaacatggtgaaaccctgtctgtacaaaaaatacataaattagccaggcgtggtggcatgcgcctgtggtcccagctactcaggaggcggaggttgcagtgagccaagatcgtgccactgcactccagcctggatggcagagtgagaccttgtctcaaaaaaaaaaaaaaaaaaaaaaagagggaggaaacatgactgatgtatattttacctttgcagcttaagcaaggtaaaagtttccagagtcaagtgtgagctcaggcttctaagcgtctttttttttgagtcagggtcttgttctcttggtacccagccaagagattcctgcagagattctctgcagcctcgaattcctgagctcaagagatcctccccactcagcctgccaggtagctgggactgcaatagtacaccaccacacctggctaattttttttttttttttttttttttttttttgagatggagtcttgctctgtcacccaggctggagtgcagtggtgcgatcccggctcactgcaagctctgtgtcctgggttcatgccgttctcctgcctcagcctcctgagtacctgggactacaggcgcccaccaccatgcctggctaatgttttgcagggggatggggtggccgggcgtggtggctcacgcctgtaatcccagcactttgggaggccgaggcgggtgcatcacgaggtcaggagttcaagaccagcctggccaagatggtgaaaccccatctctactaaaaataaaaaaaaaattagccaggcgtggtggcgggcacctgtaatcccagctacttgggaggctgaggcagtgaattgcttgaatccgggaggtgcaggttgcagtgagccaagatcgcgccattgcactccagccttggcgacagaccaagactccgtctcaaaaaaagaaaagagagatggggtttcactgtgttagccaggatggtctccatctcctgaccttgtgatctgcctgcttccgcctcccaaagtgttggaattacagacgtgagccactgcacccggccacatgctggctaattttttaagacagtcttgctctgttgcccatgctggtctggcctcaagtgatcctcccgccttgacctcccaaattgctggggttacaggcgtgagcaccttgccctaagcatcatattttaaaacatgtttcctaatctggtaatgataacttttagtttgcttgttttagactacagatagttttctatcatatacttaggagaattttgacttctgagggagtcagacttggatttgaatcttgattcgccacgttgcccaggctggtctcgaactcctgagctccggcagtcctccagccccagcctcccaaagtgctgggattacaggcgtgagccactgtaccttaatgaaactaaaatattacgtagtgttaacttcctattacatgccctttattttattttattttatttttttgagatggagtctgactctgtcgcccaggctgccaggctggagttcagtggcgtgatctcgacttactgcaagctccgcctcccaggttcacgccattctgctgcctcagcctcccgagtagctgggactacaggcgctcgccaccatgcccggctaatttttttttttgtatttttagtagagatggggtttcactgtgttagccaggatggtgtccatctcctgacctcgtgatccacccatcttggcctcccaaagtgctgggattacaggtgtgagccatcacgcccggcctcatgcccttttttaaaaaacatcaagttaaggctgggcttgtgaacttttcctcgctggtacatgcttgattaaaaattgcaggccaggcacggtggctcgtgcctgtaatcccagcattttgggaggccaaggcaggcggatcacctgaggtctggagttccagaccagtctgcccaacatggtgaaaccccgtctccactaaaaatacaaaattagccgggcgtggtggctcctgcctgtaatcccagctactcaggaggctgaggcaggagaatcacttgaaaccaggaggcagaggttgtggtgagctgagatcgcgccattgcactccatcctgggcaacaaagcaaaactccgtctcaaaaaaaaaaaaattgcagaatgggccgggcatggtggttcacacctgtaatcgcagcgctttgggaggctgaggtgggtggaaaccccatctctactaaaaacacaggaggcggaggttgcagtgagccgagatcgcaccactgcagtccagcctgggcaacagcgagactccatctcaaaaaaaaaaaaaattgcagaatatctccccgaggtgttttctgaatctgtaggctctgagaacatgtaggattcactcctgtggcataatttacagaagtgtttcccttgtggactgctggttctgaaaagctgacatccccgcaatcatgggcctcctgagctctgcttacaccacgctgaccggtgtttcctctttggccagggtgaggaccctttcaccagtgaaactgttgatccagaaatggaaggagatgacaatttaggaggtgaggataagaaagagacacctgaggaggtggccgcggacgtcttagcagaggtgattacagcagcagtgagggccgtagatggggaaggagcgcccgctccagagagcagcggggagccggctgaggacgaaggccccacggacacagcggaggccggtagtgatcctcaagccgaacagctgctggaagagcaggtgccctgtggaacggcacatgagaagggcgtccccaaggccagaagtgaggctgcagaggctggaaatggcgccgagacaatggcagcagaggcagaaagtgcccaaaccagagttgctcctgccccagctgccgcggatgctgaagtggaacaaactgatgcagagtctaaagacgctgttcccacagaatgatgctcatttccctgttccagggaaggcgttgggatgatggatgcgttggtctttctcccttggtttgtaagcagtacaagggcgtgtgctcccagaatatgctgtaatctaattttggtgaagagacccagcgtttcctcctgagcagtgcctctcacggcttgtctcatgcagtcgtgtggcttcttgcccaggtttcaaagctgaagtacattgtccttagcggctgtaacatgtctcttgacagtagtgcacttggaataataaaggttgggtgattatatcttgatgatacattacttgttcaatacagccactgatggaatgcttccttttttatttttttccttaatttttttttttatttggttgggaacagctgaatactaggaatatatcttgctctatagaggatttttttttgtatgtttcaagcttcagcctttaacctatacctttgtagtgcaccatatggtgtgtgactttcacaggacttcgcagcacctggttcacatgtggcactgaccgcgtcacatccacgcactcccaaaggccagaagtatctgaccgacctacgccactggaaacacacccaccgcaacctcaagaaccagactgtgcagagggcattgcgtcccaatctttagtccttgctgaatcagttctctaatattttacctcatttgtgttccacctctagattacttcaggtttttttcctttaaaattagttactaccactcaaatgtatttacaaagagaatttggccaggcacggtgatgcatacctataatcccagcacttcgggaggccgtggtgagaggatagcttaagcccaggagttcaagaccaacctggacaacatagcaagaccccatctcttaaaaaaaaaggaaagaaaacttgatgtgattgccataggtggaataatccaacataaattgccatagatagaaggtatctgtaatatatatatatatatataaaatgaaatatatgtttcattttagagaaataactattactttagatctttccaaatctgagaaagggaggctagcatgtgttcaaggttagcacgcaacagaatttcctaaaatcagaagaattggaagatcctccccttttgaaatggccctgctgtgtcagtttccctgtggccttttgaactgtacatctcacatgttgggaaacgctggccactgggaaatcattagaaaggaggctgtagaatatttgccgagcctctactgtataccaggggctaactcaccaagcacattctaggaattgggccctgctcatgaggagccttagtggagattccaggtgaatatttatgaaaaagtcaacattagaactgaaaatggaaataaactgcttgaaaagacga

SEQ ID NO: 11425 - DNA, 217 bp, Homo sapiens
ggatactggcagctgcactgcacattgcttcgtgcctgcgagtgtgtgacagcagacacctgcggggtcgggagcacccaggcccactgggtctttgagaggcgggcgcccttcagcaggtctcttcatgtccaatgcaggagaccagagggtctgcagcaacagcagagcaggcttaaatccctcatggcagagcggcctgaggtgccgcggcctg

SEQ ID NO: 11426 - DNA, 1122 bp, Homo sapiens
gggtgacagagcaagactccgtctcaaaaaacaaacaaaaaaagattgaagtaatgaattttatttcagtggtatggggaaccttgtttctgacagtaggggaagctatcatgttcctggtaggaggttgcatcttatttcaagcggtgggaaaacaggacctggctttgcattagtaactgaagccaggtggtgaactctcagcatgtgtaaggagccggctgagaaggagctttgctcccatgatattaaattatctgattattgaaaacttttgtaaatggtcattagtgagcaaattgtctttttaaaaattctattatgaaagagttttaaacttaacagaaaataggcaagaacagtgccaagaactcctgtacactcctttgcccagagactattcctttagagcaaaggctacagcccagaatcacgcgcttcaccccattcatcacagctctcctttctgtccatctggtgccactcctcagttttcctgaacttccgcgattttggcgtttgtggaggttataggctgatcattttgtagaatgtctttcaatgtggattcgttgatgtttctgcatgattagaccccacctgtgtgtacttgaagcctgaatgtcacagactctgttctttttatcctattctgtgtctttctgtccagttactggtgaggttactgctgtcgccttgaagcacaaggtgttctgggtttgtcttgttttttcatgaccctgtaactggccacatcttcaaggagcgctgcttccatatagtggaggggggtgtttggaaatgagatctggttgctggtgtgcctatttccactagggtattgcagctcccagaccttctcataggatagagctaggggacttgtacatttatagttatttctgtatctgcgtcatatatcatgttcacacaaatgcatctaattccaatctaacatcacagagttgtcttttaaaaatatgacaagctggccatgcgtgatggctcacgcctgtcatcccagcactttgggaggccaaggcaggcggatcacctgaggttgggagtttaagaccagcctggccaacatggagaaacctcgtctttactaaaaatagaaaa

SEQ ID NO: 11427 - DNA, 191 bp, Homo sapiens
gatcgcaccattgtactccagcctgggcaacagagcgaaactctatctcaaaacaaaccaaccaaccaggattgaagtttctattttcctattttcacatacacattttcttcagccatattatatgtgtatgtatagcctacattggctaaatctgaggaacaccacaaacatcagataaatctctcatg

SEQ ID NO: 11428 - DNA, 1936 bp, Homo sapiens; identical to SEQ ID NO: 11386
  misc_feature (1768)..(1768): n equals a,t,g, or c

SEQ ID NO: 11429 - DNA, 4602 bp, Homo sapiens; identical to SEQ ID NO: 11383

SEQ ID NO: 11430 - DNA, 166 bp, Homo sapiens
actgattcttttttttttgtttttttttgagatggagtcttgctctgtcgccccggctggagagcagtggcgcgatctcggctcactgcaagctccgcctcccaggttcacgccattctcctgcctcagcctcccgagtagctgggactacaggcgctgccgtgcc

SEQ ID NO: 11431 - DNA, 1936 bp, Homo sapiens; identical to SEQ ID NO: 11386
  misc_feature (1768)..(1768): n equals a,t,g, or c

SEQ ID NO: 11432 - DNA, 4602 bp, Homo sapiens; identical to SEQ ID NO: 11383

SEQ ID NO: 11433 - DNA, 166 bp, Homo sapiens; identical to SEQ ID NO: 11430

SEQ ID NO: 11434 - DNA, 10719 bp, Homo sapiens
acagtccccactgacgggagcagcagaaatgaggtgagtcctcgcccttcctggcagggatcctggccccttcccccgggacagcttgcccacctggccctggccttggccccttcccagtctgcattctgtgtccagcctgtgctgctctgtggcctctccttgagggcatacagacagttgagaaccagcctcatgcaggccccacaccatgttctccaggaggaacagtcattgagcttctaagtctggacacctcaggagggtcagccacagggggcacccactggtcaggtgtataagttcatttagggctcgtagttcctagtgaagccgagcggtgccgttttgcacataaggaagcagtgacggggacagcacagtggcccatctgcctcttgccttgctcttcaccaggatgcctggtgtgtccctccatggccaggctttacagaacgcagtcccacctggagcagccactcggacccagcagccccccattgttgcctgctccaagcctcacatctaaccctagctgcggctgtctgctgggaagagccaagtccatagggccctttgggcacatggccaggcctctgaccctgtggctgctctctagttctcaggcccaggcaggatgtcagtgcaggatggagccccgccctaccaaaggcttccaggtgggcatgagctcacaggcaggccagggagtagggaaaggctgccctggaggaggccaccattggtgcagattcttggtcccctctacccccactgctccaagaaaaggtggcctaggggcattatagattgggaattgaggggttggagtgttagttcatgccctggcctgggaatgggaccgccctaccaggttcgtctccctgccaaccccagtcccttccagtgctctcctttctttcccaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtacacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacatgggccgagcgcagtggctcacgcctgtaatcccagcactttgggaggccaaggtgggcagatcgcctgaggtctggagttcaagaccagcctggccaacagggtgaaaccccgtctctacaaaaataagaaaattagccaggtgtagtggcagacgtctgtaatcccagctattcaggaggctgaggcacgagaattccatgaacccaggatgcggaggttgcagtgagccgagattgtgccactgcgctccagcctgggcgacagagtggtattctgtttcaaaaaaaaaaaaaaaggcagtatgtagccccgaagactgttgcccaagtggtagaatgttagcacactaccagcctaggtaaaaaatacaaaaagtaactgggcatggcggcgcccatctatagtcccagctacatgggaggctgaggtgggaagataagtcacttgagcccgccaggaggcggaggttgtagtgagctgagatcgcaccactgcactccagcctgggtgaccgagtgatactctgtctcaaagaaaaaaaattataattttagcacagtaaccagccatgatgggagataccctgggtaaggcatgtagaaagggttgagggaccttcccagtcccctagccccgcctcccatcctcccatctttttcttttttcttttttttagagaatcacccagcctggagcgaagtggtgcaatcataactcactgtatccttaaactcccgggcttaagcgatcctcctgcctcagccttctgagtaactaggacttcaggtacctgtcaccatgcctggctaattaaatttttttttcttttttttttttgagatggagtcttgctctgtcacccaggctggagtgcagtggcgcgatctcagctcactgcgacctccacctcctgggttcaggccattctcccgcctcagcctccagagtagctgggactacaggcgcctgccaccacgcctggctaatttttttgcacttttagtagagacggggtttcactgtgttagccaggatggtctcgatctcctgaccttgtgatccgcccgcctcggcctcccaaagtgctgggattacaggcgtgagccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaagccgaggtgggaggatcccttgaagccaggagtttgagacaagcctgggcaacaaagcaagaccctatctctaaaaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggtcatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctacttcttcagtgctgtttttatt

SEQ ID NO: 11435 - DNA, 504 bp, Homo sapiens
atagactccctccctagacgggaggactgacaggcacagtgcagtggggctgggtggagatgagcgagataagtagggccatttttgcgctctgccaaagggactgtagggaacagccagggcctatagggcagtgggagagggacagtgaagggctgcatcagctgttggcaggggaacctttaggcactgtcttaccgcagagatctccagttcccagtgaatcatgaaaacttctcagtccccagaggaagtaaggtcttcatcatccagtggcctggactcaactccagatgtcagtgctccccctcagaaatatatagttgtccatctggacctctcaggccagcatgtctctttcctacttcccaaactattccacatgacgctggtgcccagtcagccctcagtgccctgggacagccacaagacacatgagcagttagaggctgggagacgtcatcttagtacttttgtcatccccaaactgctccaagcacctgt

SEQ ID NO: 11436 - DNA, 517 bp, Homo sapiens
caggcaaaatgaagggaagccctgggttcttgtcctgcatccgcagccagctcccactttcctcaccctccaggacctgtaaactgtgaggctggaccagttatgtcaaatctgtcctcccccagagctcagtccctctgcccttgggtgtccttggcacaaggcaggctaggctgcaccagcttcctccatctccgtcctgcctcccccatccccaggtgccattcccacaccatctgaatcactgatttcctcgcaatcagacgctatcttccagttaatcacttcgcttgtatttaacataagaaagaaaaaccctttcattatcacatacagctggaaatcggcttcttgcaggaggcgtatccaaaggaattggagaagagataaactggtaattggtgaaagaattactttaattttttttcctacttgctgtcatgatgatgtccttagaattgtgagcccgtggacacttctgtacaataaatctgctattattacttctagaactaca

SEQ ID NO: 11437 - DNA, 102 bp, Homo sapiens; identical to SEQ ID NO: 6331

SEQ ID NO: 11438 - DNA, 109 bp, Homo sapiens; identical to SEQ ID NO: 7566

SEQ ID NO: 11439 - DNA, 131 bp, Homo sapiens; identical to SEQ ID NO: 6213

SEQ ID NO: 11440 - DNA, 91 bp, Homo sapiens
cccgggaggcggagcttgcagtgagctgagattgcaccactacactccagcctgggcgacagagtgagactctgtctcaaaaaaaaaagaa

SEQ ID NO: 11441 - DNA, 98 bp, Homo sapiens; identical to SEQ ID NO: 7600

SEQ ID NO: 11442 - DNA, 135 bp, Homo sapiens; identical to SEQ ID NO: 7602

SEQ ID NO: 11443 - DNA, 125 bp, Homo sapiens; identical to SEQ ID NO: 7605

SEQ ID NO: 11444 - DNA, 108 bp, Homo sapiens
tggcgtgaacctgggaggcagagcttgcagtgagctgagattgcgccactgcactccagcctgggcaacagagtgagactccatcttaaaaaaaaaaaaaaaaatata

SEQ ID NO: 11445 - DNA, 101 bp, Homo sapiens; identical to SEQ ID NO: 6685

SEQ ID NO: 11446 - DNA, 87 bp, Homo sapiens
ccgggaggtggaggttgcagtgagctgagatcgcgccattgcactccagcctaggcgacagagtgagactccatctcaaaaaaaaaa

SEQ ID NO: 11447 - DNA, 116 bp, Homo sapiens; identical to SEQ ID NO: 7632

SEQ ID NO: 11448 - DNA, 162 bp, Homo sapiens; identical to SEQ ID NO: 6214

SEQ ID NO: 11449 - DNA, 129 bp, Homo sapiens; identical to SEQ ID NO: 7645

SEQ ID NO: 11450 - DNA, 616 bp, Homo sapiens
aagagacggagtctcactatgttgcccagtgcctaggctggcctcaaattcctgggctcaagtgatcctcctgcctcagccttcagagtagctgggattacaggcatgcaccacactgtgcctggctcatctcattttctagaatggatatattgacaaagaaaagagaagaaataagaaatgcaaaaaatgcaccttcaccatatggccctttagctaaaagctacaaagctaacaagggtgtgccatcagaactatccatgtacatgtacagagatgattttaacagctgccatgtgacatgtggcttaaagtcaccctgagtctactaaatggttgtgttgtcaatatatctaaatatggctacgtgctctccagagtgttcccatgatcaccacgtcctttgatcagtgccatctggaagagcagatgagtgcagccctcctctcatcctctctgtgctggctccgaacgcttgcttacagacccaccaacaaccaagaagctgcactggttggtacacactgcagcaaacaaggaaaacaagtagataaaaagtccaacatcaaaaagaaaaaaaaaccatagaaacaattgaagagagaatggctaaagg

SEQ ID NO: 11451 - DNA, 140 bp, Homo sapiens; identical to SEQ ID NO: 6216

SEQ ID NO: 11452 - DNA, 114 bp, Homo sapiens; identical to SEQ ID NO: 6217

SEQ ID NO: 11453 - DNA, 63 bp, Homo sapiens; identical to SEQ ID NO: 7662

SEQ ID NO: 11454 - DNA, 616 bp, Homo sapiens; identical to SEQ ID NO: 11450

SEQ ID NO: 11455 - DNA, 98 bp, Homo sapiens; identical to SEQ ID NO: 11303

SEQ ID NO: 11456 - DNA, 121 bp, Homo sapiens; identical to SEQ ID NO: 7669

SEQ ID NO: 11457 - DNA, 108 bp, Homo sapiens; identical to SEQ ID NO: 7680

SEQ ID NO: 11458 - DNA, 95 bp, Homo sapiens; identical to SEQ ID NO: 8302

SEQ ID NO: 11459 - DNA, 115 bp, Homo sapiens
ggctcaggcaggagaatggcatgaacccaggaggcggagcttgcagtgagccgagatcgcaccactgcactgcagcctgggtgacagagcaagactccatctcaaaaaaaaaaaa

SEQ ID NO: 11460 - DNA, 93 bp, Homo sapiens; identical to SEQ ID NO: 7709

SEQ ID NO: 11461 - DNA, 136 bp, Homo sapiens; identical to SEQ ID NO: 6219

SEQ ID NO: 11462 - DNA, 138 bp, Homo sapiens; identical to SEQ ID NO: 7715

SEQ ID NO: 11463 - DNA, 40 bp, Homo sapiens; identical to SEQ ID NO: 7736

SEQ ID NO: 11464 - DNA, 122 bp, Homo sapiens; identical to SEQ ID NO: 7739

SEQ ID NO: 11465 - DNA, 616 bp, Homo sapiens; identical to SEQ ID NO: 11450

SEQ ID NO: 11466 - DNA, 4802 bp, Homo sapiens; identical to SEQ ID NO: 7769

SEQ ID NO: 11467 - DNA, 368 bp, Homo sapiens; identical to SEQ ID NO: 6222

SEQ ID NO: 11468 - DNA, 453 bp, Homo sapiens
ctaggttcaaaagagagcagagaaacagacactctgaggtagcctttatggagagtaatttggccagatctcaaaatttaacacacacatgcactgaccaaataatcacacttctaggaaatatcccccatgtacctactgcagggattttcaatgcagccctatttatcagaacgactagaaacaacccaaatgcctactgggaacagccagttaaacacgattacaatgatagcctatgcagtcagcaaaaaaagaatgaggtgaccccataaatatggtaggaatgacctccaaattacactgttaagagacaaaagcagaagggtatctaccatcttgtgctttcagctgtgtgatgcatagaattcatacacaatatgaatgcatatatgtacacacacgtgcacatctgtttctgcatatgtgtatgggtatatgaggaagcaagtt

SEQ ID NO: 11469 - DNA, 158 bp, Homo sapiens
gcatgcctgtaatcccagctactcaggaggctgaggcaggagaatctcttgaacctgggaggcagaggttgcagtgagccgagatagtgccactgcactccagcctgggcgacagacggaaactctgtctcaaaaaaaaaaaaaaaaaaaaaaaaaaa

SEQ ID NO: 11470 - DNA, 2925 bp, Homo sapiens; identical to SEQ ID NO: 6223

SEQ ID NO: 11471 - DNA, 129 bp, Homo sapiens; identical to SEQ ID NO: 7777

SEQ ID NO: 11472 - DNA, 453 bp, Homo sapiens; identical to SEQ ID NO: 11468

SEQ ID NO: 11473 - DNA, 131 bp, Homo sapiens; identical to SEQ ID NO: 7781

SEQ ID NO: 11474 - DNA, 1090 bp, Homo sapiens; identical to SEQ ID NO: 7782

SEQ ID NO: 11475 - DNA, 453 bp, Homo sapiens
ctaggttcaaaagagagcagagaaacagacactctgaggtagcctttatggagagtaatttggccagatctcaaaatttaacacacacatgcactgaccaaataatcacacttctaggaaatatcccccatgtacctactgcagggattttcaatgcagccctatttatcagaacgactagaaacaacccaaatgcctactgggaacagccagttaaacacgattacaatgatagcctatgcagtcagcaaaaaaagaatgaggtgaccccataaatatggtaggaattacctccaaattacactgttaagagacaaaagcagaagggtatctaccatcttgtgctttcagctgtgtgatgcatagaattcatacacaatatgaatgcatatatgtacacacacgtgcacatctgtttctgcatatgtgtatgggtatatgaggaagcaagtt

SEQ ID NO: 11476 - DNA, 969 bp, Homo sapiens
gccagggcgcacccgtcggcggtaaaagctgaggggctggcgcgggggattggtgggcgacacttttacgtctacacgtgcctacccgtctgcacgtttctgagtccgcacggttgtcttctcttgctgaatggacataggtgttttgttttgtcccaagagatacaggcaagcagtacaggggtgatggagtgctccttgaccttagcggggctgaccctggcactccctgtaggtctccccgctgcgaagcactgagtctcttcactgcagtttctctccagttacccgccctgtctacggcccaaacggccatgctagtgaaaacctgccctggccgctaagcaagcctagcccaggctgtaacccatgtttctagggcttgttttcctctgcagtcaaatcagagattcggagttgaaggggatcttagaggtcaacatgcccaacctcttagcccgagtgagtgaatgtacgctttttacctgcacaccccgaaaatcgcccgttttctggaaacaacgttgattatgtagtcctggaactttcctgcatgcacattttattccttcgacaatatttattgctacctactgtgtgcaggcattgtaggccccggggatacgattaaaaccaatgaagaacgaaacgcacaagattgttgatctcggccgggcgcggtggctcacgcctgtagtcccagcactttgggaggcggaggtgggtggattgcttgaggtcaggagttcgagaccagcctggccaacctagcgaaaccccacctctactaaaaatacaaaaattggccgggcttggtggcgtgcgcctgtagtcccagctactcgggaagctgaggcaggaaaatcacttgaacctgggaagtggaggttgtagtgagccaagattccgcctgcattctagcctgggcaacaaaatgagactctgtctcagaaaaagaaaaaaaaaaaa

SEQ ID NO: 11477 - DNA, 265 bp, Homo sapiens
cacgtctgtaatcccaacactttgggatgccgaggtgggcggatcacgaggtcaggagatggagaccatcctggctaacacggtgaaacctcgtctctactaaaaatacaaaaaattagctgggtgtggtggcgggcgcctgtagtcccagctactcgggaggctgaggcaggagaatcgcttgaacctgggacgcggaggttgcagtgagctgagatcaggccactgcactccagcctgggcgacagagccagactccatctca

SEQ ID NO: 11478 - DNA, 921 bp, Homo sapiens
gatttctatgcattgtgtaatattcagtgatgttgagattttgcatgttgttacaggtgctctttcatatgtgtgtttggggggttgatgtggaattgttaaccactgctgctatcacttattggagttaaactgaaaaactgtgttaaaaggctgtgccagtcaacatttctatgtgtgacttaagtaactgtgtacttcattgtttaatattttgagccagcacttagtggcctctacagaaggaaatattgtagttgtcaaagtggtgccaaacttgaaaatcttgtgtcatgtttataattccaggccaggtcagcttttcttcaacactttccgagctctttgaaagcaaaaaacatttgcaaaaagagaaagaaagcaagaattctgaacttttctaatactctctcctctagaattttaaatatttttttcttttgatgtttgagtatcttacagaaaaatccaatcaaatgactagcggtagaatttcccttgatctggatatttttaggctgaacagtgtaatagcagaggactatgaggtgcatacattatttttgttggctatcatggcttattgtttgaatttcatttaataacaatattcaggctggaggtggtgactcacacctgcattcccagcactttgggagactgaggcgggcggatcacctgagatcaggagttcgaggccagcctggccaacatgacgaagcccagtctctactaaaaatacaaaaattagctgggtgtggtggctcacacctgtaatcccagctacttgggaggctgaggcaggagcattgcttgagcctgggaggtggaggttgtagtgatctgagatcacactactgcactccagcctgggtgagggagcaaggctccaacccccctaaaaagaaaaaaagaatattc

SEQ ID NO: 11479 - DNA, 921 bp, Homo sapiens
gatttctatgcattgtgtaatattcagtgatgttgagattttgcatgttgttacaggtgctctttcatatgtgtgtttgtggtgttgatgtggaattgttaaccactgctgctatcacttattgtagttaaactgaaaaactgtgttaaaaggctgtgccagtcaacatttctatgtgtgacttaagtaactgtgtacttcattgtttaatattttgagccagcacttagtggcctctacagaaggaaatattgtagttgtcaaagtggtgccaaacttgaaaatcttgtgtcatgtttataattccaggccaggtcagcttttcttcaacactttccgagctctttgaaagcaaaaaacatttgcaaaaagagaaagaaagcaagaattctgaacttttctaatactctctcctctagaattttaaatatttttttcttttgatgtttgagtatcttacagaaaaatccaatcaaatgactagcggtagaatttcccttgatctggatatttttaggctgaacagtgtaatagcagaggactatgaggtgcatacattatttttgttggctatcatggcttattgtttgaatttcatttaataacaatattcaggctggaggtggtgactcacacctgcattcccagcactttgggagactgaggcgggcggatcacctgagatcaggagttcgaggccagcctggccaacatgacgaagcccagtctctactaaaaatacaaaaattagctgggtgtggtggctcacacctgtaatcccagctacttgggaggctgaggcaggagcattgcttgagcctgggaggtggaggttgtagtgatctgagatcacactactgcactccagcctgggtgagggagcaaggctccaacccccctaaaaagaaaaaaagaatattc

SEQ ID NO: 11480 - DNA, 1548 bp, Homo sapiens
atttggacacattgctgatgaaattactgatttaattctaagactatcaaaactaattcgtcaaggtccccaccacctctttgcttaaaggaaaacaaaggcagattttaactgtgagcctcttctctagaatatgctgtagacatttgcccctccgtgaggtgataaagcaataaaaataaatttaattatgtgtggtctaaagaagttctacctctgtccattggcctccagagtcacacaaaattatttcttgattcctacatcagaggttttcaggcagagcctttgtaccaagaattccttttatattttggacaccaaagattatggcatgatatatcctgatgattaacaatttagcagtgggcacatttatttgagtcctgctcttggatttatttcccacctttgggtcttacgtacattttgtatttctgtcctgaggactttttgcctcaggcagtttttaaatcaaaaaaatatatatatatttattaggtttctaatttatagagtttccaatttctcccacaattttaaatgttttcactgccaaagttagcagtagatttgctaggttaatgccatggtcagtaatagtttgtaccttttatgttgtagcctgaaaatgtaactctaaccccgtaggcctgaaacctggtgggaagatgattgaaagtgttttagattcaacagattgactatgtatgacttatctattaaaatgaagaacttccatggtttaatagaatgaatgctgtattcaacaaggtcttccatccttcttataaatcttaagactgtgtttaagctttctttcacttttactctatcccttggaagttaattgggaataaaaagatttatcaatttagtcactataatttaaggccaggcatctgcttggaaatacaataaccacaattaatacttacagaaaattgtttcaacagattaactctgctattttaaaaactatagtagtgttctttgaggatgcatttacttttccccaaatttgatagatagttatttttatatattttttctggccacttggcttctaactgattaacatgaaaaacgcacgtgtgcctgtttcactcaaatcatattttacaactttttaaaagctgctacagttatagtttgtgaaagaggagaaaggtgaattgcaacagagggaaattactgttactgtgtcaaatatgtgactgatgcttttggtcagataatctgctgcctgtcaatatttgtaataacagaattttttgttaagagtactctcatctttattttgctgctcactgattttttacactaagatgttctcatctttgtcgactcactgtttttgcttcatatttgtctgtgtacttgtgctctaaataaaaatctagttttatgtctagtttattccattgtgtgtataatgtttgcctctgatgtagtgtaattttctattgtttttgatgtttgttggtacagcctaaaacttatggaaataagaaaagcaatccaataaagtcagctaatgagtgtcaa

SEQ ID NO: 11481 - DNA, 1548 bp, Homo sapiens
atttggacacattgctgatgaaattactgatttaattctaagactatcaaaactaattcgtcaaggtccccaccacctctttgcttaaaggaaaacaaaggcagattttaactgtgagcctcttctctagaatatgctgtagacatttgcccctccgtgaggtgataaagcaataaaaataaatttaattatgtgtggtctaaagaagttctacctctgtccattggcctccagagtcacacaaaattatttcttgattcctacatcagaggttttcaggcagagcctttgtaccaagaattccttttatattttggacaccaaagattatggcatgatatatcctgatgattaacaatttagcagtgggcacatttatttgagtcctgctcttggatttatttcccacctttgggtcttacgtacattttgtatttctgtcctgaggactttttgcctcaggcagtttttaaatcaaaaaaatatatatatatttattaggtttctaatttatagagtttccaatttctcccacaattttaaatgttttcactgccaaagttagcagtagatttgctaggttaatgccatggtcagtaatagtttgtaccttttatgttgtagcctgaaaatgtaactctaaccccgtaggcctgaaacctggtgggaagatgattgaaagtgttttagattcaacagattgactatgtatgacttatctattaaaatgaagaacttccatggtttaatagaatgaatgctgtattcaacaaggtcttccatccttcttataaatcttaagactgtgtttaagctttctttcacttttactctatcccttggaagttaattgggaataaaaagatttatcaatttagtcactataatttaaggccaggcatctgcttggaaatacaataaccacaattaatacttagagaaaattgtttcaacagattaactctgctattttaaaaactatagtagtgttctttgaggatgcatttacttttccccaaatttgatagatagttatttttatatattttttctggccacttggcttctaactgattaacatgaaaaacgcacgtgtgcctgtttcactcaaatcatattttacaactttttaaaagctgctacagttatagtttgtgaaagaggagaaaggtgaattgcaacagagggaaattactgttactgtgtcaaatatgtgactgatgcttttggtcagataatctgctgcctgtcaatatttgtaataacagaattttttgttaagagtactctcatctttattttgctgctcactgattttttacactaagatgttctcatctttgtcgactcactgtttttgcttcatatttgtctgtgtacttgtgctctaaataaaaatctagttttatgtctagtttattccattgtgtgtataatgtttgcctctgatgtagtgtaattttctattgtttttgatgtttgttggtacagcctaaaacttatggaaataagaaaagcaatccaataaagtcagctaatgagtgtcaa

SEQ ID NO: 11482 - DNA, 1672 bp, Homo sapiens
ataatttatgatttgattctttcctttgtccagcctttaacatacatgtttctgtaatttaaataaaaatttatgtactttttccattttagcaaatagtttctttaccgaaacaggttgcaccatagtccccatatggttttctactgttccacaaccactatttcacaaagattgacaaaacttgtatcaaagttaaatttatagacatcttaaggtatcttaggaaatatgtagtaaaaaagaatcaagtccacaaattatgaatattttgctaatacaccaaacaccaatttcagcaaatccaatctacttaacttgtatgtttaatgtggtaatttttctaacaaaatttaatgggggtatgaatgatatatttacacccttgacaaagatgacatgtgtgattttgttgtgacgaagaaaggagagtatgatttctggtgattattatattactctggctcatcaaagctcacagaatatgtaaggttctgccacatccaaaggtgttaggcaaacataatagaaggcacactaggctgacacacgttttcatcatacaaatcttccggtagttcctcttcatctccatcaggaaaatacgtagggaatggtagatttttaccgagatccttatatgcaggcagtttagaatctctgacccttactaagcaatttttatgtccaggtacagagccatttacatagattatgttgtgctttgtgtttattctccacactttcagtccatatactgttctatatatgtttcccatttttccaggcattttagttccaggccagactctgccaatgtcaccagttgaaatatctccaggtctcctgtgggttttcgtttgaccatgtgtagcaggctggcctttaaatccccatcttttcatgacaccttgaaaacctttaccaatagttttggctgtgacatccacatactgtcctggacaaaagtgagcagcataaagaggagtgcctggtttaattgcagcattatctgttacattaaagattataactgtctgttttgacggcaatccaagttctcggtaaaattccaatacaggtgtagctttatgaaaacgtgatacagtttgcctcctacagacagggctgccgtttttccattacggctttcctttgaagtatattttaggacatgacagtcttgtacctgaagtaatgtgaccacgtgcttttgaccatccttggtccataaaggcatcatgcccagcttcaaggccaactctaaaggaacctggttcccaaggatgcataggccatggttcatctttcagaggacacagtttacttgctaattgggttttatcttcatcagagaccaactgcttaatgaatgggacattttcttcagaaagatgctcatcccaccacgtaccactctttccatgaagacttctaacaaaaagccagatgtgtgttctgttccccgggcccagggcagcacccaggccatccccgacttgacccagcacctgggcgccgacctgcatcagcagcctccaacccgggatggattagcccgggaagactcaactcatgacttccgggtgcccagctgctctgctttcagggcgtccccacgccaccaccacgcggacgcagcagccatggggaagtcgctgcaatggccgcc

SEQ ID NO: 11483 - DNA, 1672 bp, Homo sapiens; identical to SEQ ID NO: 11482

SEQ ID NO: 11484 - DNA, 583 bp, Homo sapiens
aataaaaacttaaaaaaaagtggctacctttggatttaaagtgaaaaatgtgatacgaccaggatagtatatcacatggagatctaacactatgactaacaaacctattgggtgatgtgaattaacaatctggttcagaggaaatcaagtatttaagctgaggtctgcttatacacatggttaaacttatttgtcatgaacctgccattagtaaatacatgttaatttcatgcaattaaaaagaaacccagaaaccattagcattttgattaatacatgattaataaaagtttgttgaacatacaatcttaaatcattataaattctttttgaaaggtaggctgggtgcagtggctcacacctgtaatcctaacactttgggaggccacggagggtaaaaagattgaactcagaagttcaaggccagcctgggcaacatagtaggacgccatttttacaaaaaatacaaataatagccaggcatggtggtgggcacctatagtcccagatacatgggaggctgaggtggaaggatcacttgagctcagaaggtcttggctccagtgagccaagattgcaccac

SEQ ID NO: 11485 - DNA, 841 bp, Homo sapiens
caaaagaaactaccatcagagtgaacaggcaacctacagaatgggagaaaatttttgcaattgactcatctgacaaagggctgatatccagaatctacaatgaactcaaacaaatttacaagaaaaaaacaaacaaccccatcaaaaagtgggcaaaggatatgaacagacacttctcaaaagaagacatttatgcagccaaaaaaacacatgaaaaaatgctcattatcactggccatcagagcaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagttggtgtggcgattcctcagggatctagaactagaaataccatttgacccagccatcccattactgggtatatacccaaaggattataaatcatgctgctataaagacacatgcacacgtatgtttatcgcggtactattcacaatagcaaaaacttggaaccaacccaaatgtccaacaacgatagactggattaagaaaatgtggcacatatacaccatggaatactatgcagccataaaaaatgatgagttcatgtcctttgtagggacatggatgaagctggaaaccatcatgctcagcaaactatcgcaaggacagaaaaccaaacatcgcgtgttctcactcataggtgggaattgaacaatgagaacacatggacacaggaaggggaacatcacacactggggactgttgtggggtggggggaggggggagg

SEQ ID NO: 11486 - DNA, 583 bp, Homo sapiens
aattaaaacttactaaaaagtggctacctttggattaaaagtgaaaaatgtgatacgaccaggatagtatatcacatggagatctaacactatgactaacaaacctattgggtgatgtgaattaacaatctggttcagaggaaatcaagtatttaagctgaggtctgcttatacacatggttaaacttatttgtcatgaacctgccattagtaaatacatgttaatttcatgcaattaaaaagaaacccagaaaccattagcattttgattaatacatgattaataaaagtttgttgaacatacaatcttaaatcattataaattctttttgaaaggtaggctgggtgcagtggctcacacctgtaatcctaacactttgggaggccacggagggtaaaaagattgaactcagaagttcaaggccagcctgggcaacatagtaggacgccatttttacaaaaaatacaaataatagccaggcatggtggtgggcacctatagtcccagatacatgggaggctgaggtggaaggatcacttgagctcagaaggtcttggctccagtgagccaagattgcaccac

SEQ ID NO: 11487 - DNA, 980 bp, Homo sapiens
caaaagaaactaccatcagagtgaacaggcaacctacagaatgggagaaaatttttgcaattgactcatctgacaaagggctgatatccagaatctacaatgaactcaaacaaatttacaagaaaaaaacaaacaaccccatcaaaaagtgggcaaaggatatgaacagacacttctcaaaagaagacatttatgcagccaaaaaaacacatgaaaaaatgctcattatcactggccatcagagcaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagttggtgtggcgattcctcagggatctagaactagaaataccatttgacccagccatcccattactgggtatatacccaaaggattataaatcatgctgctataaagacacatgcacacgtatgtttatcgcggtactattcacaatagcaaaaacttggaaccaacccaaatgtccaacaacgatagactggattaagaaaatgtggcacatatacaccatggaatactatgcagccataaaaaatgatgagttcatgtcctttgtagggacatggatgaagctggaaaccatcatgctcagcaaactatcgcaaggacagaaaaccaaacatcgcgtgttctcactcataggtgggaattgaacaatgagaacacatggacacaggaaggggaacatcacacactggggactgttgtggggtggggggaggggggagggatagcattaggagatatacctaatgctaaatgacgagttaatgggtgcagcgcaccaacatagcacatgtatacatatgtaacaaacctgcacattgtgcacgtgtaccctaaaacttaaagtataataataataatt

SEQ ID NO: 11488 - DNA, 3489 bp, Homo sapiens
ggcaggtaaaagcagctgttaagtatgcccttagcgtaggctaccgccacattgattgtgctgctatctacggcaatgagcctgagattggggaggccctgaaggaggacgtgggaccaggcaaggtaaggactggggttgtaaatagaggtgggataagagaacttagaagctgaagctagggctggggcccagctggagggaatctggcatcagcttccttccagttcctctcccagagttgagggtgggtgagaccacgtgctcatggctcttctcactgtgggccctgccccctgcactaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagtgagccttgccagagcctcatctggggaatcagggggttgagcaggatggtgttagtaacttattgtaagtcacagcagcagagcaggataggaacactcatttgcatgccaagctgaggagcttgacatgggatcttagcctcttctgctacagcagcttagctgtagctacaggagtttaactctggaaaaaggaaggcagtctcacatggtgtgtaccccagggtatgcacctgtaaccctcctgctccctttattcatttagaaaaggtgctgacttttctgttgagcacctggggttacagtaataagtaagtctcagcagaagatgtgagaagagctcaccattagtgccgtgccctgtgctggaagaagggtggataactccctgaggatgagttaaggaagacttcctaggggagaggagatatctacgtctaggaagaggagggggcataggcattccatgtaaacttaacacctgggttacgatctggaaggatgaaaaagcatggctttttttggccaggcgcggtggctcacgcctgtaatcccagcactttgggaggctaaggcgggcggatcacgaggtcaggagatcgagatcatcctggctaacacggtgaaaccccgtctctactaaaaatacaaaaaattagctgcgcgtggtggtgagcgcctgtagtcccagctactggggaggctgaggcaggagaatggcgtgaacccaggaggtggagcttgcagtgagctgagatagtgccactgcactccagcctgggcggtaaagcgagactccatctcaaaaaaaaaaaaaaagaaaaagcatggctttttaaaaattcttggccctttgtcctctctgggattggagtttgggacatagagtggctggatgggcaggtagggtagaagcctggcatttgtgtccacacttggtggggctgtctctcactcaggcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtaaggacagcaagcagatgagtggtttaggggttgtctgctcaagagcatgagggagcagacgatggatctgcttaagggagatagctagcaagttgtcagagtgttggtgcagaagtcctctgcataaaggtgggcattgaagcagtgggagagaatgaaattgccgatgggaaatggtgagaaaagcaggctgaaggggagtggaggagtcagcaatagggggtggtccagacatgcatgtctgggatgggccaagcaagctgggtgtcaccacttcatggtgatgggttattctttggctcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtatggggcagtcttagggagagggccctgggttgggaggcaagggttaagggatttcttatttcagtgtctgggtgaggctgaggatcttgccttgtgatctggagggaggccactgtaggcatatttcccatttcagcagggctcaggtgctccaggagcttagggaagctgcatggggaacaaaatagtgcttatgaatactgaccccttttcctcatctgtctaatcccccaacttaggtggcaggtccagcggaaagtgatctgcatccccaaaagtatcactccttctcgaatccttcagaacatcaaggtacttggtaatgggttctatcttctttagctctttgggacattttcttggccctgactctacctggctaaaaaggcagtgttgtggaaccccagcttctgctcacaaagctggctttcttgaaccccactctccatcctcaggtgtttgacttcacctttagcccagaagagatgaagcagctaaatgccctgaacaaaaattggagatatattgtgcctatgcttacggtgaggatgtatcagcctcctagacttggggaatgtgagatttggggtgggattctggcccaggtgtgacctaaggcttgctggttgtgagaaggacacaatgttgtgggtgggattgctatgctggacatagtgccctcatttctctttattgagctcagggaagtagtatggctcagggataaggcatataacctgtgagtcccagtcctgcttcttgatatcttgtaacctagagcaagttattaaacttctccaagcctcagcttcctatgtgtaaaatgagcccagttcctgacatgtagtagattctcagtaaatgatatgaggagagcccagaaggcgttgttgacctcactcgagggattggggttgggagggaagtcggctgtacttagggaaataaatggttcctggcctcttgatctcagttcagactgcaaactcttaggggcaggggtagctacatatcaggctatgggtttggtgctagaatggtgttgatactgtggtgttctctgaggatggggatcccagccaatgccatctggcatagtgctgtacacaggtgagtttgtttaggaagatttggggaagatgcctggagtctttggaatggcaactcctgctgatggagtaatctatctgtctctctttccaggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatccatat

SEQ ID NO: 11489 - DNA, 3489 bp, Homo sapiens; identical to SEQ ID NO: 11488

SEQ ID NO: 11490 - DNA, 123 bp, Homo sapiens
ttgttgccgaggctgaagtgcagtggcacaatctcagctcactgcaacctctgcctcctgggttcaagtgattctcctgcctcagcctcctgagtagctgggattacaggcacctgccaccac

SEQ ID NO: 11491 - DNA, 134 bp, Homo sapiens
gatggagtcttgctctgtcacccaggctggagtgcagtggcgccatctcggctcactgcaacctccgcctccttggttcaagcgattctcctgcctcagcctcctgagtagctgggattacaagtccccgccat

SEQ ID NO: 11492 - DNA, 134 bp, Homo sapiens
gatggagtctcgctctgtcacccaggctggagtgcagtggcgccatctcggctcactgcaacctccgcctccttggttcaagcgattctcctgcctcagcctcctgagtagctgggattacaagtccccgccat

SEQ ID NO: 11493 - DNA, 123 bp, Homo sapiens; identical to SEQ ID NO: 11490

SEQ ID NO: 11494 - DNA, 8737 bp, Homo sapiens
tctagggagaaggtgctttattctgggatctgcgtaccaggctggctggggtgctggagtgggaaggggaatccaaggagcaaaccaagaaggtcctagggccagcctaggcctccacggcccggccgttgatgacgcggatgtggcggatgacgtcctggatggcttcagatgttgtgccctggcccccgatgtccggagtgtgcatctgtaggacacaggcaggctcggcacacaccaggccctgccaccccccgctgtctcctgtgacgtgcaggactgggattgccacaggagggaagtggcaccagctaagggccagaagatggggccagatccagtaccatcctcccctgggggctgtggtcagtgcatgaggcgggctacaggaggctgcagggggagactgggcggggcagcagggtagggtgcgaggggaacctcacattctcattgtccatggatgccaggacagccttacggatggaggtggcataggagtgcagcctagaggatgggacagccagccttcagtccctggggcccggagggctggccaggggcttgcggggcactgggagccactcacttgaggtggtccagcatcatgcagctggccagcagggtggccgtggggttggcgatgttcttattggcgatactcttgccggtgttcctcgtagcctggggaggcaagacgaaggagagtgggtggagggcagaaggatgccgggcagtgactctgctcctgtgacacgtccagaagaagccactccacagggacaaaagcccaccagcgggtgccaggggttgggggaaggtgtggggacagatagcttatggggacaggctttcctcgtggggtggtgaaaatgttctggaatgacctggtggtgacggcagtacaaccctggatatccaaaaaactactaaatcatgcattttgaacgggctaaccggatgggatgagtgtgcctcactaagtctgtgaacaggagaaaggcggcaagccgcggcactgccaccggcactcactgtttcaaacaccgcgtacacatggccatagttggccccagccacaaggcctgggcccccgaccagtcccgcgcagacattgttgacgatgttgccatagagattgggcatcaccatgacatcaaactgctggggccgggacaccagctgcgggacaaggagggggctggctgaggagcagattcggaagcatgggtgagagaagcccagggcactcagggcagggggacagcactgggcaggctaatacctgcatggtggtgttatccacaatcatgttctcgaaggtgatctgagggtagcgggctgccacctccctgcagcactggaggaaaagcccatcgcccagtttcctggtggggggttaggaataggacaccagcttggccatcgcaacagtcagccagagggacggggcgtgcagagggccccaggaggctggggtctgaattctaacctgtccctcaccagcaaaatggacagaatcccaccccacctcccctaagtgtgggttctggcaaggcctcgagggcaacagggcactcgcctagggtggcacctcggtgggtagctgggcttttggaccacaaatccctcagagcaggcccaagcaggccactgcagctgcttctggactgctcgcagagaggtcaggggacatacatgatgttggccttgtgcacggccgtcactttcttgcgcccgctctcctgcgccagcttgaaggcatactcggcaatgcgcagggacttggccttggtgatgatcttcaggctctccaccactcccgccacactctgaggagggcatggggagaagagacccatgtgctactgaagagcagcactggccaaacaagctggcgcgaccgggccaccgtgggaagcaaccctgtctgcctatttctggcttctccctcgggcacagcccctgccctctaagggtacacctgtccctggttccttaagctctccccttaatcttgacgctgggggggctcatctcgggccccccatgcacacctcatgctccaggctgctgtactcgccctctgtgttctcccggacaatgaggatgtctatgtccttgtgccgggtcaccacgcctggaaggctcttacagtggatgacgttggcatagaggtccaggctggtgctgggaggggacggagaaagaggctgctaggcctgacaggtggctgactggagccagactccactggctcaccccaccttagccccaccaagcccccagcccgcacacccggatctcaccgaaggatgttgtttcgagatttgtgcgacggtggcaggttatggttggtttcgatgttgcctacaaaacacaacacaggcttagtggcactgcccatccccgccccacctcagcagggcagctgaaggctgccggggtcagaagacttggggagcaaaaatgtttcctgaacactagaatgctagaatgcaacttccagcctaagccccacgaggctacacgctcagggatctcgaagggcacctggtgcagcaggtgctccatgaataacccctgaacgacggaatgaacaagtcaataaatgaataaaggctggcaaccagccaggcagccatgccattctccatccaggctctggagcaacagaaagtgaccactctttactaacaggttggccggccaggctggagctagcaaggtggccttggcggtgttactgccaagcccccgcatcaaggcaccacactcagaggcaggcgggggctgcctggagaaggccacggattggccggaccctaccctacgacccaggacacctggaggaagggaagcagaggccagtggccgctggagacagcagtcagagggcgccaagcagaggccgcctgctggtgagcggtaccccacccagactgctccactcacagcgcgggggtcccctgtggctggcacaaaggcccctctacttgactgccagggcctggggctccccctgggttcatctttgctcacacgctcctcacacagtgcaagtaatgggctgagtgtgcaaaatgagcaatggaagtagtttaaggacctcaagtgaagccccaagaatccctgcctgggctgtgccatccacctccaggctggctgcagccgaggagccaggcagagggtcggaactgcatctctgtgatacctggtttgtgaagaaagatgctgagggtcaaagctgaccccagcagagaggactgtctcaggagggaaggaggggtgggagggaacccatcagggagcccgtcactggacaggctcacacacagctgctctcactcgaatcccagcatcgcagcgcaaacaggcccgaggaggcgtccacccagtctccaagcacgagggtcctctctagccagacaagccctgaaatcagagccgtggggccccacaagagtcagctcagagggaggtaaaagaaatcacaggggctgggcacgacggctcacgcctgtaatcccaacactttgagaggctgaggcgggcagatcacgaggtcaggagttcaagaccagcctggccaacatggtgaaacccactctctactgaaaatacaaaaatcagctgggcgtggtggcgggcgcctgtaatctcagctactcgggaggctgaggcaggagaatcgcttgaaactggaaggcagaggttgcactgagccgagatcacaccgctgcactctagcctgggcgacagagcgagaccccatctcagaaagaacgcaagaaagaaagcaagaaagcaaaaaagcaagcaagcaagaaagcaggaaagcaagcaagaaagcaagcaagcgagcaagtaagcaagaaacgaaggaagaaagcaagaaagaaatcacacctagggccccatcctggcccctggccctggagctcacccttcagggccacgcggttccggcggatggccatgatggcattgcgaatgtcctcttcatcagcattggaactcacgtgcacctcttcaaagtccactggtacacatgcgtgcctgaggcacggcagggtcagggaggctggcccagacccccccgcacctcctccaggaagcctgcccaggctacctctctcctgttgctacctgccctgacctggctctgactgagaagggactgggcccaccttcactgactgatggggacacgcttgaactccacaatgcacactgtggcaggactggtgccaccttccccgagcccaggccagtctggcgggatcacaggccatgggacgcaaggcctgggcttacaggtcgtcttgccatggcctcaccgagtgcttctgggcgcaatgcccctcttggcacaaagtcctcagggccccctggctgaggacaaggcggggacccaggagctccatacctgaagacggacttgacatgcagcatgagctctggcccgatgccatcccctgggatcatggtcaccgtgtgccgcccgccatacttagcggacggaggctgtgggaggcagagggtgaaggtgggccttcggggatcccacatgcccccagctcggcccccatgggctcaagccaattcccttcttcccactggcgctgaccccacaggctgccccgtcacaaggtgccaacttggggcagccccgtcccagacagggctgctcatccagggctcctgggtcagcagcagcccacccccacctggaatttagttaaccccaaagcaactaagagccccccaaacctaacaggcagagaagaatactcacaattgtttgttcctagaaaggatgagaaaggaagaagacacaatcagccaaggttccaagagcaaggccgtgaccaggaaagtgggaccttttcccagggggatgctggctagtacaactcccagaagaggggtgggtagcccctggagaccacgtctcagaggacaggacacaggccgtgcacacacgcgcacaattgcggccacatggagaaagacacatgcgtgggcacgggcaggtacttactgaaaagatgttcctcgaggggacctcgtgggcgcctagaacctggcagagaccaaatgccagcggttggtttgatgtctaacccagaaagccaagttggaaggaaaaacggaccgtccccactgtgcccaggcaggtcccctgtctgtgcagcatggcccactgccaggggcacaatagataattagctccaaagcctcagtccccagggccggcccgctggagcacctggaaagtagaaggcgctccagcctcctgcctccttccgctcttcagaaaatttcttaaaaggcgtgtccctgccctccctcctcttttttgcttctgattatttttttggccagttattcccgctcagcgatgtttgtaacatgcaaaaactggcaaactaaccctggtacagcagggaaatcattacaacaaaccacagatccatgacaacagtcacgttatcacttcgccgatcactttttcttattacaaaagcagcatgtggtcgctacagaaaaagcagaatagggagataagaaggtagcacccagcctccggcctccctgagacaagcactgctggccccctggggaatggcccttcggcattagaaatcgaaaacaaatgtgtagggacatccagccatttctggaaggttgataacagaaacccaactctaggaaggccttcggaaaggactgctggatgccgaatgtccccaacgccctgactggaaatgccggacagcttcagagccaaagctgcctgagccaaatgtgccaggtgccaagtgacctgctgtcctggaagaagccccacctagaacacacctgagacggtggcagagccaaggtcttccctgtcacttggggatgccctgccacttgaccaccaggcagcagcaaagtgttccagccaatggcagaagcatcatagccattggccaaagagccatgccttccagctagaagtccagaaaggctcgggcggagtctgacctctccctgtctgtgtgtccctggccggcactcatcagtccaagccaggggctaggagagggtgcccacaaggaccagagccccgaggatagctcagctgatctgtgtggcacctggatctgcaagcacaggcacggtcgggacttttctgtcttctctctagcgcttatcaacgggtcgggacttttctgtcttctctctagcgcttatcaacatctgaaatcatcttatttgggggctcttgtaagcacgcagaaagcggcttcgatggaccttcctccagggagctttccctgatgccctaaggctactgagctgggaccctaaggccctacttacccccttccctaggttatcactgcattgctccctcctcaacccctgagcccgagaggaggggccaagtcagtgtggtccaatactgtcaccctaggacccagcacagtacctggcccagagctggcacataaggaacatttcctgagtgaacaagcacatcagaaaatgaaaaaagatctggagactagggaggcctcggtccaaatccaccatccactcttcttgagatggcttcatggcctcatctgaaattcacagaacggaggtacctactttccgtgactgttggaaagattaggggacaggaggtgtgtgagctgctcacagtagctagtgccacacagcacgcctgccccttcaccccactggcccctcaggtcagagttcaaggctggtgtccctgggaggtcacgggtggacccctgcagctcccagcagtagttcctcctgggcttcagctgtggcagcaagccaatctcctgagagcatggacctccctcacagatggcaacatcaccaccagggctgagctgaacctctctgccacccggtccctgtgccaggtgttcctttgggctttggcaaaagacccagagagcgctccagatggacttccctgaccttactgtacagatgcaggcaccttccttcaggaggtcgcaaaggctctgccttgtgccctgacttccctgtgaagccaccaatcaaaggagccaagtgtgaggcaggatgcaatatgtacacgcctcccgctctcccatcaccctttcatggttccatggaaagaaagaacatccacaccccacatcttatgcctgctgaggcttctgtctttggcatatttctgttggaccatgtgtcaatggtggctgcatgttttcctatggcgtccaaatcagtgggattcaagacctggggttcctctgtaagggttctcacacccaggacggtcagtctcagggcaaggcactgcccagctacccaccgttcactgtcccctactcccaccccaacgcacacacaggcacacacacaggggaggtcagggaggaggcacacatgtcttcaccaagagcctacaggagcccagttgctggagccatcagagcctctggaaagccactatatactgccgtcctttcagcagcaaggtgggagaagtcagcatcgtcaagagaatttcattaggcacaagcagtctcccccagaggtcagaaggagaaaacatggcaagtagagatgtccctggggagtggccgcaaagtcacggagttctggaaggtcagagttgacaggatcctttgagaacatgaagtctcctcccctctgggttccaaaggggaaactagaacccagagagaggaggaaatggcctaaggccacgcagtggctcagtgtgggagcatggcctagaggtcaaacctcttacccatcagggccaggtgctggctggcagctgcttcagatggtttccagcccacctaggacctaaattaacctcttcttaaataagtgtaaggaaagaagactcggacctgaatacgcaagaccgcacacggagaagagcagaagcaaaacccccgcagcctcagaaaccctagctccttcccattccaggcgcctcgaggggaaggcatctggggctctaagactgggggactatgggggatgactggcaaagtccggttctttgccaccgggataggtggcaaagcggtccacgagagaggaaaccgtggagaaatttgagtcccggaaccggattcccgaagcggtttgagaaaggcgggccgggatacgtgagtgactgcctcagaagggctccttcaaggacactaaggaggtgacagccgccgtggcccactctcccggcccgtccggagggccccccgccacccgatgcagaccccctgggggagccggtccagggccaacttcggccaatcccctcagtgacagcggaggcggccaatcaaccccggcgcgaagccctttccccgcccctggtggggcccctagccaatcggactccagactgcttcgggtgcggctaccccaccgctcccctgcgaccgctgccgcggtcccgtggctctttccctgctcacctcccagggacggcagagaagggctggcccgagcaccgccttcgcggcgctgccggcgacggtcgctaccttcagcgccatgacggaaagtgagagcctccgcacgtcccgacacgcagataccgctctcgcgagagttcgacggggtgcgaagtttcggggacaggcgcggacccggtactgcgcacgcgcgcggtcgcaccgattcacgcccccttccggcgcctagagcaccgctgccgccatgttgagggggg

SEQ ID NO: 11495 - DNA, 1886 bp, Homo sapiens
cagaggctggaggccatggaggctgccacccaggctgagggtgaggggccacagagggtgatgggccgtggagcgcagcaaaggctgcaagacatctgctcagcagctgcctccaccccgtctccccagactctggcttgagactagacgggggcagcggctccacatcctcttcaggctgtcaccccgggggcgccagagcaggtccctccccagcctcttcctcccccgccccagggggcggccgtagcctcagcgcgggctcacagacctcaggcttctccggctccctcttctctcctgcctcctgctccatcctctccggctcgtccaatcagcgagagaccgggggcctcctgtcgcctagcagtaagttgggtggcaagtggtgggcaggcagggctggcagtagtcggaccacttcagtctccctgctctgccttccccagcaccattcggtgcctcgaacctcctggtgaaccccctggagccccaaaatgcagataagatcaagatcaagatcgcagacctgggcaacgcctgctgggtggtatgagcaagtgtgggagagcagagtggggggccctgctccaagggtggaggcacagggccgctcttggggagccctaccccagtctgcagtgcacgtgaaccgtcggctgggtgggcactggtcctgcccagtcaacagcactggggccatggccaagggcaggggccactaggaagggatcagcctcagcctcacatcactgggcctgtccctcttggaggacctggggaccccgaggctcacagcaaaccccactgagctcctcgggtaggcggatcggggtggggcaggagtccgtgggggcaggacagccttggccccagcccgtccccagggctccccttgcttccagcacaagcacttcacggaagacatccagactcggcagtaccgggccgtcgaggtgctgatcggcgccgaatacggccccccggcagacatctggagcacagcctgcatggtacgcccgcccgggctgccctgtgcccagggccagcagcccaccagccagcagcctcacctcctcccccttccaggccttcgagctggccactggtgactacctgttcgagccgcattctggagaagactacagtcgtgatgagggtaaggggtgagggctctgggctcagcctcccggcctcccggcctgcctgcccccaacctcctctttctgcccacagaccacatcgctcacatagtggagcttctgggggacatccccccagccttcgccctctcaggccgctattcccgggagttcttcaaccggagaggtgagggcccgggcagcctcaggccatgtggctgcagggagggtgggacggggaccttggattctgcaacagagggaacactgggtcccaggagccagggcctaagcagaaggcaggtccagagacagggacagagcctgacgcccgctggcctgcccgcaggagagctgcggcacatccacaatctcaagcactggggcctgtacgaggtactcatggaaaagtacgagtggcccctagagcaggccacacagttcagcgcctttctgctgcccatgatggagtacatccccgaaaagcgggccagtgccgctgactgcctccagcacccctggctcaacccctaggcccggctgtggctccacctccagctctccgtgccttaagggaaaagcgggacagctcccaccaccctgctgggcgccagttctccacaaccacagggcagagagacgctggagccaggcccggctctcagagcgtgttctgcctgagacccccgtgagggctctcggagaaagtgtgtgtattcctttcttaataaagtgtggactgaa

SEQ ID NO: 11496 - DNA, 4005 bp, Homo sapiens
cgaccagctgggcccctggctcagggaggggccacgtcagtgctgccagagacgtcacaatgccggcccagccgttcggtgcgcgattggctgccgctgccacttacgcgtcgctcttcctcgtttgcccctcgtgttcatgggagctcgttttcttttcctctaggcagagaagaggcgatggcggcgatggcatctctcggcgccctggcgctgctcctgctgtccagcctctcccgctgctcaggtagcggcccagccggggcttctttcttgcgagcctctgacccacggcaggtggtgttgggggcaggagggatgcgggggtccggcctttcagggtccgtcgctgcgggccgggccttcccccgagaggcaggcggccttgggacggggggaccaaagcacctcgcgcacgtttaccggcagccaggcttttccttgtctgcccatacgaagaggagtccccgagcctccatggtgcgcccggcccccaagctgcagcacggaacgtgacacatgtcccggctcccgctccctgcggggtcggaccggagcgaagctctgtagcgctgagcgatcgcggccaaaaacggggctggaggagccacataagctaggaagggacctcagtgaggagagggagcaagagcggggcgagttagatggggagccaaaggtgcgcagggccttgagtgccaggccgaagactggcttttccggagggccctgccttacccttaccagagttttcggcagagccgaccaggggtcccgtcgatttgcattcgtgaggggctgaggtctgaactccagagtgtgtttaggaggtggctgcagcagccagccccgggcccgggggccaggactggacaggggcggctttctccacattcccttttctgccgtccttcaggccagtagccttgctgcctgcaacgttttggcagcctaactggcctccctttccgcacactcctcatctgcccctcaggaattccctgaactatagtcagggacgtatccagaggacaagcctggccataaaacccttcgggggctcccctgcgccacaggaagcaggcccaacttaggcaggacacagaagggctggcgggatctagcccctgagaactgcctccacgctgttcctagggatctgcctcctgtggtccagacccagagccttctctgacgtcctctgctgaagccatcgttctgccagggcaccacatttggacagcgggtggctgagaacattcccactttggggagcctttgtttcacaccctctgatgtaggcggcagccttcctttcctttgggcctctggttatggagaaggctaaggcaaggtcctttctctcacagctaacaagttgtgcttctggaaccagagtctctcccgtttacttcttcaggaaacgctggggccagtcttcaccttctgtcaactggccgggggcagagaccctttctctcatcttgaaagccccagtgcattgcctgcctgcagcccccacccccgatgtctctgctgaggatgccttcagtaactcgtccaggccgtttgtggctctgaattgaggctggcgtggcccccgggcctccgtgtcataggtccaagtgttggcatgtattgtccagtgaatccagcccccacctgtccccagttcgctcttcctgcacacctccagaaagccggccttgcccctccccagccttccttcacagccatcccgcctacgttgccattgcatttgtgaccgagcacttggatctgtctcgcatatcccacctggaaggggcaggaagagcgcatgggtccccagctgatccgtgctatgaggcagggccgggccatcctgccctcagaccgggatactcgagctggccttacccaggcatctctccctcttccccgcagccgaggcctgcctggagccccagatcaccccttcctactacaccacttctgacgctgtcatttccactgagaccgtcttcattgtggagatctccctgacatgcaagaacagggtccaggtgagacagtggggtttcagacaggagggcgggtggggggtgctcctcactgctagttgatgggggacctgtgtcgatagagggagaatcaagattccaactcttggggtgccggagagatcagggcacggtgatgccagatcctagccagtgttgacaggtcaccttcctcacctgctttgtgtgctgtgcctacacgaggtaaccctgggctcaccacccgctgtttcctgaatgagtatctggaccgggagaaagggccaggagtcagcccaccccggttgccattggccagtttgtctgtgtgggtgttttgtttttgtttttgttttttgtttgtttttttgagatagggtctcactctgttgcctcagctggagtgcattggcacgatcttggctcactgcagcctccacctcccgggttcaagcgattctcctctcagtctcctaagtagctgggatgacaggtgctcgccaccatgcccagctaagttcccataagtccaaagaaggaaatggggccttttttgggtatggccctcttagggtaaagcaccccttgggcagcccactgggcacccctgaccccagcacctcccttgtagactcaggaaatcactcagcccttttgatcatcccgcccctgctcacagtcaacagggttcctatgcgtccagttaggcccggccatggggatctggccttgtgcccccgtagggaagaccaatgcagagggccagtcacgggattggtgagtgttacctggtacctcctgccagggacactgcagcccccaactgggcctagcctgcccacctgcaggccgtgtgagcagcgcacagggctcctctgcccacacccagagggggcagaaggtgaccctgcctttgttccctcacccagaacatggctctctatgctgacgtcggtggaaaacaattccctgtcactcgaggccaggatgtggggcgttatcaggtgaggggccaatggttcccttgctagggggctccctgctcccgggtgtgacctgaagccccaggggtggccggtcaaccagggccaggggccgtgggctctggctgccggagtgctgcagtgtcggcactggtggtcagggtggcccctccgtgtccactctgcccacactctgctcaacacccaacccaggtgtcctggagcctggaccacaagagcgcccacgcaggcacctatgaggttagattcttcgacgaggagtcctacagcctcctcaggaaggtgaggactcctgtagcccactgtgctcccctgtccctggggagcaggatgggctgggttgggaggtgctggcagcaagtcctgagctgggtggcctttctgtgatcctgtcccttcctcagtgtctcttgcccatttctctcctttccttttctggggcttgggccggtgttcctacctgtctttcccctcccctccccacccccacacgccaggcacccctgaccccagcacctcccttgcacctcccttgcaggctcagaggaataacgaggacatttccatcatcccgcctctgtttacagtcagcgtggaccatcgggtgagtggcctggtccctcctcctttttggggttgttgggctgagtgaaggttatcctctccacagccccagctctgctgctgggccgtgattggccagcatgtcttggttcccctggcggaaggtgaccagggctggctggtctgctcacctgtactcccctgagctggcttgtgatctcctttttttcagggcacttggaacgggccctgggtgtccactgaggtgctggctgcggcgatcggccttgtgatctactacttggccttcagtgcgaagagccacatccaggcctgagggcggcaccccagccctgcccttgcttccttcaataaacatcacaggacctgggactgcacaggacctggggctgctg

SEQ ID NO: 11497 - DNA, 5569 bp, Homo sapiens
tctgggtgttgtttccagatgtctgtatggtaattgcatcagaaattgccgtggatattgtaaaacatgcctttattactaaattcaatgacattactgcagatgtatgtattttgatatgcacttcaatgtttaaagtttacttctgttgcttaatttttaaaagttgtagaataataggagtttgttaatactttaaggtcagaattgtaattttaagtttctaaaaattattacactattgaaagtattctgttttaatattaggcaatgataattccatattcttggggtagaagtatagaccagccagtagtcgaagtcacagtgtcactaactcaaaatcattctgatcagttaacactgtcataatctgtttaaagactttaaaatcacattgtttctattttaaaacttagaccatcaaaatttttctctctggctaggtttttaaaatattttatatttaaaagttgatttttttccacgattatgaataggttcctgctaagttttagaagacgagagcctacatttttctggtgaaagtgtttaaactttgagaaatttgttttatgttctaaccagatgttctggataatttctagaaatagatatgtggctatagatttattgcatataaaacataagaaagtttcctaatgtagttctcattcctgtctcagtcccaaaataaataatagttccacagttttctagattttactgggtagtacttttaataacagtctcacagtaatatttgttttgtttcaaaaggcaattatttaaaataaaatgcagttgcaacaactgtgattcaattatgagtttctgaatgttttaatatacttaaagtaaatacagttttgtacttttttgtaaagcattgataaagtaatttcaccatttactttctcagctttcttaatgcagaatgattcccttttcataggatcatttatttagcatctgaagtcaaaattaataggcttgattgagacacttgtgcactttttagtggtaatgatcattcacaagtgccttcatatttactatgttccctaacttagttttatgtctttttcagcattcatttttctcagaaggcattattggttagacaaacagtaatttttttaaactattcatttaatttaaaatttcaaaattattttatatacattacactacttaaaatagtcactcttccccaaattctaaactctcaggatcatagtcgttggatatttattcccctttaaagaaaaacctttagaagatctatgaatgttaacagttcggtggaattgaggttacattttacctttactgtaggaaaacaaataagaaattatgcccagatgtcagcttggttattagcacttgttcctggttaattattaaatgtttttattaataaagttgcagtctttccacattatatatttttactgtattacttgatatttcattcttgtttgtttttaggtctacagtgaatatagagccagtcttgcttttgaccttgttagcagccgacagaaaaatgtgagcatttatcaagggcgtagtctgaaattaacaaaggcatagtctgaaattaactgaataatgattaatttagcatgaaatattaactaaaggaaagctacataaactgcctactgatctctattctcaacactaaataaacatttacaaattaagaataatagtaatacttaacattaagtagtatatgctctttgcagcattttaagttattcaactttgtatttaagacttgtgaacatttggatttccacatcattttataagtgccaggttctgttcttgctccatagcctcacctgtttagaacatttgctggtaataagtgaatagtacttttaaaatgctgtttaaatcccataaatctgaatcttttgcttctttctctgttcaggcatacactgattacagtgactctgtagcacggaggatgggctttattcctctcccactagctgttttagtaagtgcatactttttaatgttttttgtaacaaagtagccatcattatagaatattaataaatggattattaatatgattgtttcaaaaggacttgatataaaaattaagggtaaataacttggaagaaaattttgttttaaattatagcagtagcttatatatccaaatatctattggttgagccatccaatagatgagtgacgcttagctgttttatgtaaatggctttcctaacaatgagaatactcttttttgcttattcatttagtaaaaaacattttttaatggaaatatctgagcatggtcattaacgtggccactgcaacacatattggtggaagtataaattaatccagtgtttctacaaggcaatgtgacagtatcatgctttaattcagtcatttcatttctaggaattatcctaaggaaatagttataaaagacacacaatgatttatgggcatggctttgcatttcagtgacatttgtaataataaaaagttagaaacaaacgaaataggttaaaaaattatggtatgcccaaatgaagacatattctctatcagtggtaattaatactttttaaaaattgtccaaactttttgcaatgaaaattcctgcttttatacccaagaagtatgtattttttttttactcgggaggctgaggcaggagaatggcgtgaacctgggaggtggagcttgcagtgagccgagatcgtgccactgcactccagcctgggcgaaagagcaagactccatctcaaaaaagaaagaataaaaagaaatatgtatttttttcaaaagcactactgaaacttactaaatcaaccctcaacaagtcatcaactttgaatattttaatgaattgcccacaacaggcttgcaaatagtttctagccaggttaggctataataatgttaattaagacgatttgtttagcctggcttagtggcatgcacctgtagtcctagctactcaggaggctgaggcaagaaaaaaaaatttgctggctgcacttgtatttgattatgttctttcttgactaccgattctaacatcgaaacagatgcaaccagctgggcacagtggctcacacctgtaatcccagcactttgggaagctaaggcaggtggatcacctgaggtcaggagtttgaaaccagcctggctaacttggtgaaaccccatctctactaaaaatacaaaaattagtcaggcgtggtggcaggcgcctgtaatttcagctacttaggaggctgaggcaggagaatcacttgaacctgggagggaaggttgcagtaagccgagatcgcgtcactgccctccagcctaggcaacaagagcaacactccatctcaaaaaaaaaaacaacaaaaacaaaacaaaacaaacaaatgcaactgtcttttttgccaaaggatatctagacttctatagctgcagtctcatgcaaatcagctaagaaatgtgtaaagaaagtgaaggtcataccagctatgttttagaccagcttccttgacttttttttagatgacagatgattaataggcttaatgctatttaaatttcagtgtgcctttacagacaaccacatccctaaacatttttaattatattaatagcttgcttattacatcataatatagctttcttttgcttcggaaaaggaactcctagaattttggaaaaatggaggcttctaaataataaaattgtttgttaaaggcttaagagattgataaaatagaatattaaatatttccgcatttgtttactacaactagaaatatgaaacatacaaatataaggataaacctacaaggcctgaatttttttttttttgtaaggattggtcagatggttggatttaaatatgatcctgctttgccaaataataattgacttatttgtctagtaacttgtcagaaaactcatagtatgaactttttttgatttagtatttaaaaatttttcttcaatccttgttttattctttaaatgagtttttatggctgttataccaaaatatttatgaataattaataattgacaaaacacttttggaacacctgcagtgtgctgaaagggggtcatatagttaggcagagatctagtgggcttccttccatagcactttgctcacagagcttcgtcgtgtgccacagctttggcgggcatccaggagccttgagaaatacatcgaggcctctgtgacaagttaattctttaattaaggcacaaggatggcaattttttcttctaagcgttacattgggtcgtaaaatgattttatatccgaaaaaaggaagaaaaaatgtgtattaaagtctcatggaaattagactgagtaaaagttaactgataatatgctaggtgaaagtatagttatttaagccttaaatgtgatcattggtttgcctttcatattaatgaataaaatcctggagtcatgttaacttcagtcacaattgcctatacagtagacattaccctgtagagactgtgacacggttgagggcttccattgtcacttttctcatagtgagagtttattgaacatatgacaagccattgccccagctcttcccaattgttcttttattaaaagcatttttaaatgtctttttaaatgtgtaccattatgatgtttatttaagataccctaatagactttggataacttgacattactagataagacgacttctccctaattctctatttctcttttaacatatgggcatagcagcacttgtaacatgtggacattttactttaactgattccaccagatttattcagcagacttccaaggataatgcttttattcctttatttctgtgaaagaagtaagaaaatggatagttaactgtatccaaaagagaaaactgtttcaatgtttaattaattttttaatagtgtttagtttttctaaatacaaaacttttaaggttccatttttcctgtgttccctgtgagttactgggggttcataaaagagtcaaagaagaaaggacggagggcaaaaaaagcaggaataaggaaacacccaccaaataattctagctttggtgtggacacgtgtagcaagatgaaatcatttgtactttgcagaatgatattttataaaaatcagctgctttgcatccctgtgaggtataagtgtgacattcatgacctaagtatagggccgaacttagagagtccacaggagtcaaactgttgcactagccacaggcatcccagatttgcttgaaccaatccaaatgtaccacagaaggtttcacaagcaggcagattttgatacaaatcaacaaatctgccttcttggatttttagacaaaggccatagatatatgcctaaaatgttaaagtcagcatggagaaatctttttaagtattaactaataactctgtggttgtgtgttctgtttgtgtgtttttgttgttttggtttgtttctggctagctcatcagagttgtaacaagctcaattaaagtgcaaggaatcctgtcttatgcctgtgtcatactcttctattttggg

SEQ ID NO: 11498 - DNA, 851 bp, Homo sapiens
gacatacaatgctgaactttcccccaccacacccagtttctcctctttccctccagactcactcttgccagctaaggtgggaggacttgccagcctctgccattactgctctctgcccagtgcccctcagggaatagctgcttagcagcagggcctgggcctgggctggtctagggcttggccaaaaagaagccagacaagtgccctgccttgatgtcacagaaattcccaacaacaaatagacaacaactagaaaaacaagtcactctattgacagttggtaggaatcattaggaagaaaagcacagtagtatgaggagatgaatgggagaggcagatacagctgccttagagggtggccagggcaggcctctctggtgagctggtgtttcagtaaggaagggagctgtgcagccacctgggaagagcgtaggctcagcagaagggcacggggacacaggcctgatggaggaacagcaggcaccaggcagctgcagtagtccatgagcagccatgggggaggagggcccggggacgggagactacgaaaggagctgagcagaagatggcatggtggctcatgcctgtagccccaggactttggcaggctgggtgggaggattgcttgagcccaagagtttgagaccagcctgggcaacatagcaagaccccatctctacaaaaaagaaaattagctgggcgtggtggcatacgcctgtggtcccagctgtgcaggaggctgaggtgggagattgcttaagcccaggagttcaaggctgcggtgagcgatgatcatgccactgcaccacagcctgggcgacaatgcaagactgcctcttaaaaaaaaaaaa

SEQ ID NO: 11499 - DNA, 2757 bp, Homo sapiens
gactaggaaggatgtcagggcttagaacagggttgaagaaagggacaaaaagtctaaaaacctgagaatttgtgtatcgttgaagggcagtaagtgatgtacatggcctttaccataataaaaaggaagctattcaaggaagatgctgaagaggtgtcaaggtgataaggataaagaactatggtgtgacaaacaggtatcagtaaccatctaaaaggatgggcatggcaccatgtgtaggtgcaaaggaccacatagtaagaccattgtgaagtagtttttaaaaaagtcaaaagacagagaacaagcaaaggaactaataactaaaggaacaaccaaaggaactagcagttagaaaggggaagatctggaactcttaaaactaagtcattgtttggcttatgggacaaaccaaacagatagaatggttgcagtccctattaagccaaaaggacatgaaaacataacttcgtcatttttctctgacaccattgcatcttagattgttaacctcttccatgatagaacactgtataaagttcatatttagagtgaaaatgctttctgtatccaaaccatgtaccagatccatgtcttgttatttattacgtttcaactttttatgggttcttttctctctttaagaaaatatccaaaattgcatcctaattataaaacaagttaaaagaaaaaaaacaccattaatagacagttcatgtatattcttccagtaatttttctcggttatcatatacataaaaacatgtatactttattgtgctttacataaactgaataatactaaatgtttaacctaatctaactgaagtttttccatgataatatgtggggtgatttttttaaaattgtatagcattctagcactaataaacatttccttattatacatttagattatttttagattttcattgtataaacaatggttcagtaaacatacctcaacctttatctttgaatactttaggaagtatatttttttaggatggtcacctaaaattagaatttctggataaaagggcatatgcatatttaagactagtgaatattgaccgggcagagtggctcacacctgtaatcccagcactttgggaggccaaggcgggtggatcacaaggtcaggagatcgagaccatcctggctaacacagtgaaaccccatctctactaaaaatataaaaaaattagccgggtgtggtggcggtcgcctgtagtcccagctgctcaggaggctgaggcaggagaatggcgtgaacccgggaggcggagcttgcagtgagccaatatagggccactgcactccggcctgggcaaaagagcgaggctccgtctcaaaaaaaaaaaaaaaaaaaaaaaaaaaaaaggcatactggatttttatcccttatccatagccttaccaatgctggctactgtccatcttttttaaatacttaccaaatggactaagagggatttttcactgttttaatatgatttatttaatttttggtgcagtcatactttcttgtaatttgtcatttgtatatctctcctgtgaattgcctatatatatttcatggccattttctcattaggatttctttttttcttaccagtttctagaaatgcattgtttattcctcttcccaacttggcatcaagtgtatcttatgtttttctttctcataaattagaatgtttcattttcagttatattaattttccttttttcttaagtacattaaaaaaggtacaacagtgaaattctcatttgtatttgtcactctgtttcttattggatgagtaatcaggatttttggggaaataactggatatttcatacagcaagcaaataattcaaagcatgggaagttaacatagaggtggtagtggggatgcataaaatcgtagtcagtaagttaacaatgagggaaataattaaatttcactcagtgtttacaaacattggaaaacattctgacctgatgggtctgatttcttttgttggaattgttttgtctgtttaaggataatgtgaattactgtgtgtgtagtataattagaatataccacagtatcttaaaattgtttagcatatactttaatcagttggatctgcttcaccctcttctccccatgaagaaaattatatgttaagtgctcataccatatctacttatcttcagtaactatatttagccttagcattacaccagccttacagccttattcattcatttagtttctaaacattaaaatcttaaatactttttgtttaaattagttattattttgtttttatttttttttaatttcattttttctttttatcttcttggttaccaagttttagtgagttaagtggctgtcagagtattggaagggggtctgtttgaggatgaatggtaggaattttacatttgatgttgtcttattttaatgagtcaatacagaaagtacttcagagtatttatgaaaagtgtaaatctaatgttacatgagaatgtggctaggactttatggtttttaaatttctccattctaaaattatgaagatcaatttatatgtaaatcttacgcattaagaacatgcttattgataaatctaaatctctattttagagcaatatactttgctgcttattcaaactgcaaggaaaagttgaatgatgtatttgatcctgattctacccaagtacatatgatttcagctgcaatggcaggtatgaatgtataatattaaaaaaaaaaaaaa

SEQ ID NO: 11500 - DNA, 268 bp, Homo sapiens
cccttatcgtattacaaattgtttttaaggctttttgtatttattaattgtcagttgattcactgaagctttaaaactggaagggacaatccaaaggtcaaaagagtgaaatacaatcatttaccaataaggaaaccttgggcaaattatgtaatttatgtgaacctctcttagcttacccatggaatgagtcaagtggtctacatagatttggattttgagaattagttctttcatttagtgttatagagattatcttgttacaact

SEQ ID NO: 11501 - DNA, 8062 bp, Homo sapiens
gctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcaggtcagtacctggaagattccataaagtcggggtgcttgagggcgtagggccgagaccgtcgcgggtactgaggcgcctccgtcgtctctcccactcgccgcccgctttccaagacatatgtcccgcttgcagcccatttcgatgctgcgaaacggtgagctgcggggtgtttggggaagagctcagagactgggaaatgggaatctgctgggagcctagggccgcaatccggaaagggagctgtggcctgggtgttggcccctagtccaccaggacagtgccggaggggaatggctggatatgggggcgggggtggtgagatgcaacgcgatatgtcagcagaaccccaagagaggtaataggggtgggaaacctctgacaaccaggcctccgaattagaaaagagttttgtgttctggggactagtccgtccaccaagcgctcagtggcggcagtttcccgtctttctgcctgtggctgtgtcttactgaccatggctctgtgtctagtgggtccaagcctctcccgggtggccagtctttctgtaggttgcggcacaacgccaggcaaaagaagaggaaggaatttaatcctaatcggtggaggtcgatttgagggtaagaccatctggggaccctaggagggacgggggtggcggcgggggtggggagaaggcagagaaggtaataatctaggtacatgtctgagtccgaatgtgtttcttgcactccccggactgtggcgaaatggcgtgctttgtgtgtctgtggttggggggaagtgggggaaatgacagcagggaaacctatcggatagtttgttcgtaatcctcctctctcaacagcacttactctccatgttttcgatctgtcatcctgcaggtctgctgtagcaggtggctccgcttgaagcgagggaggaagtttcctccgatcagtagaggtcggtgtgggcgtgggggctgcctggaatgggggaggggttagaaatcgccggcactttggacaggctcttccaatcctgctttattttccttacctccctcccatttcaggctagggagggggcagacctgtgcatgtctgggatagcataaagaggttaaaaacaaacctgataaccggaatggtgaatcaggaaagcaacgaatcaacagtcaacccatcaagtgctccattctcactggctctggtctctctgcagattggaaagattgttgggagtggcacaccactagggaaaagaagaaggggcgaactgcttgtcttgaggaggttagtgcaagggttctagtcaggtccctagggacatctgaggttgtggtgactgagaccccagcagagtctgtggattccattgacattatctaggctttgggcggggtgacctgggatggggagggaaaggctgaaatgagaggcatagagatttcgtcaacaatctacatttcctacctagcattcaattattattatcttgtccctctgtgcagctccctgcatggggcaacacaagcagaagagaaactcaaacccaattttcttcttccactcctaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacactaaaaactggagttatagatatccagatagaaacagtagttatctttgggtagaagaataatgagtgatctttacttttttactttttattcatctttgtgtttttatttatctaaaatgggtattgatttttaggacggttttgaaaaagaaaagtgttgggaatgaagcaagtgattgattggaaaacatactgaatggaagaaatatttagattaaaaatgaggtaggttgaagtttcttctctgaaatgatagataaatggtgaagataaggcttattgtgaggattcagtgaggtaatatatgcaaagtacttacaatgttctggcacatagtaattaattaagaaaatcgagcacccttaattacctagaatgcagggttgttagttttttggttgacttttgttttgctggggcattctgccatgttttagtgtcatttaataaataatagtaacaataaaggttaacatttattaagtgactactgtgtaaagttctatcattcctgcaaggcaactgttaaaataatttctcacaggagtagagttttctttctttcctaaaaatccaaagtgtttcctcagacatgatcacaccagcctccacaatatatttctagttgtttgggggatgttatcctgctttatatatgaggccaggaaagggtaaaatcctctattcacttacctggttttatacccaggtttccctgtatgtactgtaatggggtgatggaaaagtgaactaacattttttcttgttcctattgttaggtgagagagagagatttgtggggagatggagtggggaggattaattcctttaaaataaattcagtttgatgtacctgcgtgacactcagatggggatatcctattgtcatttgaatgattgatctggtgctcagaggagatgaacaggctgcaaataaggatttgagagccattggaggatggatgataatggagcacatggaagcagatgtggcccttcagagagaaggtgcagagtcagagtgaagggttgcaaaagaaatgtaagggactatgggcagctggggagagaagcacagaattgaaacaatgtatacccttccagacacttttactattcatatacttatatattctttacataaaattggatcatactattgaaaaattttcagtgcctgatttaaaacttttttcctcaaaaaaagaataatattcattggagatataatacttgaaaaaatagagttgatgagtacaaacttgtgccttgacccagatatgtagcttgaacatctaacaaaaatccagatcaagccatgttgaacttgagatgcggagcgacttttacacctggggtgaaaatgaggctaactcgagtagtaaaaatccccagtgaggcaggtataggcctgactagcacccatctgctcctttccccattcctttgttccttctcattcttctttccacttccttcctcctacttttctttattttatccttctgggagatcattggtggtagcctctctgggcttctctgatccttcaattcccatgacgccatgccatgtatcagtgggcatttaatacagaataataactgtcattgctctggtcataagttgaccctgggtgtgactggatgccaagaatttttggaacctttgttggacaaaaagagactgagaaggaactagtcttaacttgtcacggccacatgtgcactgcatgaatttttgatgtcctgtacccggtcttatttagactgaataacccggagtctgggaaaggtgtatgagatagatgtgtgactgcttggtccaggcagccaggtcacaggttgatgtcccaatgttttcacataggaggttgtcactctcaatccttttggaaggggcagagttctaggattgtagctgattatggcagcccattggcacatggaggaggcagtgtcttctctttagagaggatggcagcttctgggaaaccaaggaaaccagaaactcagaggatgtcctgctattttggttttgttctcatctaacagttttaggaatataagtggatctatcccagtgcaaacatgttcaaaggcgattttacaaaagtggagtgttgttctgttgtaaattgtcagccaatatacataatatttcaaggctcaggaaatggattttcttttttgaaaaattcacattttacctgtcttttttcaaaagagattccaagtgtaggcttagcaaattgatgtggttcaggcaaattttatgtttatggctctctttcattaatttctttgctaagttcccttgagaatggccttttagataatgattcatactattttcaatgctagctttttacatttattttgcatcgcatcccaggctgaagatttttttccggtttttctgtttaaaccatggctctttcttgcttttaagccagagccgtgtcaccatcatcctggggtcccttatctgccctgccccgagggtatggtattagcaggataagtaatatttacttatctgagtggcatagctcagtgcttgaccctctccactggggccctctcaggtattgtgctaagggcttgggcaatgtatgctttaggggatagatgggagaggagggagaggggagaagggagtgaaggaagccttatcagagaggtaactttattctgacagggtgccctcaaagtaggagaacttggtggatccatctccactgtgaggataaagttattgctgaaatccaattcttgtattcaagagatgcagcacatttctccctggacacaattataaattttgtctgcccagatgctcctttagcagaggtagagcatcggtgggtggtagttttatgactattaacatatatgatcaaattggctatcaaaaagagtttaagagaaatatacttttttttagcagtgtgattaattttttaaattatatttttaaaaaaatgacaaataataaaaagtatgtatttatggagtacagtatcatgttatgatacatgaatacattgtggaatgattaaaacaggcctattaacatacaacacctaacatactaatcttttgtggtgggaacacttaaaatctactttttaagcaattttggaatatacaatatgttattattaagtatagtccccatgcaatgaaataggctactagaacttaatccatttgtctaactgaaactttgtgccctttaagaaacatctctcctttccttgtgcctccccttacccccatcccgtggtaactaccattctactctacttctatgaattcgactttttaagattccacatataagtgagatcatgcattatttgtctttttgtgcctgacttatttcacctagtacaatgttttctagattaacatgttattgcaaatgttgcaactgacaaattttccttctttttttttttaagagacataagacataagagtctcattacgttgcccatgctggtatcgaactcctgggctcaagagatcctcccaccccagcctctgaattagctaggactacaggccagtgccagtacacccggctggctagaattttcttctttttaaaggctgcattgtttccattgtatttccatttgcatgtgccacattttctttatccatccaatgatggacacttaggttgattccacatcttggctattgtgaataatgctgcaatgaacatgggagtgaagatatctctttgatacactgatttcaattcctttgaatatatatgcagaagtgggattgctggataatatggtaattaaaattttagttttttgaggggc

SEQ ID NO: 11502 - DNA, 398 bp, Homo sapiens
cttttccaaaatggctgtactaatttacattcccaccaacaatgttcaaggatttcatattcttgacattcttaccaaaattgtcacagtttgtaaaaggtagtctaataagtggcctaagtgaatgtgacaacacttcattgaaagcaatcttaggtttttccaactatagtcaataataacttaattgtacattctaaaataactcaaagagtgtaattggattgcttgtaacttaaaggataaatgcttgaggggatggatgcctcattctccatgatgtgcttatttcacattgcatgcctgtatcaaaacattacatttatcccataatatacacacttactatgtaccccccaaaaataaacattaaaattaagttttcaaaaaaaaaaaaa

SEQ ID NO: 11503 - DNA, 1228 bp, Homo sapiens
ggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacatatttgccttttcatcccatctagcaagcacagtgttaattttagaaattatagaagaaaaaatcagcaaggagtgtgggaaaactgcatgccccaggcctcccccgccccagggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtttaagccactga

SEQ ID NO: 11504 - DNA, 4866 bp, Homo sapiens
gcaggacccagtgctgaacacacacagggtaaatggtggtgtgtgaaagaccgagaaagaagctgttaattctgggcttccaatggtcagaaatgcagagatgaagggaatttgagctgagtcttgaagggtttagtaaaagggtcactgtcaaggtgaagaaaagccagtattgagggtgctgtatttgggtgagccatgcagagttagaggtgggctgaggcagagtggcctccaggagaaggtgagaggcgtgcccaggtgccaggcttgatcggcaggctgtgctcaggcccatttttctgattcattttttcttttccgcccaccctactgctgctgctttgcaaacaacacataaatctccttaggttagctgggatcccctgaaggcagtgcccactgcggcatagagaatgaagcggtgggccttagagcatgggaatgcgttccccgggtggctgcaggtcacggctctgcagcatagttcagagctggtgtgcgctgggtggagtcttgtcctttcagtcgccgtcatcctttcttgcagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtgtatctttcagggcagggtgtgtgtcagggaggacctacagttgcaagatgtactttaggatcagataacttgaaaccttttagaagaaaaagaggtgagagtttttagccagccagggaattagggtagcttgaggtgaatgaaggcctgtaactcttctctttcattggaagagccatttgggaaaagcaaggctagaattccccgtagaatgttttggtttgcacgtgtccgttgtctggtttgcagaggaagtgggacacttctgctttgtacctgcaaggatttctttctgtgcttttcagggggagccaccacctttgagcaggggataatagtttcatttatttcattaggccttgcctcttatgtcactagacactcgtctagtcccttgggacaaatcacttgaggccatggaattcaaagaccttcccaaaagtcatcatgtagcctgtccatggtgacatttgctagtagccactattttacaaaataatgtggcctctagagaggggatccgccttgttcacgaagcctctggttttgcagttaactttccgggccaggcattgattcatgaagagggtgaggtgttccagacagacagactcggagtctaggtggttcggctcctggagtgtgaactgggtaaggcttggctgcctgctcttcgcttctcctgcaaacaccagacgtcgccctagcaaagtatttaggcttgtacccagcacggccactgcaggaccagcccagcatgggcatttcctgtgattcaaggttgccacatttctccaaagtgagcccacagagggccctccaccggcagtccctgtgttacgagtgccttccctaaccagctgtgcagatacggctacgtcaccaactccaaggtgaagtttgtcatggtggtagattcctccaacacagcccttcgagacaacgaaattcgcagcgtaagtcagggagttagagggccacgcccgagtgggtgttttgtttttcctttttgactttgttttgaaatgctgagaaactaaaaatctggcagtggctgtgtgtatgtggcaaggtcatggtttgctgggtctttttcagatgttccggaagctacacaactcctacacagacgtgatgtgcaaccccttctacaacccgggggaccgcatccagtccaggtgggccctactttctgtgtcttgccaccttctttctgtaggacatgccttgccattttggttgccaaaatgcaaccatttggaaaataagggaggaaagatctttttaagctatgagcaccatccccctagggcagaggttttaaagccacaaagccccgtttctccacaccaactcttacacagatctccagcgcataaagtggatagagtgtgtgtggtgtggggagtagagcttgcccatttggcttcccaggtgtgcccagtgggtacctggggcacctgcaggactcagggccaagcacatgggcagtggctttcagggatcacacgtccttttgtagctacctgatcttttatgttgaatttggaacagtcaggaacctggtttgcaggtgtcttccgaatagtccacaaagtaaacagatttaacttttgaacatcatgagggaaatgtggggtccatgcccacattccagacttgctttcagtgagtccccagttccaagacataattccctgtggttggcagggaagaggacgctgcagtgatccaaggcaggcccctccctccaccaggacactgtcttggggccatcctggtcccagatgggagcaggcaggcgaatgtccacagtcttgcctcctgggctgcacagggccatccttgccacaccaccgctctgcctgcccatgctgctccctcctccaccccttcctggggccttgggaggctgcacagggaacttggaggcagcagatgggttctcagtgcccggtggggtgggactcctgtcctggcctctcagcggagttcacatttctggaccctggagaaggtcccgagcatcctgtggatggagccatgctgcccggcccgtctctgagcagaggggtggagggcctggctctcctctgagtgggtctgtttctcttagcagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcgccgagcccatagtgcgtcagtccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacatatttgccttttcatcccatctagcaagcacagtgttaattttagaaattatagaagaaaaaatcagcaaggagtgtgggaaaactgcatgccccaggcctcccccgccccagggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggccttcgtgacgcagaacgcgggaaggaccctgggcctttgctgacataccagccccagactacttaaattcagctttttttttaatgtgagaaaataaatgcacccctctctggtttaagccactgatttttgggttttctgttaggtgcagccagacccacctgtaagtactttttacatgagggcgttttcacaagccttgttaggcagcatccccattttaagcccaaggaaacagtgcctgatgaggcgctgttagtcgtggaatgctggagtcaggtgtgtgcacataagcagccttgggcttctgcggccgtgcatgcagccagggagcccgactggctgtgctttcagaggggacagtcgtcaaagtgcccagga

SEQ ID NO: 11505 - DNA, 5813 bp, Homo sapiens
gcctggcgccgagcctcccaagatggcggtgtgcatcgcggtgattgccaaggaggtgcgtacgcgcggcgtggggcgtccgggctcgcaccatcctcggctctccgctttctttctacttcttccctgggcttagaaggcaccttaggaaatgggacctggaggaggccttcgccgagctccagcggtcaggggcttcgcggtggacgagccgccaggcagaccctgactgagaccccagttccgcgctcgcccgtcccgctgctgaacgcacccctcggcgcagcaggtctcctccccgccaggacccaccagaaacctaggtggtcccgggcactacctccgtcctccgtcctcagcaggttctgcccgttctcccgtccagcgctggttccccgcggacggcggccccggccctcctgccagtctccccggagccgagttaaaaacaaatcggatcctgtcacgcctctgcctgagacctctgcagtggcttctcgttgccttaggatgctgtctgaataacctgctctgggatcctttccccccataacccttggcactctccgctccaaccaaacaattctgcagctccctggacatgctctgccctctcacctgtgggcctttgcacgcggaacacctctccccagctcccatcctctttactggcccacatacatttcaactggaaagcattttctgaaggctaagactgagctgggtggctgcccacacgctcctgctgcacggagccttcatttcctagccagggtctcccgagaccagactcgagaccgctccctgctgggcggtggctgctgctaagctgctcatgggcttccctcttggccaagatgatcatttgcttgtttgtgggtttattgactaggtatcactccccacgagggtagcgaggactcttgttcactgtatttgtgcaggacccagtgctgaacacacacagggtaaatggtggtgtgtgaaagaccgagaaagaagctgttaattctgggcttccaatggtcagaaatgcagagatgaagggaatttgagctgagtcttgaagggtttagtaaaagggtcactgtcaaggtgaagaaaagccagtattgagggtgctgtatttgggtgagccatgcagagttagaggtgggctgaggcagagtggcctccaggagaaggtgagaggcgtgcccaggtgccaggcttgatcggcaggctgtgctcaggcccatttttctgattcattttttcttttccgcccaccctactgctgctgctttgcaaacaacacataaatctccttaggttagctgggatcccctgaaggcagtgcccactgcggcatagagaatgaagcggtgggccttagagcatgggaatgcgttccccgggtggctgcaggtcacggctctgcagcatagttcagagctggtgtgcgctgggtggagtcttgtcctttcagtcgccgtcatcctttcttgcagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtgtatctttcagggcagggtgtgtgtcagggaggacctacagttgcaagatgtactttaggatcagataacttgaaaccttttagaagaaaaagaggtgagagtttttagccagccagggaattagggtagcttgaggtgaatgaaggcctgtaactcttctctttcattggaagagccatttgggaaaagcagggctagaattccccgtagaatgttttggtttgcacgtgtccgttgtctggtttgcagaggaagtgggacacttctgctttgtacctgcaaggatttctttctgtgcttttcagggggagccaccacctttgagcaggggataatagttacatttatttcattaggccttgcctcttatgtcactagacactcgtctagtcccttgggacaaatcacttgaggccatggaattcaaagaccttcccaaaagtcatcatgtagcctgtccatggtgacatttgctagtagccactattttacaaaataatgtggcctctagagaggggatccgccttgttcacgaagcctctggttttgcagttaactttccgggccaggcattgattcatgaagagggtgaggtgttccagacagacagactcggagtctaggtggttcggctcctggagtgtgaactgggtaaggcttggctgcctgctcttcgcttctcctgcaaacaccagacgtcgccctagcaaagtatttaggcttgtacccagcacggccactgcaggaccagcccagcatgggcatttcctgtgattcaaggttgccacatttctccaaagtgagggcccacagagggccctccaccggcagtccctgtgttacgagtgccttccctaaccagctgtgcagatacggctacgtcaccaactccaaggtgaagtttgtcatggtggtagattcctccaacacagcccttcgagacaacgaaattcgcagcgtaagtcagggagttagagggccacgcccgagtgggtgttttgtttttcctttttgactttgttttgaaatgctgagaaactaaaaatctggcagtggctgtgtgtatgtggcaaggtcatggtttgctgggtctttttcagatgttccggaagctacacaactcctacacagacgtgatgtgcaaccccttctacaacccgggggaccgcatccagtccaggtgggccctactttctgtgtcttgccaccttctttctgtaggacatgccttgccattttggttgccaaaatgcaaccatttggaaaataagggaggaaagatctttttaagctatgagcaccatccccctagggcagaggttttaaagccacaaagccccgtttctccacaccaactcttacacagatctccagcgcataaagtggatagagtgtgtgtggtgtggggagtagagcttgcccatttggcttcccaggtgtgcccagtgggtacctggggcacctgcaggactcagggccaagcacatgggcagtggctttcagggatcacacgtccttttgtagctacctgatcttttatgttgaatttggaacagtcaggaacctggtttgcaggtgtcttccgaatagtccacaaagtaaacagatttaacttttgaacatcatgagggaaatgtggggtccatgcccacattccagacttgctttcagtgagtccccagttccaagacataattccctgtggttggcagggaaaaggacgctgcaatgatccaaggcaggcccctccctccaccaggacactgtcttggggccatcctggtcccagatgggagcaggcaggcgaatgtccacagtcttgcttcctgggctgcacagggccatccttggcacacccccgctctgcctgcccatgttgctccctcctccaccccttcctggggccttgggaggctgcacagggaacttggaggcagcagatgggttctcagtgcccggtggggtgggactcctgtcctggcctctcagcggagttcacatttctggaccctggagaaggtcccgagcatcctgtggatggagccatgctgcccggcccgtctctgagcagaggggtggagggcctggctctcctctgagtgggtctgtttctcttagcagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacatatttgccttttcatcccatctagcaagcacagtgttaattttagaaattatagaagaaaaaatcagcaaggagtgtgggaaaactgcatgccccaggcctcccccgccccagggtgaattggaagccctggaatgggccgaggcacaccaggcagctgatctgggtgcctgtgggccacagacccactttacaagggttaaattttaacaagagccctatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgaaagccatgtcctgggctcccttgcagcccggggtgggcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtttaagccactgatttttgggttttctgttaggtgcagccagacccacctgtaagtactttttacatgagggcgttttcacaagccttgttaggcagcatccccattttaagcccaaggaaacagtgcctgatgaggcgctgttagtcgtggaatgctggagtcaggtgtgtgcacataagcagccttgggcttctgcggccgtgcatgcagccagggagcccgactggctgtgctttcagaggggacagtcgtcaaagtgcccagga

SEQ ID NO: 11506 - DNA, 542 bp, Homo sapiens
ctgactgagaccccagttccgcgctcgcccgtcccgctgctgaacgcacccctcggcgcacgaggtctcctccccgccagacccaccagaaacctaggtggtcccgggcactacctccgtcctccgtcctcagcaggttctgcccgttctcccgtccagcgctggttccccgcggacggcgccccggcctcctgccagtctccccggagccgagttaaaaacaaatcggatcctgtcacgcctctgcctgagacctctgcagtggcttctcgttgccttaggatgctgtctgaataacctgctctgggatcctttccccccataacccttggcactctccgctccaaccaaacaattctgcagctccctggacatgctctgccctctcacctgtgggcctttgcacgcggaacacctctccccagctcccatcctctttactggcccacatacatttcaactggaaagcattttctgaaggctaagactgagctgggtggctgcccacacgctcctgctgcacggagccttcatttcctagc

SEQ ID NO: 11507 - DNA, 9777 bp, Homo sapiens
attctgatgctcacagtaccacctcaagtgcctccccagctcaatctccttgttacagtaaccagtcagatgacggctcagatacagagatggcttctggttctaacagaacaccagttttttcctttttagatctcacttactggaaaaggtaaaagaaacaaagtatctctctaaccagcaaaccatcttaattatgggcagtatttttctacttccttagcaattaaatggcatttggcaaacagttggtaacacacgattgcagtggattaagcaggaattgagcagggaagtgggatttttgtatgttcttcctattaaaatttatttaaaataaaaatcacatcaaggtacctacattgcctattgctagataagtggagtagaaagacaatatgcagtggagagaatcagtaaaactaagagttggtccttcaaaaagacgtgaccaaaaatatactagagataaagtggatcaggaaaaggagataatacacataagcaattttaggaaagagaaaagagacttaggtatagataaagcagacatttaaaaaataataggatattatagacaacttgatgccaataaatttgaacatacaggtgaagcaggtacagtactagaaaaaagacatgttgctaaagctgtctcaagaaaaagtgaaaaacggagataatctcataataaattgattcaggccaggtgtgatggctcacacctgtaatcctagcattttgagaggccaaggtgaggggattgtttgagcctaggaggttaggtttgcagtaagctatttttgcaccattgcactccagcctggtgataaagcaagactctatttaaaaaaacaaacaaacaaacaaacaaaccacaataggcaagttgtactaaacatccaggaacagatgattggagcctatgcactggcttttccagactatggataaaatagggcataggccccaagcatttttaaggctgatataagtttgataccaaaacaaatatatcatcagccactagggttattctaggtatgtaagattggtttgaacatgagacgatcaactaatataatttaccacattgacagtttcttttttttttttttttttgagacggagttttgctcttgttgccaagctatagtgcaatggctcgatctctgctcactgcagcctctgcctcccgggttcagtgattctcctgccttagcctcccgagtagctgggattacaggtgcatggccaccacacctggctaaatttttgtatttttagtagaaaaggggtttcaccatgttggtcaggctggtctcgaactcctgaccttaggtgatccacctgcctcagcctcccaaagtgttgggattataggcgtgagccaccgtgcccagcccacattgatagtttctaaaggaaggtgttgtcttcttagtggtgcaaagaaggagtttgacaaatttgaacattcctttaaggtttaaaaaaaaaaaagttttagcaaaataggaatagaaggaaacttttttacttagacaacaggtatcttacaaaaaggacaaaagtacataatacataattgtgataaaatgaaagcattttctctatgatcaggaacaaatcaagagtgttgactatcaccatttctattcagcattatacagaaggttctaaccaatacaatattggtagtagtgtagtagtaaacactttagaacagtgcctagtgcatagtgtaagtactttaaagtactttaaaccactttgtttgcatttatttaatctttttttttttttttttgagacagagtttcactctgtagcccagactggagtgcagtggtgttatcttggctcactgcaatgtccgcctcctgggctcaggcaattctcccacctcagccgcccaaatagctgggtctacaggcacgcaccaccatgcctggctaatttttgtattttagtagagatggggtttcgccatattggccaggctggtcttgaacttctagcttcaagtgatctgcctgccttgacctcccaaagtgctgggattacaggtgtgagttactgcacctggccttatttagtctttatgacaattctgtgaagcattatgtgaaaacacaggtacaaagaggaagtactttgtttaaggttacatagtaagtagagcaggatttaaatctaggcagtttggcattagaatgatacattttatcatagtgttaggaaatataaaataatgtagtaaaatatcaaaagccctttggaggagttatgtaaaaatcatacaatattgtcgaataacatttatttatgtgtgtgtgtgtgtgtgtgtgtgtgtgtgtgtgtgtatgtatatatataaatatatgtctatgttgagagagagagactcactctgtcacttaggctggagtgcagtggtgtgatcttggctcactgcaacctccgcctcctgggttcaagcgattttcctgtctcagcctccggagtagctgggattacaggcatgcaccaccacaccctgctaatttttgtatttttagtagagattgggtttcaccatgctggccaggctgatagtgaactcctgacctcaggtgatctgctcgccttggcctcccaaagtgctgggattacaggcatgaaccactgcgcccggccgttgaataacatttaaagacacctaaataaattgagaggtatagcacattcatagatattattaaactgactgttagggagatgatcactttgtagattcagggtaattgcagtcaaaatcccaacatatttatggaactttacaagctaatttataatttatatagaaaagcaaagggcccaaaataggcatcttcagaagaaaaagaaagatgtggataaacttgccctaacagaaatcaagacatattatgaagccatggtaattaatgtgttttgggactaggaatagaaaaataaaccaatggaatagtatagagagcctggaaacaaggccacatatgtatatagcacttgttatgtgatacatgatgtgggggtgattggtgggcgaaaatggtctgttcaataagtgttgctaggatattaagaacaacatggttattcatgtggaaaaattgggcttgggttccctacctcacaccatagacaaacaccaattacagatgcattaaagtagaaaatagattatgacttttgagtgggaaaggatttttttatgacagagtacttaagcatttaaaaaaacctccaggtttaattacattataattatgaacttaaattcatcaaataataccataaagaaaatgaaatgatatccagcacatatatctgacaaaggattagtatctggaatatacagacaactcctacaatggaagaaaaagataaaccaacagaaaaatggacacacttagaaaggaatcatgaaataactcattaaatgataatgtgttcaaactttttgaaaatcaaggaaatacaaagtaaaatttcaatgagataccattttatactcattagattggtgaaaaaactaaaataaagtctattaccaaatgttggggagaaggtatggaatgatgagaacactgtcagttataggtgtaaatagttataaccatgtagataaatggccgtttttgagtaaagttgaagacgttcccattcctatatgccagcaatataaactagtaaaaacctttaagatgtgtccactgatttatacattaaaataagagtagataaataaaactgtgttatatattcacagggtagaatattatacatgttaaaatgaaataaagctctataacaatatgtatggatctcaacgttgactaaaacattgcagaatacattgtgattctgtgtgtgtgtgtgtgtgtgtgtgtgtgtgtgtgtgtaatggataactgtgcagtatgattagagatgccaacatacggtgaaaccatgaagtataaagaaaagggagtgataaacctaaaattaagtggggagaggatgagatgaggtaggatgggactgtggaggggcctgcagggggcttcataggaaatgatcttttttcccttagagtatgtggtctgtaggcattctcattgtgttgtcatttttgatgcctttgctaacacacacccttttttgtttttttttgagacagagttttgctctgtctcccaggctagagtgcagtggtgtgatttcggctcactgcaacctccacttcctgggttcaagtgattctactgcctcagtctcccaagtagctgggactacaggcacgtgccaccacgcctggctaatttttgcatttttagtagagatggggtttcgccatgttggccaggctgatctcgaactcctgacctcaagttatctgcccacctcagcctcccaaactgctgggattacaggtgtaagccaccacacccggcccacacatgtatttttatctactcagtatttaattaaaaattaccactcaagcacttaggagttgataaagaaaaaaaattaaatatatataaaaaattgctagctgcatcagcctgtttatggtggctgatttttttttcaagagttggtgattttggaggaaatagttaacaacatcaggggcagcctttgaaactgactgctgtctttcaaaatgccgtcttcctcaatatttgagaagattccagtgtggcctttaaggcaactgggtaattccccttctctagctaattggggttactctaggagccctttcacttggaatgtgcaagattgtagaagcacaactctttggttatattggactagttataatagtgagtagatttcttttgtattcctatttttcttccttattaatgtatcttgttctccattttttcttttagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactagaaaataaaaggagctgttttgtggctttgtttgacaggtcttcagtaagaataatgtttttggctttcacatatactcagtttaagtgcttagtattaataacaagccatgaagggaataaattcctcttcactgagacatagactttggaataaaagacattttaactgatgtgcacaattattaatctagtggataagatggatttaaaaggaagaacaaaatgttcccagtactttttactgtctgtggttttattactatctatgggcatagtgggaagcatcattgagactttagggaaactataaaagttggaagggtggtggcatcaggggttggatgctggttctcaagttcctagctctgccccttgttagtcatttgagttaaataattaatgggaatatctacttcacaggattatgaggaatcctaagaggtgtaatccatatcaaacttttagaaaccagttgttttattacctgggaaaggtaataaagggccagactttttatactactgttagtatttaaatttgggatagtctggatgccacctaatacagttactatgaaattaacaaggtaactaaggaagttgatagtaccagtattatctattgctatgtcctaaattaccatagatttagtggcttaaaacaaatgcgtctcagtttctgtctgagcatggtttagataggtcctttagaaagctcatggtctcatctgcattctcacctggtgatttgggaagaactcatttcagcctcactcggctggcagaattcagttcttgccactgcaggactgagtgtccagacctctcactggttgtcagctggaggcccccgcttagttccttgccagctgggtgctccctgcatggcctggctgctgactggaccactgacatgattactgtcactaccagcaagtgtcgagagccaagctgccagcaagaggggtcttttcaggtcctgcccatatccaaggggagaggctcatacgaaggattggataccaagaggtgcgggtggggctaatgggaaggcacctagagtttgtcacagctttttttttttttaactgaatctctttaaattggtcgtctcgccctacaatgcaaatgctttgtgtagcaagtaaaaagaaaaatggctctcacaatatgaaaaaccctggctgggcactgtggcttatataaacctgtaatcccagcactttgggaggcccaggcgggtggatcccttgaggtcaggagttcaagtccaaccaggccaacatggtgaaacaccgtctctactaaaaataaaaaaattagccaggcatggtggcatgcgcctgtggtcccagccactcgagagattgaggcaggagaattgcttgaacctgggaggtagaggttgcagtgagctgagttgggccactgcactccagtctgggtgacagagtaagactccacctccaaagaaaaaaaagaaaagacctactgttgggccagacacttttaaacattgtttaagtaaccctgcaaagtaaaaaaaaatctatttaccggtaagaggaggtgccaggaggtcatgtaacttgaatgaaagaatctgcttttcttatttgaaagcctttgttctctaaactgtctcctgtctgctgcagtaatgctgtcctaaccctcattggaaactattccctgggtctcttcttgcctcccttctttctgaaggctgaaatgaggggcaagtttaacttttgcagatacgttgatctttaacttaaatcaaattctgttttttaattttgataatgttcaaagtacctattatctgtctttttgtggagaaaactgctggaggtttagtgaaacgatatcttaaaacaattcatcaaggtggctgctctgcagtgaacaatagaaggtaccctgggagctcttctattcagcgtccctagaacagtttcctagtgccccagatttagcattgtagtggccaggcaatcatttttgtgtgatgttcagtgaactcggaagggaggagaaagccaaattagatcaaagatagataatttcacaggctcatgttctcaaagaaagggatctgcgggttctgtctaacaatttctcaagctgtggagtttggttactcattgtagtcatgagaatgctttaggtatcaaataccttacaccctggttagaaactgcttgttattgtatgttgactagggggtcttagacaaacttagttgcaagctttagcatgaaagaacttagtcattcagtttagagagagacaaaagatttttttgcgaaagcctgctctttatctgaaaggggaaaatgatttattctgttttacagcatttattctctaaacttctatggcttatattagcttaactgtgtctccaggtattggcttttttttttttttttttttcagacagagtcttgctcttgttacccaggctggagtgcaatggcgtgatctcggctcactgcaacctccgcctcctgggttcaagcgatcctcctgcctcagcctcccgagtagctgggattacaggcgcctgccaccacgcccag

SEQ ID NO: 11508 - DNA, 8672 bp, Homo sapiens
attctgatgctcacagtaccacctcaagtgcctccccagctcaatctccttgttacagtaaccagtcagatgacggctcagatacagagatggcttctggttctaacagaacaccagttttttcctttttagatctcacttactggaaaaggtaaaagaaacaaagtatctctctaaccagcaaaccatcttaattatgggcagtatttttctacttccttagcaattaaatggcatttggcaaacagttggtaacacacgattgcagtggattaagcaggaattgagcagggaagtgggatttttgtatgttcttcctattaaaatttatttaaaataaaaatcacatcaaggtacctacattgcctattgctagataagtggagtagaaagacaatatgcagtggagagaatcagtaaaactaagagttggtccttcaaaaagacgtgaccaaaaatatactagagataaagtggatcaggaaaaggagataatacacataagcaattttaggaaagagaaaagagacttaggtatagataaagcagacatttaaaaaataataggatattatagacaacttgatgccaataaatttgaacatacaggtgaagcaggtacagtactagaaaaaagacatgttgctaaagctgtctcaagaaaaagtgaaaaacggagataatctcataataaattgattcaggccaggtgtgatggctcacacctgtaatcctagcattttgagaggccaaggtgaggggattgtttgagcctaggaggttaggtttgcagtaagctatttttgcaccattgcactccagcctggtgataaagcaagactctatttaaaaaaacaaacaaacaaacaaacaaaccacaataggcaagttgtactaaacatccaggaacagatgattggagcctatgcactggcttttccagactatggataaaatagggcataggccccaagcatttttaaggctgatataagtttgataccaaaacaaatatatcatcagccactagggttattctaggtatgtaagattggtttgaacatgagacgatcaactaatataatttaccacattgacagtttcttttttttttttttttttgagacggagttttgctcttgttgccaagctatagtgcaatggctcgatctctgctcactgcagcctctgcctcccgggttcagtgattctcctgccttagcctcccgagtagctgggattacaggtgcatggccaccacacctggctaaatttttgtatttttagtagaaaaggggtttcaccatgttggtcaggctggtctcgaactcctgaccttaggtgatccacctgcctcagcctcccaaagtgttgggattataggcgtgagccaccgtgcccagcccacattgatagtttctaaaggaaggtgttgtcttcttagtggtgcaaagaaggagtttgacaaatttgaacattcctttaaggtttaaaaaaaaaaaagttttagcaaaataggaatagaaggaaacttttttacttagacaacaggtatcttacaaaaaggacaaaagtacataatacataattgtgataaaatgaaagcattttctctatgatcaggaacaaatcaagagtgttgactatcaccatttctattcagcattatacagaaggttctaaccaatacaatattggtagtagtgtagtagtaaacactttagaaaagtgcctagtgcatagtgtaagtactttaaagtactttaaaccactttgtttgcatttatttaatctttttttttttttttttgagacagagtttcactctgtagcccagactggagtgcagtggtgttatcttggctcactgcaatgtccgcctcctgggctcaggcaattctcccacctcagccgcccaaatagctgggtctacaggcacgcaccaccatgcctggctaatttttgtatttagttagagatggggtttcgccatattggccaggctggtcttgaacttctagcttcaagtgatctgcctgccttgacctcccaaagtgctgggattacaggtgtgagttactgcacctggccttatttagtctttatgacaattctgtgaagcattatgtgaaaacacaggtacaaagaggaagtactttgtttaaggttacatagtaagtagagcaggatttaaatctaggcagtttggcattagaatgatacattttatcatagtgttaggaaatataaaataatgtagtaaaatatcaaaagccctttggaggagttatgtaaaaatcatacaatattgtcgaataacatttatttatgtgtgtgtgtgtgtgtgtgtgtgtgtgtgtgtgtgtatgtatatatataaatatatgtctatgttgagagagagagactcactctgtcacttaggctggagtgcagtggtgtgatcttggctcactgcaacctccgcctcctgggttcaagcgattttcctgtctcagcctccggagtagctgggattacaggcatgcaccaccacaccctgctaatttttgtatttttagtagagattgggtttcaccatgctggccaggctgatagtgaactcctgacctcaggtgatctgctcgccttggcctcccaaagtgctgggattacaggcatgaaccactgcgcccggccgttgaataacatttaaagacacctaaataaattgagaggtatagcacattcatagatattattaaactgactgttagggagatgatcactttgtagattcagggtaattgcagtcaaaatcccaacatatttatggaactttacaagctaatttataatttatatagaaaagcaaagggcccaaaataggcatcttcagaagaaaaagaaagatgtggataaacttgccctaacagaaatcaagacatattatgaagccatggtaattaatgtgttttgggactaggaatagaaaaataaaccaatggaatagtatagagagcctggaaacaaggccacatatgtatatagcacttgttatgtgatacatgatgtgggggtgattggtgggcgaaaatggtctgttcaataagtgttgctaggatattaagaacaacatggttattcatgtggaaaaattgggcttgggttccctacctcacaccatagacaaacaccaattacagatgcattaaagtagaaaatagattatgacttttgagtgggaaaggatttttttatgacagagtacttaagcatttaaaaaaacctccaggtttaattacattataattatgaacttaaattcatcaaataataccataaagaaaatgaaatgatatccagcacatatatctgacaaaggattagtatctggaatatacagacaactcctacaatggaagaaaaagataaaccaacagaaaaatggacacacttagaaaggaatcatgaaataactcattaaatgataatgtgttcaaactttttgaaaatcaaggaaatacaaagtaaaatttcaatgagataccattttatactcattagattggtgaaaaaactaaaataaagtctattaccaaatgttggggagaaggtatggaatgatgagaacactgtcagttataggtgtaaatagttataaccatgtagataaatggccgtttttgagtaaagttgaagacgttcccattcctatatgccagcaatataaactagtaaaaacctttaagatgtgtccactgatttatacattaaaataagagtagataaataaaactgtgttatatattcacagggtagaatattatacatgttaaaatgaaataaagctctataacaatatgtatggatctcaacgttgactaaaacattgcagaatacattgtgattctgtgtgtgtgtgtgtgtgtgtgtgtgtgtgtgtgtgtgtaatggataactgtgcagtatgattagagatgccaacatacggtgaaaccatgaagtataaagaaaagggagtgataaacctaaaattaagtggggagaggatgagatgaggtaggatgggactgtggaggggcctgcagggggcttcataggaaatgatcttttttcccttagagtatgtggtctgtaggcattctcattgtgttgtcatttttgatgcctttgctaacacacacccttttttgtttttttttgagacagagttttgctctgtctcccaggctagagtgcagtggtgtgatttcggctcactgcaacctccacttcctgggttcaagtgattctactgcctcagtctcccaagtagctgggactacaggcacgtgccaccacgcctggctaatttttgcatttttagtagagatggggtttcgccatgttggccaggctgatctcgaactcctgacctcaagttatctgcccacctcagcctcccaaactgctgggattacaggtgtaagccaccacacccggcccacacatgtatttttatctactcagtatttaattaaaaattaccactcaagcacttaggagttgataaagaaaaaaaattaaatatatataaaaaattgctagctgcatcagcctgtttatggtggctgatttttttttcaagagttggtgattttggaggaaatagttaacaacatcaggggcagcctttgaaactgactgctgtctttcaaaatgccgtcttcctcaatatttgagaagattccagtgtggcctttaaggcaactgggtaattccccttctctagctaattggggttactctaggagccctttcacttggaatgtgcaagattgtagaagcacaactctttggttatattggactagttataatagtgagtagatttcttttgtattcctatttttcttccttattaatgtatcttgttctccattttttcttttagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactagaaaataaaaggagctgttttgtggctttgtttgacaggtcttcagtaagaataatgtttttggctttcacatatactcagtttaagtgcttagtattaataacaagccatgaagggaataaattcctcttcactgagacatagactttggaataaaagacattttaactgatgtgcacaattattaatctagtggataagatggatttaaaaggaagaacaaaatgttcccagtactttttactgtctgtggttttattactatctatgggcatagtgggaagcatcattgagactttagggaaactataaaagttggaagggtggtggcatcaggggttggatgctggttctcaagttcctagctctgccccttgttagtcatttgagttaaataattaatgggaatatctacttcacaggattatgaggaatcctaagaggtgtaatccatatcaaacttttagaaaccagttgttttattacctgggaaaggtaataaagggccagactttttatactactgttagtatttaaatttgggatagtctggatgccacctaatacagttactatgaaattaacaaggtaactaaggaagttgatagtaccagtattatctattgctatgtcctaaattaccatagatttagtggcttaaaacaaatgcgtctcagtttctgtctgagcatggtttagataggtcctttagaaagctcatggtctcatctgcattctcacctggtgatttgggaagaactcatttcagcctcactcggctggcagaattcagttcttgccactgcaggactgagtgtccagacctctcactggttgtcagctggaggcccccgcttagttccttgccagctgggtgctccctgcatggcctggctgctgactggaccactgacatgattactgtcactaccagcaagtgtcgagagccaagctgccagcaagaggggtcttttcaggtcctgcccatatccaaggggagaggctcatacgaaggattggataccaagaggtgcgggtggggctaatgggaaggcacctagagtttgtcacagctttttttttttttaactgaatctctttaaattggtcgtctcgccctacaatgcaaatgctttgtgtagcaagtaaaaagaaaaatggctctcacaatatgaaaaaccctggctgggcactgtggcttatataaacctgtaatcccagcactttgggaggcccaggcgggtggatcccttgaggtcaggagttcaagtccaaccaggccaacatggtgaaacaccgtctctactaaaaataaaaaaattagccaggcatggtggcatgcgcctgtggtcccagccactcgagagattgaggcaggagaattgcttgaacctgggaggtagaggttgcagtgagctgagttgggccactgcactccagtctgggtgacagagtaagactccacctccaaagaaaaaa

SEQ ID NO: 11509 - DNA, 8670 bp, Homo sapiens
attctgatgctcacagtaccacctcaagtgcctccccagctcaatctccttgttacagtaaccagtcagatgacggctcagatacagagatggcttctggttctaacagaacaccagttttttcctttttagatctcacttactggaaaaggtaaaagaaacaaagtatctctctaaccagcaaaccatcttaattatgggcagtatttttctacttccttagcaattaaatggcatttggcaaacagttggtaacacacgattgcagtggattaagcaggaattgagcagggaagtgggatttttgtatgttcttcctattaaaatttatttaaaataaaaatcacatcaaggtacctacattgcctattgctagataagtggagtagaaagacaatatgcagtggagagaatcagtaaaactaagagttggtccttcaaaaagacgtgaccaaaaatatactagagataaagtggatcaggaaaaggagataatacacataagcaattttaggaaagagaaaagagacttaggtatagataaagcagacatttaaaaaataataggatattatagacaacttgatgccaataaatttgaacatacaggtgaagcaggtacagtactagaaaaaagacatgttgctaaagctgtctcaagaaaaagtgaaaaacggagataatctcataataaattgattcaggccaggtgtgatggctcacacctgtaatcctagcattttgagaggccaaggtgaggggattgtttgagcctaggaggttaggtttgcagtaagctatttttgcaccattgcactccagcctggtgataaagcaagactctatttaaaaaaacaaacaaacaaacaaacaaaccacaataggcaagttgtactaaacatccaggaacagatgattggagcctatgcactggcttttccagactatggataaaatagggcataggccccaagcatttttaaggctgatataagtttgataccaaaacaaatatatcatcagccactagggttattctaggtatgtaagattggtttgaacatgagacgatcaactaatataatttaccacattgacagtttcttttttttttttttttttgagacggagttttgctcttgttgccaagctatagtgcaatggctcgatctctgctcactgcagcctctgcctcccgggttcagtgattctcctgccttagcctcccgagtagctgggattacaggtgcatggccaccacacctggctaaatttttgtatttttagtagaaaaggggtttcaccatgttggtcaggctggtctcgaactcctgaccttaggtgatccacctgcctcagcctcccaaagtgttgggattataggcgtgagccaccgtgcccagcccacattgatagtttctaaaggaaggtgttgtcttcttagtggtgcaaagaaggagtttgacaaatttgaacattcctttaaggtttaaaaaaaaaaaagttttagcaaaataggaatagaaggaaacttttttacttagacaacaggtatcttacaaaaaggacaaaagtacataatacataattgtgataaaatgaaagcattttctctatgatcaggaacaaatcaagagtgttgactatcaccatttctattcagcattatacagaaggttctaaccaatacaatattggtagtagtgtagtagtaaacactttagaacagtgcctagtgcatagtgtaagtactttaaagtactttaaaccactttgtttgcatttatttaatctttttttttttttttttgagacagagtttcactctgtagcccagactggagtgcaggggtgttatcttggctcactgcaatgtccgcctcctgggctcaggcaattctcccacctcagccgcccaaatagctgggtctacaggcacgcaccaccatgcctggctaatttttgtattttagtagagatggggtttcgccatattggccaggctggtcttgaacttctagcttcaagtgatctgcctgccttgacctcccaaagtgctgggattacaggtgtgagttactgcacctggccttatttagtctttatgacaattctgtgaagcattatgtgaaaacacaggtacaaagaggaagtactttgtttaaggttacatagtaagtagagcaggatttaaatctaggcagtttggcattagaatgatacattttatcatagtgttaggaaatataaaataatgtagtaaaatatcaaaagccctttggaggagttatgtaaaaatcatacaatattgtcgaataacatttatttatgtgtgtgtgtgtgtgtgtgtgtgtgtgtgtgtgtgtatgtatatatataaatatatgtctatgttgagagagagagactcactctgtcacttaggctggagtgcagtggtgtgatcttggctcactgcaacctccgcctcctgggttcaagcgattttcctgtctcagcctccggagtagctgggattacaggcatgcaccaccacaccctgctaatttttgtatttttagtagagattgggtttcaccatgctggccaggctgatagtgaactcctgacctcaggtgatctgctcgccttggcctcccaaagtgctgggattacaggcatgaaccactgcgcccggccgttgaataacatttaaagacacctaaataaattgagaggtatagcacattcatagatattattaaactgactgttagggagatgatcactttgtagattcagggtaattgcagtcaaaatcccaacatatttatggaactttacaagctaatttataatttatatagaaaagcaaagggcccaaaataggcatcttcagaagaaaaagaaagatgtggataaacttgccctaacagaaatcaagacatattatgaagccatggtaattaatgtgttttgggactaggaatagaaaaataaaccaatggaatagtatagagagcctggaaacaaggccacatatgtatatagcacttgttatgtgatacatgatgtgggggtgattggtgggcgaaaatggtctgttcaataagtgttgctaggatattaagaacaacatggttattcatgtggaaaaattgggcttgggttccctacctcacaccatagacaaacaccaattacagatgcattaaagtagaaaatagattatgacttttgagtgggaaaggatttttttatgacagagtacttaagcatttaaaaaaacctccaggtttaattacattataattatgaacttaaattcatcaaataataccataaagaaaatccaatgatacccagcccatatatctcacaaagcattagtatctgcaacacacagccaactcctccaatggaagaaaaagataacccccagcaaaaatggccacacttagaaaggaatcatgaaataactcattaaatgataatgtgttcaaactttttgaaaatcaaggaaatacaaagtaaaatttcaatgagataccattttatactcattagattggtgaaaaaactaaaataaagtctattaccaaatgttggggagaaggtatggaatgatgagaacactgtcagttataggtgtaaatagttataaccatgtagataaatggccgtttttgagtaaagttgaagacgttcccattcctatatgccagcaatataaactagtaaaaacctttaagatgtgtccactgatttatacattaaaataagagtagataaataaaactgtgttatatattcacagggtagaatattatacatgttaaaatgaaataaagctctataacaatatgtatggatctcaacgttgactaaaacattgcagaatacattgtgattctgtgtgtgtgtgtgtgtgtgtgtgtgtgtgtgtgtgtaatggataactgtgcagtatgattagagatgccaacatacggtgaaaccatgaagtataaagaaaagggagtgataaacctaaaattaagtggggagaggatgagatgaggtaggatgggactgtggaggggcctgcagggggcttcataggaaatgatcttttttcccttagagtatgtggtctgtaggcattctcattgtgttgtcatttttgatgcctttgctaacacacacccttttttgtttttttttgagacagagttttgctctgtctcccaggctagagtgcagtggtgtgatttcggctcactgcaacctccacttcctgggttcaagtgattctactgcctcagtctcccaagtagctgggactacaggcacgtgccaccacgcctggctaatttttgcatttttagtagagatggggtttcgccatgttggccaggctgatctcgaactcctgacctcaagttatctgcccacctcagcctcccaaactgctgggattacaggtgtaagccaccacacccggcccacacatgtatttttatctactcagtatttaattaaaaattaccactcaagcacttaggagttgataaagaaaaaaaattaaatatatataaaaaattgctagctgcatcagcctgtttatggtggctgatttttttttcaagagttggtgattttggaggaaatagttaacaacatcaggggcagcctttgaaactgactgctgtctttcaaaatgccgtcttcctcaatatttgagaagattccagtgtggcctttaaggcaactgggtaattccccttctctagctaattggggttactctaggagccctttcacttggaatgtgcaagattgtagaagcacaactctttggttatattggactagttataatagtgagtagatttcttttgtattcctatttttcttccttattaatgtatcttgttctccattttttcttttagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatatctgaattttgaaaaaccacaaagctacaaactgaccctcttttttttttgagacggagtaatgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtcttttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactagaaaataaaaggagctgttttgtggctttgtttgacaggtcttcagtaagaataatgtttttggctttcacatatactcagtttaagtgcttagtattaataacaagccatgaagggaataaattcctcttcactgagacatagactttggaataaaagacattttaactgatgtgcacaattattaatctagtggataagatggatttaaaaggaagaacaaaatgttcccagtactttttactgtctgtggttttattactatctatgggcatagtgggaagcatcattgagactttagggaaactataaaagttggaagggtggtggcatcaggggttggatgctggttctcaagttcctagctctgccccttgttagtcatttgagttaaataattaatgggaatatctacttcacaggattatgaggaatcctaagaggtgtaatccatatcaaacttttagaaaccagttgttttattacctgggaaaggtaataaagggccagactttttatactactgttagtatttaaatttgggatagtctggatgccacctaatacagttactatgaaattaacaaggtaactaaggaagttgatagtaccagtattatctattgctatgtcctaaattaccatagatttagtggcttaaaacaaatgcgtctcagtttctgtctgagcatggtttagataggtcctttagaaagctcatggtctcatctgcattctcacctggtgatttgggaagaactcatttcagcctcactcggctggcagaattcagttcttgccactgcaggactgagtgtccagacctctcactggttgtcagctggaggcccccgcttagttccttgccagctgggtgctccctgcatggcctggctgctgactggaccactgacatgattactgtcactaccagcaagtgtcgagagccaagctgccagcaagaggggtcttttcaggtcctgcccatatccaaggggagaggctcatacgaaggattggataccaagaggtgcgggtggggctaatgggaaggcacctagagtttgtcacagctttttttttttttaactgaatctctttaaattggtcgtctcgccctacaatgcaaatgctttgtgtagcaagtaaaaagaaaaatggctctcacaatatgaaaaaccctggctgggcactgtggcttatataaacctgtaatcccagcactttgggaggcccaggcgggtggatcccttgaggtcaggagttcaagtccaaccaggccaacatggtgaaacaccgtctctactaaaaataaaaaaattagccaggcatggtggcatgcgcctgtggtcccagccactcgagagattgaggcaggagaattgcttgaacctgggaggtagaggttgcagtgagctgagttgggccactgcactccagtctgggtgacagagtaagactccacctccaaagaaaaaa

SEQ ID NO: 11510 - DNA, 110 bp, Homo sapiens
attacaggcatgtgccaccatgcctggctaatttttgtattttttggtagagacagggtttcgccatgtttgccaggctggtctcgaactcctgacctcaagtgatctgc

SEQ ID NO: 11511 - DNA, 160 bp, Homo sapiens
ttttttttttttttcagacagagtcttgctcttgttacccaggctggagtgcaatggcgtgatctcggctcactgcaacctccgcctcctgggttcaagcgatcctcctgcctcagcctcccgagtagctgggattacaggcgcctgccaccacgcccag

SEQ ID NO: 11512 - DNA, 160 bp, Homo sapiens; identical to SEQ ID NO: 11511

SEQ ID NO: 11513 - DNA, 2053 bp, Homo sapiens
ttttgaagcccttgaaatgaagtttagggaccactgatctagaattctctttatgctcctccactacccattaaccccactctatagtctgccttttcgctttcttctctcctcccttctaaacacttcgtagaacactatgttttctgttcatgattgaccttcaaattgccaaatcctttggccttataaaccgtatgtacttaaccaacactctgttgttaacaaatccttcaaaactgttttcttttgcttccgctctgtttttcctgtcatccacttatcacttttcttcatatgttttctttcttttgttcccagttgttattatgtggggttctggttctattttatgttctcactgtatattcagaatcagatttttagctaccatgtaccatcttaataatacctagcatttatttactctttcctaattgttatttcagtgcttcagtatttcagtattcatttaattcattcagtattcatttaaatctcaaaacaactcagtgaggttgatacaggtataattggtgtcttttttttcttttttctgacactggcatatcgaggcccaaaggttaagtaatctatgcaactaggaggcagtagaactgggatttaaacttagactgcctgtagaggccatgttcttaaccactactagatttttggcgtccagatgtcccttgtatttctaacttccgtttagtttttctacctcccattcaatacatccattcagttaatctcaagtgcctgcctctttcccttgacaaaacacacttgctcattctttattccttgccacattaaagttaacactatcctccccatcgctagtactatagaggtcattgaaccttccccctgcgtatggcctgtgagttttattgattccagcatgattatttggtgatatttgagtgcgattttgtgctagatcctgggtgtataatgatgtatgagacacagactttgtcctcagggagcttatactctagaaataatttttttttttttcaagagagcgtcctactctgttgccgaggctggagtgcagtggtgccaacatggcttactgtagcctcaggctcccgagctcaactgatcctcctgctgcagcctcccgagtaggtgggactacagacatggactatcacaccaagctgtttttatttttagttcaggtgggttctcagtttgttgcccaggctggtcttgaactcctgggctcaaatgattctcccacctcatcctcccaaagtccaagtattgggattacaggcatgagccatcatgcctggccaataaaatgttacaacaaattagcagaatgctgagagaataaatggtgataggaaacctgtatatgtaatggagtttcagataatacctaatatttattgagcactttctttttttttttttagagacagttttcactctgtcactcaggctggagtacagtggtgctatctcaactcactgcaacctccacttcctgggttcaggcagttctcatgcctcagtcttctgagtagctggaattacaagcacccaccaacacgcccagctaatttttgtattttttgtagagatggagtttcaccatgttggccaggctggtcttgaactcctgacctcaagtaatccgcctgccttggcctcccaaagtgctaggattacaggcatgagccactgcgcctgacctattgaacactttctatatggttgacattatttttggttcttcagtacatttaattctcataaagttcctaaatgtatacttctagatctgaagtatcgggaatacctaattgtacaaagaacatgccagttggaagctacagcatttagcagaagttctaaagtaggaaagagcttcatttaaactgtgaactggccaggtgtggtgtctcacgcttgtaatcccagcactttgggaggttgaaatgggaggatcacttgagcccaggagttggagaccagcctgggcaacagtgagaccctgtatctaaaaaagaaaaaaaaaaaaaaagaaaat

SEQ ID NO: 11514 - DNA, 2052 bp, Homo sapiens
ttttgaagcccttgaaatgaagtttagggaccactgatctagaattctctttatgctcctccactacccattaaccccactctgtagtctgccttttcgctttcttctctcctcccttctaaacacttcgtagaacactatgttttctgttcatgattgaccttcaaattgccaaatcctttggccttataaaccgtatgtacttaaccaacactctgttgttaacaaatccttcaaaactgttttcttttgcttccgctctgtttttcctgtcatccacttatcacttttcttcatatgttttctttcttttgttcccagttgttattatgtggggttctggttctattttatgttctcactgtatattcagaatcagatttttagctaccatgtaccatcttaataatacctagcatttatttactctttcctaattgttatttcagtgcttcagtatttcagtattcatttaattcattcagtattcatttaattctcaaaacaactcagtgaggttgatacaggtataattggtgtcttttttttattttttctgacactggcatatcgaggcccaaaggttaagtaatctatgcaactaggaggcagtagaactgggatttaaacttagactgcctgtagaggccatgttcttaaccactactagatttttggcgtccagatgtcccttgtatttctaacttccgtttagtttttctacctcaaattcaatacatccattcagttaatctcaagtgcctgcctctttcccttgacaaaacacacttgctcattctttattccttgccacattaaagttaacactatcctccccatcgctagtactatagaggtcattgaaccttccccctgcgtatggcctgtgagttttattgattccagcatgattatttggtgatatttgagtgcgattttgtgctagatcctgggtgtataatgatgtatgagacacagactttgtcctcagggagcttatactctagaaataatttttttttttttcaagagagcgtcctactctgttgccgaggctggagtgcagtggtgccaacatggcttactgtagcctcaggctcccgagctcaactgatcctcctgctgcagcctcccgagtaggtgggactacagacatggactatcacaccaagctgtttttatttttagttcaggtgggttctcagtttgttgcccaggctggtcttgaactcctgggctcaaatgattctcccacctcatcctcccaaagtccaagtattgggattacaggcatgagccatcatgcctggccaataaaatgttacaacaaattagcagaatgctgagagaataaatggtgataggaaacctgtatatgtaatggagtttcagataatacctaatatttattgagcactttctttttttttttttagagacagttttcgctctgtcactcaggctggagtacagtggtgctatctcaactcactgcaacctccacttcctgggttcaggcagttctcatgcctcagtcttctgagtagctggaattacaagcacccaccaacacgcccagctaatttttgtattttttgtagagatggagtttcaccatgttggccaggctggtcttgaactcctgacctcaagtaatccgcctgccttggcctcccaaagtgctaggattacaggcatgagccactgcgcctgacctattgaacactttctatatggttgacattatttttggttcttcagtacatttaattctcataaagttcctaaatgtatacttctagatctgaagtatcgggaatacctaattgtacaaagaacatgccagttggaagctacagcatttagcagaagttctaaagtaggaaagagcttcatttaaactgtgaactggccaggtgtggtgtctcacgcttgtaatcccagcgctttgggaggttgaaatgggaggatcacttgagcccaggagttggagaccagcctgggcaacagtgagaccctgtatctaaaaaagaaaaaaaaaaaaaagaaaat

SEQ ID NO: 11515 - DNA, 266 bp, Homo sapiens
ctgtcgcccaggctggagtgcagtggcaccatcttggctcactgcaagctctgcctcccaggttcacgccattctcctgcctcagcctccccagtagctgggactacaggtgcctgccaccacgcccagctaatttttttgtatttttagtagaaatggggtttcaccgtgttagccaggatggtcttgatctcctgacctcgtgatctgcacaccttggcctcccaaagtgctgggattacaggcgtgaaccaccgcgcccggcc

SEQ ID NO: 11516 - DNA, 191 bp, Homo sapiens
agcaccatggccctcatcttcgcattttacgctttttttgcaagtttatcaacaagctcaattaaaccaccaactgttttctgaaactggccagttttgtccgcaaagttcttgcactcttctttgagctctgtggtctgctgggtaacctctgagtccaacacccacagcttgttcaactcatcaaagtg

SEQ ID NO: 11517 - DNA, 191 bp, Homo sapiens; identical to SEQ ID NO: 11516

SEQ ID NO: 11518 - DNA, 155 bp, Homo sapiens
cctcccaggttcacggcattctcctgcctcagcctccccagtagctgggactacaggtgcctgccaccacgcccagctaatttttttgtatttttagtagaaatggggtttcaccgtgttagccaggatggtcttgatctcctgacctcgtgatc

SEQ ID NO: 11519 - DNA, 766 bp, Homo sapiens
cagaagtattaacttgttcaaatcgtacaaccaaggctcaagtccatgattgcccaactccaaagcccatgttctttctaccttattatgttggcattgttttcaatgtcagtttggacccatataaaaacgcccagctgtaccctatgaggaggatataaaaatgtgagatggtagttgacactcggaggacattcatatctccaaacccaaccttatgaagttggccacagcaagcatgttggaaactagaaccaggggtttcatatcaagccatttgcttaggtctgtatctcaaaagctttaaatacaactttttttggtgccctcttgataaggagtcttatactgagctcttcttctcttttatagctggtccatcagaaagattaaattaaacgtttggccacatggacagttaatccttagatcacccagttggatggttcattcctgctatgtttggtttgattttttatttttggaaaacaaatagtgagtcagtctgctttccctccctttctctgcctcaccactccttctggattctcttagatgctctggtcatactaggtaaacagtatttttcttaaaattttccttgagccatgacagaatcatgagagagctcccctggctctgatacttaatgcccccctctaaaaagaaaggtctatttgaggctattcacttttgtcatcttgaaagagtctctgagtcttacctagcaggaatattttgtttcttttcctaaaaaaaaaaaaaa

SEQ ID NO: 11520 - DNA, 6114 bp, Homo sapiens
ccacatcttatctaaatacataatacagaagcctgtgtgacttgggcaatgtggccaggagggcacagagactaacacatccacctcggcaaaaggacataaaatatgtcttatggtcagaaaaatcaacattttgtgtatttacttagtttatgagaagtactgaaaatgctattataagctgaatttgtgatttccttttgaaattctgagttatccttatttttcccattttgtttttgcaccaaggagactgtagtcaaataaaacagaactacacgcactcgtcggggcagccgtactgcagaagcacgttgatgcactcctggctggaggcctgccgggcgtaggtcagcgctgtgttcccgtgggcatctcgggccatgacgtccaccccgtaccagatcaggagctgcgccaggaccacattccccttgcggcaggccagatggagcgccgtgcagccgtctccctccccacaggtctcgttcacctcctcacgggagccatgtgccagcagcaggatggctgtctgcaggtcctcatcagcggtggcccgcagcagctgctggcccagggacagatcagtgcagggtagtggggccagaaagagcttctcctcatatttggaaaggatccaccgttccttttcttccctcgtggacttttctgagggttttgtctgtccctggctgctcccttcccagatgctgttggctaggtcattgccaatagatgacataaccttcctgagctcaactggccagtcatccagctccagagatcgcacacgggaaaggcgggtgccaagactgcggtggatacctgagcattcaatacacatgaggactcccaagttcaaactggcccacttaggattctgggtctcacagtccacacagtgggcgttcccacgcatgttttggatcgactgcagggccatggcctcgctctggctggtcagctgggacttgcttttactgctctcgcatgactgcaggctggccaggatctggctctggatggcttggacccaggcatcccgctcctcatatgtcgtggcttcaaagtgccacgtttggccagtggcagacacaatcataaagttgttggtgcttttcttctttaggtgtttctttttattggcatgaggagaggggggcgggttgagcttggggccggtggtgctggagatactggggctgaagcatatggagtcacccagcccggtgtccatgtccttggataggtcattgcttttagagctggagatgggtgcgcaggccgatgtggctagggatggccactttcctgggactttgatggtagatgtctgaaggtcaatctcttttttatgaatattcttcatataatcacctaagcttgaataataggtgagcacgccattggaacacagggtgacgtatttctttttccatgtcttcagccatttcccacttcgctttaagagcatgccctgtttaatggggatggctctgccgctcccgatggtgtcagcatgattctccggggctttcctctctttgtctgggtcactccctttctcagatgtaaacaggttggaccagcgcatggaccgcttgcaaacgggggtgggtgtgttggcagtgggaggaacactgaactgagggtcctcctggctggtgctgggagtcgatggaatggaggaggaatagttatttaaactcccacctccatttctgttcttcgtaatgtgcacggtggaaacctgtgtggaacagaaggaggaatggcttcaaaaattgggtagtggcttgcagggtcctatagacagctcacaattaccttttaaaaagatacattttctgggccaggcatggtggctcacacctgtaatcacagcactttgggaggccaacgtgggtggatcacgaggtcaggagttcaagaccatcctggccaacatggtgaaaccctgtctttacaaaaaaaaaaaaagaaaaaaaaattagctgggcatggtggcacatgcctgtaattccagttactcaagaggctgaggcaggagaattgcttgaacagggacctgggaggcagagcctgcagtgagccaagatcgcgcgattgcactccagcctgggctacagaaagagagtccataaaaaaaaaaaaaaaaaaaaaaaaagatacattttctgttgtttggatagaatatttactcatactagctcactaactaaacagagctgcagatcagttcttactccagcacattctttttacaacacttaagatgactaaatgcaacatgaaatggggaagatttaaaaaaagatggctttgacttcagcatgaaacagatacaagtgtacgatgaaaatacaacctcaataaaagtgccacttaccgcaaatgagtgtaactgttcatcaggtatgctcaaagatctatctgcatctctataaaataagaaagcgcgttacttcaaaaactgttaatatcttagtataatatttgtttagtaaaatactgcctcctgtgtgctttggtgtttaccaaagcagtttttacgaattcttctcctggatcctgacttgcagagggtttcctgacttcttctttctcagcacatcatggcctgtaccgtgaagtcttttatatgataaccagtcagaaatgcccgtgagtattgactctccctaacaggccatggcaataaaccaaacatattttcactcttctaaccacacattgaaacacaagaatgttctacaaagcagtagtagtaaactttaataaatgtaaatgtgattcagatttcctagcttcctttctctttagttctctgtagtatactctcatgatgtatttatgtactttctgttgtttgaatgacaaactcatctgcctttttaagacgccagtctttgatgaactttaaactttgtaaaactaatgcattgtgcctgtgtataaaccagtggttctccaaatgtgctgtgtggacctctcgggatcccgaagaccccttccagaaggcctaagaggtcataactgttcttttttttttttttttttgagaccaagttttactcttgttgcccaggctggagtgcaatggtgtgatctcggctcatggcaaccttcgcctcccaggttcaagtgattctcctaccccagcctcccaagtagcagggattacaggcacctgccaccactcctggctaagttttgtatttttagtagagatgtggtttcaccatgttggccaggctggtcttgaactcctaacctcaggtgatccgcttgcctcggcctcccaaagtgctgggattacaggcctgagccactgtgcctggccaacactgttctgaatcatactaattaaacctgagaaagctgatgaaaaattttaaaaatttgtgaaagtaatacaaagccattgcctgctctttcgttgacacttgccatgattatataaaagcaaaagtgggtacaatggctggtttctcagcataaatcaaggcagtggtaccaattacattagtagtcattctattcttcactgtcccctacaggtaaaaaacatagcctgaatttcttaagaatgtctttgatgaagcagtaaaaattaatgttgttaaatcttgacatgtctctaatattctgaataagtggaaagttaaccagaagcgcttttttttttgtttttaaagaatccgtgatttaactatgaactgaaaaatcacttttttcacagaacatcatttttatttaaaagtacaactgggccagcgcagtggctcacgcctgtaaaatcccagcactttgagagaccaaagcaggcagatggcttgagctccttcaggagttcgagaccagcctaggcaacataacgaaaccctgtcactgtcaaacatataagaaaattagcctggcgtggtgccacacatctgtggtgccagctacaaaggagcctgaggtgagaggattgcttgagctgagatcatgccaatgcactccagccaagtgacagagtgaaactcggtctaaaaaaccagttcaactatcattctcaaaaataaatgaagtgagaggttgtcacttcaagggaaatacgtatttgttcccaatgataaaatttaagctttcctgtggactttgaaaaacttgttccttctactgtaggcttggcagctattcaatacttaaaggcgtgttaaagtaagattggtggttaaactaaaagtgatttttgacacaataaaacataaaccgatatattccaagtaactaatgcatgatattataaatgcaagtatggagcaaaagatccatttactgtggaagaaagatcaatgagtactgatggaataaatttattaatatgtaaaatgccaccgtaactaatttaagaaaccaccacttgtgaagttttgatttagtgttaacaaatacccacaactgtctgaaaagtttaaaaatacaccttctaccaactacatatttgcatgaggttcggtcatcttattgcttctttttttctttttttgagacagagtctctctctgtcacccaggctggggtgcaatggcgagatctcggctcactgcaacctccacctcccaggctcaagcgattctcctgcctcagcctcccaagtaactgggactacaggcatgcaccaccacgcccagccattttttgtactttcagtagaggcgggttttaccatgttggtcgggctggtctcaaactcctgacctcaagtgatccacccacctcggcctcccaaaatgctgggattacaggtgtgaaccactgcgccccaccagcttattgctttttttgtttgtttgtttaggcagagtcttgctctgtcacccaggctgcagtgcaatagcaccatctcagctctctgcaacctccgcctcccaagttcaagcggttctcctgcctcagcctccagaataggtgggactacaggtgtgtgccatcatgcccagccaagtttttgtatttttagtagagacggggtttcgctgtgttagccaggatggtctcgatctcctgaccttgtgatccgcccgcctcagcctcccaaagtgctgggattacaggcgtgagacaccgtgcccaacctcttattgctgctttaaagcaaattgcaaagaaagctctagagaatccatttgtctcctattaagctcaacatgagagactttaaataatataaatacatgacgcactttttactcaactttttgttgtagaaaagttatttttcaatgaaaaaattctgttaacaatactgttctcaaggaatattttctgttgttataacctgggtcatgggttactactgatatctagttggtagaggccatgaatactgctaaactctctgcaatgcacaagacagtcctcacaacaaagcattatctagcccataatatcaacagtggtaaggctgtgaaatctaaactaaaaatagattttgaaaaaatttcaattgtataattctaccacactaaatatcaatataatcaatataaacacatactctttgagattctcaatcatttaagaattatgagagtcttaaggaacaaagaaaatacaaataatttgcttcaatattttagtaggcacaatacagcttatgatgtgcctaacactgagcttgatatcttgcaaagtacttagctagaataacaagacaggtttctaaaaagctcacctttgtgtgatatgatgaggtatctccaaggtcacactgtggaaggaaaaaaaattcataacaatagatgttaacatttgttaggcctgaagacattttttaaaaggggggcagaggaaactctcctagtggccctgaaattcaaatcttctagttcagaacagtaccataagggcactttgttttcatttctttgttttttacaaaaatatgagaaccaaaatgcaaggaaatatgccgttagaagacgcgtttctgttggtgattacaatatataaataataacagatttccttgttacatgcttttctacccacgaaacctttcgtcccatgcgatttattttatgtatttatttattttttgacccagagtctgtctctcttgctcag

SEQ ID NO: 11521 - DNA, 9122 bp, Homo sapiens
tgtacaaaaatcaatgcatatttatgaacttttttttcaaatatattttcacacattttatctaaatacataatacagaagcctgtgtgacttgggcaatgtggccaggagggcctgagactaacacatccaccttggcaaaaggacataaaatatgtcttatggtcagaaaaatcaacattttgtgtatttacttagtttatgaaaagtactgaaaatgctattactagctgaatttgtgatttccttttgaaattctgagttatccttatttttcccattttgtttttgcaccaaggagactgcagtcaaataaaacagatactacacgcactcgtcggggcagccgtactgcagaagcacgttgatgcactcctggctggaggcctgccgggcgtaggtcagcgctgtgttcccgtgggcatctcgggccatgacgtccaccccgtaccagatcaggagctgtgccaggaccacattccccttgcggcaggccagatggagcgccgtgcagccgtctccctccccacaggtctcgttcacctcctcacgggagccatgtgccagcagcaggatggctgtctgcaggtcctcatcagcggtggcccgcagcaggtgctggcccagggacagctcagtgcagggtagtggggccagaaagagcttctcctcatatttggaacggatccaccgttccttctcttccctcgtggactttactgagggttttgtctgcccctggctgctcccttcccagatgctgttggctaggtcattgccaatagatgacataaccttcctgagctcaactggccagtcatccagctccagagatcgcacacgggaaaggcgggtgccaagactgcggtggattcctgagcattcaatacacatgaggactcccaagttcaaactggcccacttaggattctgggtctcatagtccacacagtgggcgttcccacgcatgttttggatcgactgcagggccatggcctcgctctggctggtcagctgggacttgcttttactgctctcgcatgactgcaggctggccaggatctggctctggatggcttggacccaggcatcccgctcctcatacgtcgtggcttcaaagtgccatgtttggccagtggcagacacaatcataaagttgttggtgcttttcttctttaggtgtttctttttattggcatgaggagaggggggcgggttgagcttggggctggtggtgctggagatactggggctgaagcatatggagtcacccagcccggtgtccatgtccttggataggccattgcttttagagctggagatgggtgcacaggccgatgtggctagggatggccactttcctgggactttgatggtagatgtccgaaggtcaatctcttttttatgaatattcttcatataatcacctaagcttgaataataggtgagcacgccattggaacacagggtgacgtatttctttttccatgtcttcagccatttcccacttcgctttaagagcatgccctgtttaatggggatggctctgccgctcccgatggtgtcagcatgattctccggggctttcctctctttgtctgggtgactccctttctcagatgtaaacaggttggaccagcgcatggaccgcttgcaaacgggggtgggtgtgttggcagtgggaggaacactgaactgagggtcctcctggctggtgctgggagtcgatggaatggaggaggaatagttatttaaactcccacctccatttctgttcttcgtaatgtgcacggtggaaacctgtgtggaacagaaggaggaatggcttcaaaaattgggtagtggcttgcagggtcctatagacagcttacaattaccttttaaaaagatacattttctgggccaggcatggtggctcacacctgtaatcacagcactttgggaggccaaggtgggtggatcacgaggtcaggagttcaagaccatcctggccaacatggtgaaaccctgtctttacaaaaaaaaaaaaaaaaagaaaagaaaaaagaaaaaaaaattagctgggcatggtgtcacatgcctgtaattccagttactcgggaggctgaggcaggagaattgcttgaacagggacctgggaggcagagcctgcagtgagccaagatcgcgcgattgcactccagcctgggctacagaaagagagtccatcaaaaaaaaaaaaagatacattttctgttgtttggatagtatatttactcatactagctcactaactaaacagagctgcagatcagttcttactccagcacattctttttacaacacttaagatgactaaatgcaacatgaaatggggaagatttaaaaaaagatggctttgacttcagcatgaaacagatacaagtgtacgatgaaaatagaacctcaataaaagtgccacttaccgcaaatgagtgtaactgttcatcaggtatgctcaaagatctatctgcatctctataaaataagaaagtgcattacttcaaaaactgttaatatcttagtataatatttgttgagtaaaatacttcctcctgtgtgctttggtgtttactttaccaaagcagtttttacaaattcttctcctggatcctgacttgcagagggtttcctgacttcttctttctcagcacatcatggcctgtaccgtgaagccttttatatgataaccagtcagaaatgcccatgaatattgactctccctaacaggccatggcaataaaccaaacatattttcactcttctaaccacacattgaaacacaagaatgttctacaaagcagtagtagtaaactttaataaatgtaaatgtgattcagatttcctagcttcctttctctttagttctctgtagtatactctcatgatgtttttatgtattttctgttgtctgaatgacaaactcatctgcctttttaagaggccagtctttgaggaactttaaactttgtaaaactaatgcattgtgcctgtgtataaaccagtggttctccaaatgtgctctgtggacctctcgggatcccgaagaccccttccagaaggcctaagaggtcataactgttcttttttttttttttttttttttttttgagaccaagttttactcttgttgcccaggctggagtgcaatggtgtgatctcggctcatggcaaccttcgcctcccaggttcaagtgattctcctaccccagcctcccaagtagcagggattacaggcacctgccaccactcctggctaagttttgtatttttagtagagatgtggtttcaccatgttggccaggctggtcttgaactcctaacctcaggcgatccacttgcctcggcctccaaagtgctgggattacaggcctgagctactgtgcctggccaacactgttctgaatcatactaattaaacctgagaaagctgatgaaaaattttaaaaatttgtgaaagtaatacaaagtcattgcctgctttttcgttgacacttgccatgattgtataaaagcaaaagtaggtacaatggctggtttctcagcataaatcaaggcagtggtaccaattacattagtagtccctttcactgtcccctacaggtaaaaaacatagcctgaatttcttaagaacgtctttgatgaagcaataaaaattaatgttgttaaatcttgacatgtctctaatattctgaataagtggaaagttaatgagaagtgcttttttttttgtttttaaagaatccgtgatttaactgtgaactgaaaaatcacttttttcacagaacatcatttttatttaaaagtacaactgggccagcgcagtggctcacgcctgtaaaatcccagcactttgagaggccaaagcaggcagatggcctgagctccttcaggagttcgggaccagcctaggcaacgtaacgaaactgtgtctctatcaaacatataagaaaattagcctggcgtggtgccacacatctgtggtcccagctacacaggagcctgaggtgagaggattgcttgagctgagatcatgccaatgcactccagccaagtgacagagtgaaactcggtctaaaaaaccagttcaactatcattctcaaaaataaatgaagtgagaggttgtcacttcaagggaaatacgtatttgttcccaatgataaaatttaagctttcctgtggactttgaaaaacttgttccttctactgtaggcttggcagcttttcaatacttaaaggcgtgttaaagtaagattggtggttaaactaaaagtgatttttgacacaataaaacataagccaatatattccaagtaactaatgcatgatattataaatgcaagtatggagcaaaagatccatttactgtgcaagaaagatcaatgagtactgatggaataaatttattaatatgtaaaatgccaccgtaactaatttaagaaaccaccacttgtgaagttttgatttagtgttttaacaaatacccacaactgtctgaaaactttaaaaatacaccttctaccaactacatatttgcatgaggttaggtcatcttattgcttctttttctctttttttgagacagagtctctctctgtcacccaggctggggtgcaatggcgagatctcggctcactgcaacctccacctcccaggctcaagcgattctcctgcctcagcctcccaagtaactgggactacaggcatgcactaccatgcccagccactttttgtactttcagtagaggcgggttttaccatgttggtcgggctggtctcaaactcctgacctcaagtgatccacccacctcagcctcccaaaatgctgggattacaggtgtgaaccactgcgccccaccagcttattgctttttttgtttgtttgtttagacagagtcttgctctgtcacccaggctgcagtgcaatggcacaatctcagctctctgcaacctccgcctcccaagttcaagcggttctcctgcctcagcctccagaataggtgggactacaggtgcgtgccaccatgcccagctaagtttttgtatttttagtagagacggggtttcgccgtgttagccagaatggtctcgatctcctgaccttgtgatccgcccgcctcagcctcccaaagtgctgggattacaggcgtgagccactgtgcccagcctcatattgcttctttgaagcaaattgcaaagaaagctctagagaatccatttgtctcctattaagctcaacatgagagactttaaataatataaacaaatgacacactttttactcaactttttgttgtagaaaagttttttttcaatgaaaaacttctgttaacaatactgttctcaaggaatattttctgtttttataacctgggtcatgggttactactgacatctagttggtagaggccatgaatactgctaaactctctgcaatgcacaagacagtccttacaacaaagcattatctagcccataatatcaacagtggtaaggctgtgaaatctaaactaaaaatagattttgaaaaaatttcaattgtataattctaccacactaaatatcaatataatcaatataagcatatactctttgagattctcaatcatttaagaattatgagagtcttaaggaacaaagaaaatacaaataatttgcttcgatattttagtaggcacaatacagcttatgatgtctagagctgtgacctaacactgagcttgatatcttgcaaagtaattagctagaataacaagacaggtttctaaaaagctcacctttgtgtgatatgatgaggtatctccaaggtcacactgtggaaggaaaaaaaattcataacaatagatgttatcatttgttaggcctgaagacattttttaaaaggggggcagaggaaactctcctagcggccctgaaattcaaatcttctagttcagaacagtaccataagggcactttgttttcatttctttgttttttacaaaaatatgagaaccaaaatgcaaggaaatatgccgttagaagacgcgtttctgttggtgattacaatatataaataataacagatttccctgttatatgcttttctaccgatgaaacctttcgtcccatgcgatttattttatgtatttatttattttttgacccagagtctgtctctcttgctcagactggactgcagtggtgccatcttgactcctcacaacctccaccacccaggttcaagcgattctcacgcctcagcctcccaagaagctgggactacaagtttgcgccactatgcccagataattttttttggggggggtgggtgggtggagtttcgctcttgttgcccaggctggagtgcaatggtgtgatctcggctcaccacaacctctgcctcccgggttcaagagattctcctgcctcagcctcccaagtggctgggattacaggcatgtaccaccacgcccagctaattttgtagagtgaggctcaaaacaactgagggaaggtaaatctcaattctactaataggtctacacaatattagcactttttaaaaagcctgtaacattagcatgtgagatggatatgtctatagtgcttcaagtagttttcatctctgaaataattttaaaatcacagaatttaaagttacatgctggaaaggaccaatgaccttatgtgacatttaattcaacactcgttttacagatcagggaaacaaaccttaaaactgacttgcccaaggtcccaccaaataggagcagtttctcgtcctaaactcaaattaagcagtggctctcaaactttgctgcacattaaaatcgcctgagaagctttaatatctgcctcatcttccacatgagacattttaatttaattagtattgggtatggctttgggcatcaaggttcttggtaaacgtttcccaggtgatttcaatcagcagcaaagtttggaatgattgagctggggtgaaaatcagaatcttctgggatgcttttcttcacagaaagatgcctcacatccatcctgattttcctaaaaggcttctcagtgcctacagatagagggaaagtggagatgggaagatacatgtatttgcagacttgcattttgaaaaaaaccttgcataagtgatctcagcgagtgccacctatcccactgacaacagtgcactactgattcatgataaaacatttttcaaaatatcttcttgaagccaatttgccctattaatttgttcaataactttatttcaccaatagtgaatacaccaaatgattatttctcaaacttgctggtggcaaattaaaacttactatactctcaaaagtagacttctaaaaagtagaataatgaggaaaaaagcacgaaattagtttcagcaaaattaatcttcaaagctgcttttgaattatatgctaacttatcaaaatctttggaactcagaagaagccagggactctagtcaaagtaatttttgtgtatgtgtgctcaaagatttaagagacttggctgactacagacatttagtgattactcaataggtcccaaagctcaggacttgagacagagtttgagtccagtttttgttcgaaacacaatttcctctcaactattgttaaaagggagggaggaaagtgacattattatgagtgtaaacttgccacttttaattgaagtaaaagttattgacaattgaattagctaaaaaggctagtgcatctgaaacaaaattgtttataagctagttatgtttacagaatgaaaagttaaattaaagataaagacattaatattctaaattaggactttccaaactgtgttctaaaaatcaagactaataacccaaggagatgagaataatgtacactggacggcccctgtggagctggtggtggtgttggttgttgttccttttaaaataaacttcatctcagggtgctctcaaagcgcatctttgtggcccacgaggtgctcatgcacaatgggagaaattcaaatgcagatacactgtggtgccagaagaagaaaagctgttccttcttccaaggataatgtccaaagtagtgcacactgatttgggcctatgatgcattgaaaaactaagtttccacaaaaaacattcaataaagggaacctatccttctcactgtgttcaacattgtctaaaggcataaaggcatcaaaaagatacactgtttctgggtttgcttctttgctaactgatttttccttccaccacgacgtctaagattaaaagagaaactgatacttaatattgagaatctggatatcaatatatggttgactccaatttcttaagctgattgctgaagaggacaaccaaatggctgaaataatttccgaataaaggaatctgtccctcggcagcatagttgtactcacgatattattgtcattgtaagataatgctggctggctgtgctgtcatcaaggaatattgtcgaacacgagctgtattgttgactgaaacgctcagtagatacctgaaggggaagggaagtgtaagtcaaatttatcaaagtgtatttttttctcagttaaaatgtcaaatgacaaagcactaagatatgtcttacactccatgaactgcctgagtgtggtatcatgtgcactctatagaaaacccattggaggctctcaacttccagagatgatgtttaagatatgggttataaaatgctgcccttaatatggtacctgtcatcaaacctaacaaggattttatgaattaccgttaaaaataatgggaaaagtcggcttcgccgggcgcggtggctcacacctgtaatcctagcactttgggaggtggaggcgggcagatcacgaggtcaagagatcgagaccatcctggctaacatggtgaaaccccgtctgtactaaaaaatacaaaaaaaaaaaagtacctgggtgtggtggcgggcacctgtagtcccagctgctcgggaggctgaggcaggagaatggcgtgaacccgggaggcggaggttgcagtgagccgagatcgcgccactgcactccagcctgggcgacagagcaagactccatctcaaaaaaaaaaaaaaaaaaaaagacttagtatattttt

SEQ ID NO: 11522 - DNA, 23934 bp, Homo sapiens
  misc_feature (22909)..(22909): n equals a,t,g, or c
tgtacaaaaatcaatgcatatttatgaactttatttcaaatatattttcacacattttatctaaatacataatacagaagcctgtgtgacttgggcaatgtggccaggagggcctgagactaacaaatccaccttggcaaaaggacataaaatacgtcttatggtcagaaaaatcaacattttgtgtatttacttagtttacgaaaagtactgaaaatgctattattagctgaatttgtgatttccttttgaaattctgagttatccttatttttcccattttgtttttgcaccaaggagactgcagtcaaataaaacagatactacacacacttgtcggggcagccgtactgcagaagcacgttgatgcactcctggctggaggcctgccgggcgtaggtcagcgctgtgttcccgtgggcatctcgggccatgacgtccaccccgtaccagatcaggagctgcgccaggaccacattccccttgcggcaggccagatggagcgccgtgcagccgtctccctccccacaggtctcgttcacctcctcacgggagccatgtgccagcagcaggatggctgtctgcaggtcctcatcagcggtggcccgcagcagctgctggcccagggacagctcagtgcagggtagtggggccagaaagagcttctcctcatatttggaacggatccaccgttccttctcttccctcgtggacttttctgagggttttgtctgcccctggctgctcccttcccagatgctgttggctaggtcattgccaatagatgacataaccttcctgagctcaactggccagtcatccagctccagagatcgcacacgggaaaggcgggtgccaagactgcggtggattcctgagcattcaatacacatgaggactcccaagttcaaactggcccacttaggattctgggtctcacagtccacacagtgggcgttcccacgcatgttttggatcgactgcagggccatggccttgctctggctggtcagctgggacttgcttttactgctctcgcatgactgcaggctggccaggatctggctctggatggcttggacccaggcatcccgctcctcatacgtcgtggcttcaaagtgccacgtttggccagtggcagacacaatcataaagttgttggtgcttttcttctttaggtgtttctttttattggcatgaggagaggggggcgggttgagcttggggctggtggtgctggagatactggggctgaagcatatggagtcacccagcccggtgtccatgtccttggataggccattgcttttagaggtggagatgggtgtgcaggccgatgtggctagggatggccactttcctgggactttgatggtagatgtctgaaggtcaatctcttttttatgaatattcttcatataatcacctaagcttgaataataggtgagcacgccattggaacacagggtgacgtatttctttttccatgtcttcagccatttcccacttcgctttaagagcatgccctgtttaatggggatggctctgccgctcccgatggtgtcagcatgattctccggggctttcctctctttgtctgggtcactccctttctcagatgtaaacaggttggaccagcgcatggaccgcttgcaaacgggggtgggtgtgttggcagtgggaggaacactgaactgagggtcctcctggctggtgctgggagtcgatggaatggaggaggaatagttatttaaactcccacctccatttcttttcttcataatgtgcacggtggaaacctgtgtggaacagaaggaggaatggcttcaaaaattgggtagtggcttgcagggtcctatagacagctcacaattaccttttaaaaagatacattttctgggccaggcatggtggctcacacctgtaatcacagcactttgggaggccaacgtgggtggatcacgaggtcaggagttcaagaccatcctggccaacatggtgaaaccctgtctttacaaaaaaaaaaaaagaaaaaaaaattagctgggcatggtggcacatgcctgtaattccagttactcaagaggctgaggcaggagaattgcttgaacagggacctgggaggcagagcctgcagtgagccaagatcgcgcgattgcactccagcctgggctacagaaagagagtccataaaaaaaaaaaaaaaaaaaaaaaagatacattttctgttgtttggatagtatatttactcatactagctcactaactaaacagagctgcagatcagttcttactccagcacattctttttacaacacttaagatgactaaatgcaacatgaaatggggaagatttaaaaaaagatggctttgacttcagcatgaaacagatacaagtgtacgatgaaaatacaacctcaataaaagtgccacttaccgcaaatgagtgtaactgttcatcaggtatgctcaaagatctatctgcatctctataaaataagaaagcgcattacttcaaaaactgttaatatcttagtataatatttgtttagtaaaatactgcctcctgtgtgctttggtgtttactttaccaaagcagtttttacgaattcttctcttggatcctgacttgcagagggtttcctgacttcttctttctcagcacatcatggcctgtaccgtgaagtcttttatatgataaccagtcagaaatgcccgtgagtattgactctccctaacaggccatggcaataaaccaaacatattttcactcttctaaccacacattgaaacacaagaatgttctacaaagcagttgtagtaaactttaataaatgtaaatgtgattcagatttcctagcttcctttctctttagttctctgtagtatactctcatgatgtatttatgtactttctgttgtttgaatgacaaactcatctgcccttttaagacgccagtctttgatgaactttaaactttgtaaaactaatgcattgggcctgtgtataaaccagtggttcttccaatgtgctctgtgggaccactcgggatcccgaagaccccttccagaaggcctaagaggtcataactgttctttttttttttttttttttttttttttgagaccaagttttactcttgttgcccaggctggagtgcaatggtgtgatctcggctcatggcaaccttcgcctcccaggttcaagtgattctcctaccccagcctcccaagtagcagggattacaggcacctgccaccactcctggctaagttttgtatttttagtagagatgtggtttcaccatgttggccaggctggtcttgaactcctaacctcaggtgatccgcttgcctcggcctcccaaagtgctgggattacaggcctgagccactgtgcctggccaacactgttctgaatcatactaattaaacctgagaaagctgatgaaaaattttaaaaatttgtgaaagtaatacaaagtcattgcctgctttttcattgacacttgccatgattatataaaagcaaaagtgggtacaatggctggtttctcagcataaatcaaggcagtggtaccaattacattagtagtcattctattcttcactgtcccctacaggtaaaaaacatagcctgaatttcttaagaatgtctttgatgaagcagtaaaaattaatgttgttaaatcttgacatgtctctaatattctgaataagtggaaagttaaccagaagcgctttttttttttttgtttttaaagaatccgtgatttaactgtgaactgaaaaatcacttttttcacagaacatcatttttatttaaaagtacaactgggccagcgcagtggctcacgcctgtaaaatcccagcactttgagaggccaaagcaggcagatggcttgagctccttcaggagttcgagaccagcctaggcaacataacgaaaccctgtcactgtcaaacatataagaaaattagcctggcgtggtgccacacatctgtggtcccagctacaaaggagcctgaggtgagaggattgcttgagctgagatcatgccaatgcactccagccaagtgacagagtgaaactcggtctaaaaaaccagttcaactatcattctcaaaaataaatgaagtgagaggttgtcacttcaagggaaatacgtatttgttcccaatgataaaatttaagctttcctgtggactttgaaaaacttgttccttctactgtaggcttggcagcttttcaatacttaaaggcgtgttaaagaaagattggtggttaaactaaaagtgatttttgacacaataaaacataaaccaatatattccaagtaactaatgcatgatattataaatgcaagtatggagcaaaagatccatttactgtgcaagaaagatcaatgagtactgatggaataaatttattaatatgtaaaatgccaccgtaactaatttaagaaaccaccacttgtgaagttttgatttagtgttaacaaatacccacaactgtctgaaaactttaaaaatacaccttctaccaactacatatttgcatgaggttaggtcatcttattgcttctttttttctttttttgagacagagtcgctctctgtcacccaggctggggtgcaatggcgagatctcggctcactgcaacctccacctcccaggctcaagcgattctcctgcctcagcctcccaagtaactgggactacaggcatgcaccaccacgcccagccattttttgtactttcagtagaggcgggttttaccatgttggtcgggctggtctcaaactcctgacctcaagtgatccacccacctcggcctcccaaaatgctgggattacaggtgtgaaccactgcgccccaccagcttattgctttttttgtttgtttgtttgtttaggcagagtcttgctctgtcacccaggctgcagtgcaatggcaccatctcagctctctgcaacctccgcctcccaagttcaagcggttctcctgcctcagcctccagaataggtgggactacaggtgcgtgccatcatgcccagccaagtttttgtatttttagtagagacggggcttcgctgtgttagccaggatggtctcgatctcctgaccttgtgatccgcccgcctcagcctcccaaagtgctgggattacaggcgtgagccaccgtgcccaacctcttattgctgctttaaagcaaattgcaaagaaagctctagagaatccatttgtctcctattaagctcaacatgagagactttaaataatataaatacatgacgcactttttactcaactttttgttgtagaaaagttatttttcaatgaaaaaattctgttaacaatactgttctcaaggaatattttctgttgttataacctgggtcatgggttactactgatatctagttggtagaggccatgaatactgctaaactctctgcaatgcacaagacagtcctcacaacaaagcattatctagcccataatatcaacagtggtaaggctgtgaaatcgaaactaaaaatagattttgaaaaaatttcaattgtataattctaccacactaaatatcaatataatcaatataaacacatactctttgagattctcaatcatttaagaattatgagagtcttaaggaacaaagaaaatacaaataatttgcttcaatattttagtaggcacaatacagcttatgatgtctagagctgtgacctaacactgagcttgatatcttgcaaagtacttagctagaataacaagacaggtttctaaaaagctcacctttgtgtgatatgatgaggtatctccaaggtcacactgtggaaggaaaaaaattcataacaatagatgttaacatttgttaggcctgaagacattttttaaaaggggggcagaggaaactctcctagtggccctgaaattcaaatcttctagttcagaacagtaccataagggcactttgttttcatttctttgttttttacaaaaatatgagaaccaaaatgcaaggaaatatgccgttagaagacgcgtttctgttggtgattacaatatataaataataacagatttccttgttatatgcttttctacccacgaaacctttcgtcccatgcgatttattttatgtatttatttattttttgacccagagtctgtctctcttgctcagactggattgcagtggtgccatcttgactcctcacaacctccaccacccaggttcaagcgattctcatgcctcagcctcccaagaagctgggactacaagtttgtgccactatgcccagataatgtttttttggggggtggggtggatggagtttcgctcttgttgcccaggctggagtgcaatggtgtgatctcggctcaccacaacctctgcctcccaggttcaagagattctcctgcctcagcctcccaagtggctgggattacaggcatgtgccaccacacccagctaattttgtagagtgaggctcaaaacaactgagggaaggcaaatctcaattctactaataggtctacacaatattagcactttttaaaaagcctgtaacattagcaggtaagatggatatgtctatagtgcttcaagtagttttcatctctgaaataattttaaaatcacagaatttaaagttacatgctggaaaggaccaatgaccttatgtgacatttaattcaacactcgttttacagatcagggaaacagaccttaaaactgacttgcccaaggtcccaccaaattggagcagtttctcgtcctaaactcaaattaagcagtggctgtcaaactttgctgcacattaaaatcgcctgagaagctttaatatctgcctcatcttccacatgagacattttaatttaattagtattgggtatggctttgggcatcaaggttcttggtaaacatttcccaggtgatttcaatcagcagcaaagtttggaatgattgagttggggtgaaaatcagaatcttctgggatgcttttcttcacagaaagatgcctcacatccatcccgattttcctaaaaggcttctcagtgcctagagatagagggaaagtggagatgggaagatacatgtgtttgcagacttgtattttgaaaaaaaccttgcataagtgatctcagcgagttccacctatcccactgacaacagtgcactactgattcatgataaaacatttttcaaaatatcttcttgaagccaatttgccctattaatttgttcaataactttatttcaccaatagtgaatacaccaaatgatcatttctcaaacttgctggtggcaaattaaaacttactatactctcaaaagtagacttctaaaaagtagaataatgaggaaaaaagcacgaaatttgtttcagcaaaattaatcttcaaagctgcttttgaattatatgctaacatatcaaaatctttggaactcagaagaagccagggactctagtcaaagtaatttttgtgtatgtgtgctcagagatttaagagacttagctgactacagacatttagtgattactcaataggtcccaaagctcaggacttgagacagagtttgagtccagtttttgttcgaaacacaatttcctctcaactattgttaaaagggagggaggaaagtgacattattatgagtgtaaactttccacttttaattgaagtaaaagttattgacaattgaattagttaaaaaggctagtgcatttgaaacaaaattgtttataagctagttatgtgtacagaatgaaaagttaaattaaagataaagacattaatattctaaattagcactttccaaactgtgttctaaaaatcaagactaataacccaagaagatgagaataatgtacactggacagcccctgtggagctggtggtggtgttggttgttgttccttttaaaataaacttcatctcagggtgctctcaaagcgcatctttgtggcccacgaggtgctcatgcacaatgggagaaattcaaatgcagatacactgtggtgccagaagaagaaaagctgttccttcttccaaggataatgtccaaagtagtgcacactgatttaggcctatgatgcattgaaaaactaagtttccacaaaaaacattcaataaagggaacctatccttctcactgtgttcaacattgtctaaaggcataaaggcatcaaaaagatacactgtttctgggattgcttctttgctaactgatttttccttccaccacgacgtctaagattaaaagagaaactgatacttaatattcagaatctggatatcaatatatggttgactccaatttcttaaactgattgctgaaaaggacaaccaaatgactgaaataattttagaataaaggaatctgtccctcggcagcatagttgtactcacgatattattgtcattgtaagataatgctggatggctgtgctgtcatcaaggaatattgtcgaacacaagctgtattgttgactgaaacgcacagtagatacctgaaggggaagggaagtgtaagtcaaacttatcaaagtgtattattttctcagttaaaatgtcaaatgacaaagcactaagatatgtcttacactccatgaaatgcctgagtgtggtatcatgtgcactctatagaaaacccattggaggctctcaacttccagagatgatgtttaagatatgggttataaaatgctgcccttaatatggtacctgtcatcaaacctaacaaggattttatgaattaccgttaaaaataatgggaaaagtcggcttcgcggggcacggtggctcacacctgtaatcctagcactttgggaggtggaggcgggcggatcacgaggtcaagagatcgagaccatcctggctaacatggtgaaaccccgtctctactaaaaatacaaaaaattagccgggcgtggtagcaggcccctgtagtcccagctacttgagaggctgagatggaagtattgcttgagccaggaaggtcaaggctgcagtgagctttgatcatgccactgcactccagcctgggcaacagagcaataccctgtctcaaaaaagaaaaaaatggctttgtttcactgtgcccttaagtgattctgtagctgggttatagaattcagcatcaattagttattttccaaagctcattgaagacatggcttcattggcctgtatctagtgttgctaatgaaattaatgaggaaaatctgatccttatttctttgaatttaaacaaattttttttttttttttttttatgctttggtagcttttaacatttttttctctattttcatagctttcttcacttttggggaatttttagctattaattaaatactactttctcccattctctctctgcctttggaattcctactagacgaaagcttgaatgcggtcacccagactttctggctcttaaccttttcacctttttctctttgttctttaacctgcaagactccctcaactgaatgctccattttgctaatggacccttcagtgtgtctctgctgttactcagcctatcttttgaggtttttctttcaataacttgggctttaatttttgagatctctaattggttctttttcataattgcttggttttattttcccctgttttgctgaaggtattaaatgtacttgctttaattgacctttggttgtagagaagatttttcatttgctctatttgttatttctctttcatagcagtgggcttcctcagacatctggcacttcttcaatgcacactagatttctggtttccaattctccacctgagtctcaggattctgcagcattcccaggtgggtgcagactcaggttacctgggccttggcttctcccatggcttcttaagaacttccttgtttatttctgtgatcccaagcactcccctttatgacttcaagcccaattgtatagtcagtaatttaatttctctatctgttctatcatttataagggcacagcatggaggggagggcctttcagatatttttcttgccccatcttaaatccctaaattacacttaaaaaaataccaccaaagcttttgtcttttatttaggaagaatagagtactcagacatgagtttggagtaggcgggtgtatgtgtgtatgtgtgcctatgcagtttaaacctgttctgtaatgtattgcaataaatgtttcagtgtcggtacagtgaacaattcaacttcataataggccaatctggaatctcccagaaaaatttactttgggtgttagtgctttttttttttttaatcattaatatctataggaagacctagtaggagtggctgacaaagtttaataaatctcatgataaaatgcttgtttttgatgtgaatgttgttcctcagtccatcctaaaatgaaattcacagggttgggttcgatgtcttcttccacacctctcattacaatctgccataggagtgcagaccgcccccatctgaggcctggatttaatgctcaaacaagacagatgccagcaggaaatatttgccctgccttcgctgtaaatcttgagtccttgtccatgatatcctaaaaggccaccagatggaaatgtgatgccgtgaaaagagatgcactaccctttgcaaagggggattgaccctgctgctctctcaaaagaaattgtccttattcaatgtaaaacaaggttttagaaatttttctttgttgaatgtagaataaagagggcattacatgaatgcctatgcatttcagctttggagaggaatccttacatccattctgacagcatggagataaaaagtctgtctttctgtattcatgttttgttgtcatttgctttcttttctcccttcttggtctgtgtgtaccacatcctctctatgtcttctctttctttcttttttttatttttgagacggagtctcgctctgtcgcccagactggagtgcagtggcgcgatctcggctcactgcaagctccgcctcccgggttcacgccattctcctgactcagcctcctgagtagctgggactacaggcgcccaccaccgtgcccggctaactttttgtgtttttagtagagacggggtttcaccgtgttagccaggatggtctcgatctcctcacctcgcgatctgcctgcctcagcctcccaaagtactgggattacaggcgtgagccacggcgcccagcccttctattatttatttactacgataaaatgtaatgtattaaataatcctgctacaagagcattttattgcagtgaatacaagactaatgcatttactaaattactaatcctaaatgtattatttcaggtgatattgttacaaaagaagtgtttcagattcagaggctctgtgtgtcagggctgctaggccaccaacaagtgaggaagccataggtttctctagtcctattttcttatgtggaggataaaaagagtatcacttacatattctctcacaccctgaaaacaaatgacaacttaaaaaatctaactttcacttcatgtttaaataagactgccaagacatgactcaaatgagactctcggagaatactttgcattcacttcaaaacttgatcaattgcattctataaatcatctgacctgcacctagccattttcctgctctacccctgctctctgcctagaatactgcttttctctttccttgcttcagcaagctcgactccatctaccctcttggatctctttgtcggcagccacaccaaaaaatgtatttttatacactaattagttgaattcaccactgcttacaagatgctaattcctgcagagtattccccttgtgagaaagtatgcctctccataagagtaagggagggcccttactcttcctacctccagctgctgagcatagaattttgagtaaatccaaaacttcgacaagtgtttgacaattcagttatcatttggaaggtaagtcttactacatttaattacagcaaaaacactactaacagtttactctttataggtattatttaaggtagtcacaaaatagaaacaaacactctaacgtcaggcagcataaatgagagtatgaaattttacaatatttaacaagaaatggaaggggttacttagtagttttaaggtttaatgacaaaaactagaaaataatcgtacctagtaatttagtaagtcaaaaccaaagccttaccatcaaaggtgcagtacccattggatgcggatgcccacgcactgacttcttctgctgtacctgctgcctctcattttaacccattaaaaatactaaagttgttttccttgtagacatctttcacctccttggttaggtctattcccaagtattttattttagtttagtttagttttgcagctatcagaaaaggggttgagttcttggtttgattctaagcttggtcgcttctggggtataacagagctactgatttgtgtacattaattttgtctcctgaaactttgctgaattcatttatcagttctaggagctttttggaggagtctttagggtttcctaggtatatgatcatatcatcatcaaacagcaacagtttgacttcctctttactgatctgcatgccttttattgttttctcttgtgtgattgctctggctaggccttccagtagtatgttgaatacaagtggtgagagtgggcatccttgtcttgttccagttctcggggggaatgctttcaacttttccccctttcagtatcatgttggttgtgggtttgtcatagatggcttttattatattgagctgtgacccttgtatgctgattttgctgagggttttaatcataaaaggatgctgcattttgtcaaatgctttttctgcatctgtttagatgatcatgtgattttttgtttttaattctgtttatgtggtgtatcacatttattgacttgtgtatgttaatccatccctgcatccctggtatgaaacccatttgatcatggtggattatcttttttttttttttgagatggagtctcgctctgttgcccaggctggaatatgcagtgtggtgatcttggctcactgcaacctctgcctccgaggttcaagcgattctcctgcctcagccacctgagtagatgggattacaggtgagcgccaccacacccggctaacttttgtatttttagtagagatgggatttcaccatgttggccaggctggtctcgaactcctgacctcatgatccgtccgcctcagcctcccaaagtgctgggattacaggtgtgagccaccgtgcctggcccgattattttttgatatgccgttgggaactacaaaacgttgctgaatgaagtcatggacacaaacaaatggaaagacaccccatgctcatgaatgggtagaatgaatattgtgaaaatgaccatactgccaaaagcaatctacaaattcaatgcaactcccatcaaaataccaccatccttcttcacagaactagaaaaaacaatcctgaaatttatatggaccaaacaagaaccggcacagccaaaacaaaactaagcaaaaacaacaaatctggaggcatgacattacctgatttcaaactatactataaggccatagtcgccaaaatagcatggtactgatataaaaataggcacatacaccaatggaacagaatagagaacccagaaataaactcaaatacctatagccaactgattttcaacaaagccacctaaaacataaagtgaagaaggtaaaccctattcaacaaatggtgctgggataattggcaagccacatgcgggagaatgaaactggatcctcaactctcagcttacacaaaaatcaactcaagatggatcaaggacataaatctatgacctgaaaccataaaagttctagaagataacattggaaaaacccgtctagacgctggcttaggcaaagacttcatgaccaagaacacaaaagcaaatgcaacagaaacaaataggtgagacttaactaaagagcttctgcacaggaaaaggaacaatcagcagagtatacagacaaccacagagtgggaggaaatcttcacagtctatacatctgacaaagggctattatccagaatctatgaggaactcaaacaaattacaattacaaaaatatggaaccagctcaaatgcccgtcaatcaatgagtggataaagaaaccgtgatatacatacatatatatatatatatgaggaataccacctcagccataataaggaataaattcatggcattcccagcaacctggatggaagtaagactattattctaagtgaaataactcagcatggaaaaccaaatatcatgttctctttcatacgtgggagctgagctatgaggatgcaaagccataagaatgatacaatggactttggggacttgggggaaaggctgggaggagggtgagggataaaagactacaaattgggttcagcggatactgctcaggtgacgggtgcacctaaatctcacaaatcatcactaaagaacttagtcatgtcaccaaatgccacctgttcccccagaaacctatggaaataataaataaataaataaagtacagcatttttctcagcaaacataaaataaaacaaagactaaagttcatatttttcactctccttttgggcaggacaaattttagataggtttttaaagaattagtaacttttttcctttttccgagacagggtctccctttgttgcccaggctggagtgcagtggtgcaattatagttaactgcagcctcaaactcctgagctcaagcgatcctctgcctcagcctcctgagtaggtaatacgaaaggcgcatgccaccaggcctggctaatttgttatttaacctttttgtagatatgaggacttgcgatgttgaccaggctaaaaatgaacaaatcttaattaacttaaatatttctaacactttgggcattcaggaaaacagctccatctatgttgtgaagtaatgggaagtatatggcagtggataaactttgaatgaaaatattaaacaaggccttaggagaaaagtgtaatatgcttattatagatacattaatttaaaaaattctctggcttaatatcattaattatactcaaattagactttgatttaaacacaggtcctaaatttggattaaatataatagattgaccacaaatttatttcgtctccctccggaagcctcatcagtcataaaataaaggttacacccatgaccagcacagaaggttgacagagataatttttaataaatgctgagacataaaaagtagataaaggagtggtaaataacacagaaacacaactttggtgcctacagaaagtgactggaacagaagcgagccagtttgtcttgcagaactaaaggcaggttgtgaacttacaggcaaatggcactttggaaagtagggtaaaatgtgaaaaaaaaaaaaaagccagcaaggtcagttgcaaatctctaactagagccccaagtccacctgtccttccatctgacaagaaacttagatgtgtgttctctggatatatcaaacctgagaatttctggctcagagataccatggcttaaacctgagatataaagaaaactgtacaccaaaaatggaactccaactttcttcgctaactctgcttttcctttccaggcctgcttttactttccaggcagaaaactgggagatccttctcagaagaaactgaaatgtcttcaaaaaagatccccagataatacactgaggtctcccaaatgaaaagctagtcaggcttctaaggcctcacactgagtgctatcagttaacagaaatcctgcttccaaataaagcaggccaggaaccaccacacattggagggaagcctccaagaaaagagatcaaaacaatagaaaaaaggaattgataggaccagtcaaaatcaggagcaaaactttaaaaaaaaatcttaaaacactctcaaaaaatataaaattcaatagaaatagtagaggataaagtcacagaatatcccagaactagaataaaaagacaaactgaaaaaaatacaaggggaaaaattaaaaatcaatgcaggcgtactggtctaagcagcctagcatctgaataacaagactatcagtaaaaaagtaacagagaaaataaaaaaaaaaattctcaagaagagatagtctgcaggtttagtagcctcaataaaatgaaaagatccccaacaagctgttataaaatttcagaaccttagagagagagattctaaaaagcttccgcagataactaaaacctggttgtaaataacatatcacacactggcaatagattcaagaacaacactgtaataagagcacaactgcaaaatgtcttcagaaccatacaatttagattcaacctagaggtgtactctctatcaaagaggagggattttaacatctccacacaggaaaatgtgttcaagtacaactagagacgataacaggacagaaggaaacacagaatctaggactcaggcgatcccacacaagacagcagttacatgagataccaaaagactttaaagagttagcccagaaaagcagacattgagcatatctagggaaacccacgctatattgaactaggatgacaaaaggccaaagaaagttgccccccacacaaacataaaaaggaacagatgtgttttcgcagatggaaaatatctttgaaaggcatgtgataaatgctacaatacttgggggaaaacagctgttagaaaacaggcaaatgaatatagtcagaaaattagcttcatgctaaaaaataatggatgtgaaagcaaacagagcacccagaggctacttaacgatatttggatagataaactaacgtaggctaggaaaaaagaagatccaggagaattgcagaagtgctcagatttcagaactgtttcagagacaggatgaaggacatggaatgcagaggcacagtgaaaacaccatatgacttagcagtgaataatatttgcagagtcataatcatgtaaatattactgatttaattaaaaagtgtgctacaattggaagaaacacagggagaaacataagatcatggtgtagcggggaaggtatgcttttacctgctgtgacagaaagtcaatagacagtgctggcaattaacttagctattctatttttgttctttcattaaaaataagattaaatatttaaggcaattttttttttttttttgagacagagttttgctctgtcgtccaggctggagtgcaatggcgcgatcttggctcactgcaacctccgcctcctgggttcaagtgattctcctgcctcagcctcctgagtagctgagattacaggcatgcaccaccacgcccagctacttttgtatttttagtagatacagaatttcaccatgttggtcagggttgtctcaaattcctgacctcagatgatcagcctgcctcggcctcctaaagtgttgtgattacagacgttagccaccatgcccagccttaaggcagatcttttgaaccggactattgaaatttaacttaaatgtcagaaatctttaaaaggtggacacgctaaactaagcacttttctggataaatttaatactcaggaaaatagaagagatttagaaaatccacaaaaagaggtccatgctaccaccaccaggtccacattgtaatttaaagaaatcaagagagacatccttttatgtcaaactatcaatttcttaactatttgagtgtttacttacatggtttgtacagttgcttcttcttatttctacaactaagaataaaaaaaaaaaaactggtcacttctgatacaaataccataaaataaaagtagttgttaacatcttactgattactcctatgaaaaatgagacaaaattccattaaaaaaaaaattttcaataacatataatttaaattatctggcatgattaatttcataagtcaaatctaaaaacttagattttcatttagtttactttttgtttctattacacacaaatgaaagaatcctcatgtacaaaagaaaagggcaaaaaaattaggccagatgaaaaatttagctaataaaaagtttaactgttgcatatatgagccatgatccattagtattctctcattctgcatttacacatagcttactttaattatcagactctaagagctaacagttctaaaaactacttcctgaccagacacctatctctagatgcaacagaatccctgtaagcatcttgaaccacacttagtggttatctactaatatgtcactaaaaacaaaacaaaattaaaaaatggtctttacacaactggaaagtaacctatcttaaatttgttttcttttttgagatggagtctcactctgtcacctaggctcgagtgcagtggcgggatctcagcgcactgcaacctctgcctcccaggttcaagcaattcttcagccttagcctccggactagctgggaccacaggcacgtgccaccatgcctagctaattgttttttgtatttttagtagagacagagttacactgtgttagccaggatggtcttgatctcctaacctcgtgatccacccacctcaacctcccaaagagttgggattacaggtgtaagccacagagcctggcctaaattttgatgttaaaataagtatacaaacctaattggacatggtgtctgcagcacaaaaaatcattttttttccctaaaaagaggccagaataataaaagccccaagagggacttgggccatgctttgtttcctacactgcctctgcctttgatgctgggagggccttgtaggcaaaagttactaccactgaagagtgagggacatggaatagcttttcttttactgcttccatgctctctaggtgtgagaagcccatgcctctggaaggaactgggaaatacaattctgatatgttttggatatgttgcccctccaagtctcatgttaacatgtgacccttaatgttggagacagggcctagtgggaggcgtttgggtaatggcagtggattccttatgaatggcttggtcccatccccatggtaataagcacattctcattatggtaatttaaaagactgtggtactggccaggtgcggtggctgaagcctgtaatcccagcactttgggaggctgaagcgggtagatcacttgaggtcaggagtttcagaccagtctggctaacatggtgaaaccctgtctctaccaaaaatacagaaattagccaggtgttatggtgcccacctatagtcccaactactcgggaggctgaggcaggagaattgcttgaacctgggagatggaggttgtagtgagccaagatcgtgccattgcactccagcctgtgcaacagagtgagactccatttcaaaaaaaaaaaaaaagagtgtggtaccttcccccttcccctctctcctccctctttcacggtgtggaaccacctgcttcccctttgccttttatcatgattgtaagtttgctgaggccctcaccagaagcagatgttaaagccatgtttgtacagcctgaaaatctttgagccaattaaacctctttttgttataaattacccagccttaggtatctctttatagtaatgtaaaaaatgaagacaaattctaaccagaaataactgactcaagatgggcaaagtctactcaaactataaaaacaaaggttacaaactcccgtgttttactgtgctgcattacttcgcacattataatagaaccctcacttgtgttcttgctgtttaagtcaactggaaaacttggctgtgtatggcttgttggcaaataaatgaggatttaatataacattaagggaaataagcaggagtaaggcatgtttaaatttacattatatcaaatgaaaaagttaataacctaaaacttttgagtagcgtaaacttggatgtggtaaatgaatgtggtcagaggactgtgtaagaggaggcccaaatcacagattcaatccctgatgataaacgactatgttttttaatttgtttaaatgaaaaccaagctgaagttctatcattcatctttaaaatgtactttttggagcaagggaaaagggattgtaaataaagatgaatccattaattataaataaagataaatccaagaattataaagagaaatccatgactcctccatcacatcacaaaataattgtgttgataaaaagatggcaaaatgtataaacaaaaaggttacacgttttcactaacatcatagcaactaaaggaaagtatatcacatattaaaataagacaagggaacatgtgaaaagatgaaaattttaaaccaatatgagtttttctaaatactttctataacctgatcaaacaagagcttttattctttctcttggtggaaaaaacaatgtcgtctcaccatctgtttgagagttcctctggaatattgtgcttgcctctggattggcagaagggttaaactccaaagctatatgcatagaggaagaaaagaaaaaaagatgtaatcattgataaaaatttatcaactcgtttattcgactgctgcatttaggctatttcactatctctactttgattcttatccattgaaatgaatgtatagacataagagagagccaggcaagatggcacatgcttgtagtcccagctactcaggaggctgagatgggaaaatcacttgaacccaggtcaggaagttgaggccagcatgagtaacataatgacaccctcctttatttaaaaaaaaaaaaaaaaagaagaggtaaattttggctttgagttgtgtaaaatcaactttgcataaaataaatcaagatggcagtaagttttaaaagacaggtctattttataggcaaaatataagatgtattctagagtttttaaaatttttaaaaagtaaattcatcatatctgtcacttccatttcattctgaggacacagaaccttagttctcttgagtagctgtcttccatagtcatgtgatatctctaagttttcatttcttcgttagcaacacatagggagaacatacacaggccttatttgtattggaaagggccaagtgagacatacataaactgtgttgtaatcctaaagaatgacaataaagagccatttttgggctctcatccaacactacccatctactaactggtgtgtaacatccatcaggctttccgaacatcaccaagcagagtataagtttacacaagtacttacatgctttgtgtataaaggtacaatcaattaattcacataatacatttgtttattctaaagcaatccttaaatatcttgaaatgtgaagatagtacttccaagttacaaagtcacactcataatgagtcttaattatcctacctctttaaaaattaagagcgcaaccaaagtttaaatagaagagctataagacatttcctctacagtgatgaaatctctggcatttaaatgaaaacaataagcctactggatgtaatatgtttatgatgcaatgttttctattttgaaaatttcagtttttattcaagaaccatattattacccagaattacttttacttagattcatctctttgcaaaattttagaggcaaacgaactaattgttttctcttttctaccggctcccatcccctgcctctgccagcagtgtagagactaaaaaactccaactttctttcctttttttttttgtgagacggagtctcgctctgtcacccaggctggagtgcattggcgtgatctctgctcactgcaacctccacctcccaggtccaagcaattctcctgcctcagccttgtgagtagctggaactacagtcatgtgccactacgcccagctaatttttgtattttttttttagtagagacagcgtttcaccatgttggccaggctggtctggaactcctgacctcaggtgatccgcctgccacggcctcccaaagtgctgggattacaggcgtgagccaccaagcccagccaaaactgtaactttcttatctttgaacaagatgctattgtcaggaggggaagggacaaagggggagccatggcaacaaacactcttacagggaaggtctgacattttaacctgcaatctttatattacacattgaaagtctacattgacgtttcatgtcttttgaaagttttgaccatgaaccaatccccacctctcttttagaacaaggaggtaaataaagtctgttaagtcaccagaataaatctggagacacattttctgttaaagtaagaactttaacagaaaagagcttcataggtaaactcctttgagaaaccccaaacacacacacacaaccatttttctgcagccccggctgtgacatttcacacctttcacaattattttaagcactctccttttttctttttccttctgtgttcaaattacagttagaagaaactaagcagcttctatcaaggtgacttaaagcagcccattaagaataccatatagcctctcccatggcaaactccattctgattttaaataagaaatccccaaatatttgaataggaactgtcttgagatttggctactttaacaaaggaaacaattaggcacttacctggttccttcacttaggtaccatctggataggtacaaagaaaaaataagatgggtactgaaaagttgggatatttgagtttttattgagaaaaggaagagaatagctcaaagaagcctaaacaaagtcccacaggataataaacagagctacagacactgttgtctcaccatctgtttgagagttcctctggaatattgtgcttgcctctggattggcagaaaggttaaactccaaagcntatatgtatagagggagaaaagaaaaaagatgtaatcatttataaaaatttatcaactcatttattcaactgctgcttattcgacaagagccataaataaatggtcccatgccagcctgggagaatgagatgagagagcaagaactgggcgattgggaggggaggcgaaaagaaactgactggactcggtggggaaatactaaggggtgggaattcaaggcagagccagcttttgttcctggccagctcccgggaaagctggctacaagcagaaaggagctcgaagtgggggatgcctcaaagggaaccttggggacagtagcagccagaggcaaaccgagggtagatggcacctatcacctcctcaccttcaggcatctcccggtcacgaacgtggtgcatgtggaggtcctcaccaacttcaacagtcacctcagcaggctgtacagcagcagccatgggcgctcctgccatcctgtccccagctcctgcctcatagatctcagattcagagggacacaccgacccctgctgctggtcaaactcgaggctgacgctagggtgcacacgacaggtcagtatgttccccatggggcgcctctactgtctgccaccacctgtgcctctgctcacagctttggccacgcactcccgctgtcctaggccgaggctatgctgcacttgcagagatggtcttcccgctcctcgcctgcccacctcacagcgcggccccgggcaccagccctggccctggccctggccccggccccggctagggctgcgggccaaggcccgcaccctgctgcctcccctgagttgacttgtctgggagggtgaagaccagccggcttatttaataggttgtgaacccaacaagtgctgagagacacaacaactgcctgaagagagaacagacggagctcctcctccttctgtagtcacctacagactgaagcccactggccccaggtgggagcccaggcatgtggcacacaatgccccaccccacacttcacaatgccctc

SEQ ID NO: 11523 - DNA, 8900 bp, Homo sapiens
tgtacaaaaatcaatgcaaatttatgaactttttttcaaatatattttcacacatcttatctaaatacataatacagaagcctgtgtgacttgggcaatgtggccaggagggcctgagactaacacatccacctcggcaaaaggacataaaatatgtcttatggtcagaaaaatcaacattttgtgtatttacttagtttatgagaagtactgaaaatgctattataagctgaatttgtgatttccttttgaaattctgagttatccttatttttcccattttgtttttgcaccaaggagactgtagtcaaataaaacagaactacacgcactcgtcggggcagccgtactgcagaagcacgttgatgcactcctggctggaggcctgccgggcgtaggtcagcgctgtgttcccgtgggcatctcgggccatgacgtccaccccgtaccagatcaggagctgcgccaggaccacattccccttgcggcaggccagatggagcgccgtgcagccgtctccctccccacaggtctcgttcacctcctcacgggagccatgtgccagcagcaggatggctgtctgcaggtcctcatcagcggtggcccgcagcagctgctggcccagggacagatcagtgcagggtagtggggccagaaagagcttctcctcatatttggaaaggatccaccgttccttttcttccctcgtggacttttctgagggttttgtctgtccctggctgctcccttcccagatgctgttggctaggtcattgccaatagatgacataaccttcctgagctcaactggccagtcatccagctccagagatcgcacacgggaaaggcgggtgccaagactgcggtggatacctgagcattcaatacacatgaggactcccaagttcaaactggcccacttaggattctgggtctcacagtccacacagtgggcgttcccacgcatgttttggatcgactgcagggccatggcctcgctctggctggtcagctgggacttgcttttactgctctcgcatgactgcaggctggccaggatctggctctggatggcttggacccaggcatcccgctcctcatatgtcgtggcttcaaagtgccacgtttggccagtggcagacacaatcataaagttgttggtgcttttcttctttaggtgtttctttttattggcatgaggagaggggggcgggttgagcttggggccggtggtgctggagatactggggctgaagcatatggagtcacccagcccggtgtccatgtccttggataggtcattgcttttagagctggagatgggtgcgcaggccgatgtggctagggatggccactttcctgggactttgatggtagatgtctgaaggtcaatctcttttttatgaatattcttcatataatcacctaagcttgaataataggtgagcacgccattggaacacagggtgacgtatttctttttccatgtcttcagccatttcccacttcgctttaagagcatgccctgtttaatggggatggctctgccgctcccgatggtgtcagcatgattctccggggctttcctctctttgtctgggtcactccctttctcagatgtaaacaggttggaccagcgcatggaccgcttgcaaacgggggtgggtgtgttggcagtgggaggaacactgaactgagggtcctcctggctggtgctgggagtcgatggaatggaggaggaatagttatttaaactcccacctccatttctgttcttcgtaatgtgcacggtggaaacctgtgtggaacagaaggaggaatggcttcaaaaattgggtagtggcttgcagggtcctatagacagctcacaattaccttttaaaaagatacattttctgggccaggcatggtggctcacacctgtaatcacagcactttgggaggccaacgtgggtggatcacgaggtcaggagttcaagaccatcctggccaacatggtgaaaccctgtctttacaaaaaaaaaaaaagaaaaaaaaattagctgggcatggtggcacatgcctgtaattccagttactcaagaggctgaggcaggagaattgcttgaacagggacctgggaggcagagcctgcagtgagccaagatcgcgcgattgcactccagcctgggctacagaaagagagtccataaaaaaaaaaaaaaaaaaaaaaaaagatacattttctgttgtttggatagtatatttactcatactagctcactaactaaacagagctgcagatcagttcttactccagcacattctttttacaacacttaagatgactaaatgcaacatgaaatggggaagatttaaaaaaagatggctttgacttcagcatgaaacagatacaagtgtacgatgaaaatacaacctcaataaaagtgccacttaccgcaaatgagtgtaactgttcatcaggtatgctcaaagatctatctgcatctctataaaataagaaagcgcgttacttcaaaaactgttaatatcttagtataatatttgtttagtaaaatactgcctcctgtgtgctttggtgtttaccaaagcagtttttacgaattcttctcctggatcctgacttgcagagggtttcctgacttcttctttctcagcacatcatggcctgtaccgtgaagtcttttatatgataaccagtcagaaatgcccgtgagtattgactctccctaacaggccatggcaataaaccaaacatattttcactcttctaaccacacattgaaacacaagaatgttctacaaagcagtagtagtaaactttaataaatgtaaatgtgattcagatttcctagcttcctttctctttagttctctgtagtatactctcatgatgtatttatgtactttctgttgtttgaatgacaaactcatctgcctttttaagacgccagtctttgatgaactttaaactttgtaaaactaatgcattgtgcctgtgtataaaccagtggttctccaaatgtgctgtgtggacctctcgggatcccgaagaccccttccagaaggcctaagaggtcataactgttcttttttttttttttttttgagaccaagttttactcttgttgcccaggctggagtgcaatggtgtgatctcggctcatggcaaccttcgcctcccaggttcaagtgattctcctaccccagcctcccaagtagcagggattacaggcacctgccaccactcctggctaagttttgtatttttagtagagatgtggtttcaccatgttggccaggctggtcttgaactcctaacctcaggtgatccgcttgcctcggcctcccaaagtgctgggattacaggcctgagccactgtgcctggccaacactgttctgaatcatactaattaaacctgagaaagctgatgaaaaattttaaaaatttgtgaaagtaatacaaagccattgcctgctctttcgttgacacttgccatgattatataaaagcaaaagtgggtacaatggctggtttctcagcataaatcaaggcagtggtaccaattacattagtagtcattctattcttcactgtcccctacaggtaaaaaacatagcctgaatttcttaagaatgtctttgatgaagcagtaaaaattaatgttgttaaatcttgacatgtctctaatattctgaataagtggaaagttaaccagaagcgcttttttttttgtttttaaagaatccgtgatttaactatgaactgaaaaatcacttttttcacagaacatcatttttatttaaaagtacaactgggccagcgcagtggctcacgcctgtaaaatcccagcactttgagagaccaaagcaggcagatggcttgagctccttcaggagttcgagaccagcctaggcaacataacgaaaccctgtcactgtcaaacatataagaaaattagcctggcgtggtgccacacatctgtggtgccagctacaaaggagcctgaggtgagaggattgcttgagctgagatcatgccaatgcactccagccaagtgacagagtgaaactcggtctaaaaaaccagttcaactatcattctcaaaaataaatgaagtgagaggttgtcacttcaagggaaatacgtatttgttcccaatgataaaatttaagctttcctgtggactttgaaaaacttgttccttctactgtaggcttggcagctattcaatacttaaaggcgtgttaaagtaagattggtggttaaactaaaagtgatttttgacacaataaaacataaaccgatatattccaagtaactaatgcatgatattataaatgcaagtatggagcaaaagatccatttactgtggaagaaagatcaatgagtactgatggaataaatttattaatatgtaaaatgccaccgtaactaatttaagaaaccaccacttgtgaagttttgatttagtgttaacaaatacccacaactgtctgaaaagtttaaaaatacaccttctaccaactacatatttgcatgaggttcggtcatcttattgcttctttttttctttttttgagacagagtctctctctgtcacccaggctggggtgcaatggcgagatctcggctcactgcaacctccacctcccaggctcaagcgattctcctgcctcagcctcccaagtaactgggactacaggcatgcaccaccacgcccagccattttttgtactttcagtagaggcgggttttaccatgttggtcgggctggtctcaaactcctgacctcaagtgatccacccacctcggcctcccaaaatgctgggattacaggtgtgaaccactgcgccccaccagcttattgctttttttgtttgtttgtttaggcagagtcttgctctgtcacccaggctgcagtgcaatagcaccatctcagctctctgcaacctccgcctcccaagttcaagcggttctcctgcctcagcctccagaataggtgggactacaggtgtgtgccatcatgcccagccaagtttttgtatttttagtagagacggggtttcgctgtgttagccaggatggtctcgatctcctgaccttgtgatccgcccgcctcagcctcccaaagtgctgggattacaggcgtgagacaccgtgcccaacctcttattgctgctttaaagcaaattgcaaagaaagctctagagaatccatttgtctcctattaagctcaacatgagagactttaaataatataaatacatgacgcactttttactcaactttttgttgtagaaaagttatttttcaatgaaaaaattctgttaacaatactgttctcaaggaatattttctgttgttataacctgggtcatgggttactactgatatctagttggtagaggccatgaatactgctaaactctctgcaatgcacaagacagtcctcacaacaaagcattatctagcccataatatcaacagtggtaaggctgtgaaatctaaactaaaaatagattttgaaaaaatttcaattgtataattctaccacactaaatatcaatataatcaatataaacacatactctttgagattctcaatcatttaagaattatgagagtcttaaggaacaaagaaaatacaaataatttgcttcaatattttagtaggcacaatacagcttatgatgtgcctaacactgagcttgatatcttgcaaagtacttagctagaataacaagacaggtttctaaaaagctcacctttgtgtgatatgatgaggtatctccaaggtcacactgtggaaggaaaaaaaattcataacaatagatgttaacatttgttaggcctgaagacattttttaaaaggggggcagaggaaactctcctagtggccctgaaattcaaatcttctagttcagaacagtaccataagggcactttgttttcatttctttgttttttacaaaaatatgagaaccaaaatgcaaggaaatatgccgttagaagacgcgtttctgttggtgattacaatatataaataataacagatttccttgttacatgcttttctacccacgaaacctttcgtcccatgcgatttattttatgtatttatttattttttgacccagagtctgtctctcttgctcagactggactgcagtggtgccatcttgactcctcacaacctccaccacccaggttcaagcgattctcatgcctcagcctcccaagaagctgggactacaagtttgtgtcactatgcccagataatttttttttggaggggggcggtgggtggagtttcgctcttgttgcccaggctggagtgcaatggtgtgatctcggctcaccacaacctctgcctcccgggttcaagagattctcctgcctcagcctcccaagtggctgggattacaggcatgtgccaccacacccagctaattttgtagagtgagcctcaaaacaactgagggaaggcaaatctcaattctactaataggtctacacaatattagcactttttaaaaagcctgtaacattagcaggtaagatggatatgtctatagtgcttcaagtagttttcatctctgaaataattttaaaatcacagaatttaaagttacatgctggaaaggaccaatgaccttatgtgacatttaattcaacactcgttttacagatcagggaaacagaccttaaaactgacttgcccaaggtcccaccaaataggagcagtttctcatcctaaactcaaattaagcagtggctgtcaaactttgctgcacattaaaatcgcctgagaagctttaatatctgcctcatcttccacatgagacattttaatttaattagtattgggtatggctttgggcatcaaggttcttggtaaacgtttcccaggtgatttcaatcagcagcaaagtttggaatgattgagttggggtgaaaatcagaatcttctgggatgcttttcttcacagaaagatgcctcacatccatcccgattttcctaaaaggcttctcagtgcctagagatagagggaaagtggagatgggaagatacatgtgtttgcagacttgtgttttgaaaaaaaagcctgtgcgatagagctgattgctgcaggcgaggtttgccagcctatcccactgacaacagtgcactactgattcatgataaaacatttttcaaaatatcttcttgaagccaatttgcccaattaatttgttcaataactttatttcaccaatagtgaatacaccaaatgatcatttctcaaatttgctggtggcaaattaaaacttactatactctcaaaagtagacttctaaaaagtagaataatgaggaaaaaagcacgaaatttgtttcagcaaaattaatcttcaaagctgcttttgaattatatgctaacatatgaaaatctttggaactcagaagaagccagggactctagtcaaagtaatttttgtgtatgtgtgctcagagatttaagagacttagctgactacagacatttagtgattactcaataggtcccaaagctcaggacttgagacagagtttgagtccagtttttgttcgaaacacaatttcctctcaactattgttaaaagggagggaggaaagtgacattattatgagtgtaaactttccacttttaattgaagtaaaagttattgacaattgaattagttaaaaaggctagtgcatttgaaacaaaattgtttataagctagttatgtgtacagaatgaaaagttaaattaaagataaagacattaatattctaaattagcactttccaaactgtgttctaaaaatcaagactaataacccaagaagatgagaataatgtacactggacagcccctgtggagctggtggtggtgttggttgttgttccttttaaaataaacttcatctcagggtgctctcaaagcgcatctttgtggcccatgaggtgctcatgcacaatgggagaaattcaaatgcagatacactgcgttgccagaagaagaaaagctgttccttcttccaaggataatgtccaaagtagtgcacactgatttaggcctatgatgcattgaaaaactaagtttccacaagaaaacattcaataaagggaacctatccttctcactctgttcaacattgtctaaaggcataaaggcatcaaaaagatacactgtttctgggattgcttctttgctaactgatttttccttccaccacgacgtctaagattaaaagagaaactgatacttaatattcagaatctggatatcaatatatggttgactccaatttcttaaactgattgctgaaaaggacaaccaaatgactgaaataattttagaataaaggaatctgtccctcggcagcatagttgtactcacgatattattgtcattgtaagataatgctgatggctgtgctgtcatcaaggaatattgtcgaacacaagctgtattgttgactgaaacgcacagtagatacctgaaggggaagggaagtgtaagtcaaacttatcaaagtgtattattttctcagttaaaatgtcaaatgacaaagcactaagatatgtcttacactccatgaactgcctgagtgtggtatcatgtgcactctatagaaaacccattggaggctctcaacttccagagatgatgtttaagatatgggttataaaatgctgcccttaatatggtacctgtcatcaaacctaacaaggattttatgaattaccgttaaaaataatgggaaaagtcggcttcgcggggcgcggtggctcacacctgtaatcctagcactttgggaggtggaggcgggcggatcacaaggtcaagagatggagtaccatcctggcaaacatggtgaaaccccgtct

SEQ ID NO: 11524 - DNA, 221 bp, Homo sapiens
ggtgggtggagtttcgctcttgttgcccaggctggagtgcaatggtgtgatctcggctcaccacaacctctgcctcccgggttcaagagattctcctgcctcagcctcccaagtggctgggattacaggcatgtgccaccacacccagctaattttgtagagtgagcctcaaaacaactgagggaaggcaaatctcaattctactaataggtctacacaat

SEQ ID NO: 11525 - DNA, 413 bp, Homo sapiens
gagacagagtcttgctctgtcgccaagattggagtgtagtggtgcgatctcctccacctcccgggttcaagcaattctcttgtctaagcctcccgagtagctgagactataggcatgtgccaccatgcccagctaattttcgtatttttatagagatggggttttgccatgttgatcaggctggtcttgaactcttgacctcaggtgatccacccatctcagaatcccaaagtgctgggattacaggcgtgagccactatgcccggcctcctactatttgtaataggagatagggtcagataagggaataaaagcaggctgccccagccaggggcagcaaccagctcaggtccccttccacactgtggaggctttgtttttttgcgctttgcaataaatcttgctgctgctca

SEQ ID NO: 11526 - DNA, 12562 bp, Homo sapiens
gtcctaagaaaagcaaagggtagttcattacttgaagccatcttcctctatgagttctatacaaagcctcagtagagtgggtccaattagcaaccaagttgaacaacttttatttgctgactaaatatagatacacctgaattgttgactgcttttgtaactaaacactcctctcctgtcttccaacgagtggtcatttttgtccgcaacttgaccacagcaatccctggggccctagctctactctcaataaagagttatggctgtgtgttttgaatgacaccttaggacccatcctgcctccacctccttctccataaaatagaaacctaacttgcccctccaagctctgaaatgctgaaacttaccaactcccttttctccccgctatttcttccttccgtggcagggactttcaggttttctttcttttactaacaaggcactaagcatgattttctcatacaaaatcgagagccataaagtggcttaccacagtcctatttcaataaagatgaatactcgacatctggcaagtagtgtgtgcctgacagtgtccccactgtgctatgctcatttaaccctcagaaacaatctcatgttacagattttgcagaagttgttgagacggagaaggtaagcaacctccccaaggtcacatgactgctaagggtggggccatagtttgatcccagctagtctgaattccccagttgcttaagcatgattatcagaaagtatagcagtctgttttcacactgatataaagaaatacctcaggttgggtaatttttaaaggaaagaggtttaactgactcagtttcacatggctggggaggcctcaggaaacttagaatcatggcagagggggaagtccttcaggaaacttacaatcatggcagaagggcaggtccgacttccatggtggccgcacagagagtgggaacatgtgaaggagcaactgtcaaacatgtataaaaccatcagatctcagctgggcacggtggctcacacttgtaaccctagtactttgggaggccaaggcaggtggatcaactgaggtcaggagtttgagaccagcctagctaatgtagtgaaatcctgtctctactaaaaatacaaaaattagctgggtgtggttgtgcatgcctgtaatcccagctactcaggaggctgaggcaggagaatcactggaactcaagaggcagagactgcagtgagccaagatcgtgccatggcactcctgcctggacaacagagcaagactccatcccaaaaaacaaaacaaaacaaaaccctataagatctcatgaggacttactgaatatcacaagaacagcatgaggataactgcccccgtgatccaatcacctccccctaggcccctccctcgacacatcaggattatggggattataattcatgatgagatttgggtgggggcatggcaaaaccatatcagaaagtaaaggtagaagtcaagcttggatgggaaatgacattgtagatgatgatgatgatgattattattattattattattattattttgagatgaagttttgctcttgttgcccagtgaaattgtttctctaatttcattttcagattgtgtcttgtagatgtatagaaatacaattgataaatgattctggctattaaccttttatgcttcaaccttgctgaacactattttttttttttttgagacggagtttctctcttgttgcccaggcaggagtgcaatggcatgatcttggctcactgcaacctccgcctcctgggctcaagcgattctcctgcctcagcctcccaagtagttgggattgcaggcatgcgccaccatgcccagctaattttgtatttttagtagagacggggtttctgcacgttggtcaggcccgcctcagcctcccaaagtgctaggactacaggcatgagccaccgtgcccagccagattcgtatatttttaaaagaattttttttttattttttttgagacagagtctcactctgttgcccaggcagtggcacaatcgttgctcactgcaacctccacctcctgggtccaggtgattctcattcaagtgcctaagcctcccaagtagctgggattacaggagcccaaccccatgctcagctaatgtttgtattttagtagagatggggtttcaccatgttgctcaggttgatctcgaactcctgacctcaggtgatccacctgccttggcctcccaaagtgctgggattgcaggcgtgagccaccactcccgaacagaacaacatttttttgatgtggattttaaaatgcctccccttctttcaacattgattaagtcccttctacatgccaggcactgtatgtgtgaaatagtcccaactctcaatgagtgtaggcagatacacaaacaaagccttaaggaggtcagttttctgagaccatactgctggacagtatatgaacctgggatacaaacccacctctatttgacctcaaatttgatgctggggtggttttaattttattctgggaatttcagtcattgaaccatgaaaaggtgaaaagtctctgtcagatgtgtgtgtagtggtctgtataataaggactgaaggaagcaaccaaacaaattaagagactttctctaaaggcagagtaatgctaagggcagtggcagtgacaaaagcggaggaaaaagtctgtgatcatttgggagacagaataggaagtgcttggtcatgagatgtgaaagaagaggggaagtagaaggaaaacagagctgctcaggctctgctggggaagactgggtatgtagcagtgccttcctcctggccaagaatgtaggaagagaaataggtaaggaggaaaagacagttttttactctcagtgtcacattaaaatggaactctctggtcaaaagttgaatataaatctctgtaggctaagtccatttgtgacatcccaacatatgttttcaaaaataacatacatactaaatcaagccattaagcgtaactggggaaatttcctaaaatttacatgctaaaaaatcaccatttttcatttattagtttcatggagcaactttgaatctatggttacagcaattgaggcaccttgtataaaataaagctaatacatgaaaaaaaaaagccatttaaaattctgttgttctcagagaatggagaaagcaattgaagccatgggtgtggaggtgactgccctgagaagctgtgtatagtaaggagaactgggaagaaagaagacctggagaatagggtgatttgcacggcattaagtgaagcttgcaaaagtgagcactgagactcaagagacctgcatatgaatcaggaatggctgctcctgtgagttgttagaaaggagatgatgccttcttttcatatctataacagcagcacctagcacagtgcctgttcaataggtactcaacatgtattatcccaatgcagagtcaaattttgccaggagggcaggaaagccacaaattagctatggcaacttagtgattgggcttgtgtgtgtgtgtgtgagcgagctggatgtcaggcagtgggtaaagtagtgaactggaggtgagaaaacaatgacacaaactcagggcttctcttcccaagtatttggctgagaagagagatgtagtattaaagggagatatgtggtaaaggaagacttttattccaagattcaacaaaagcgtgagtatacttctatgttaaagggaaagagccaacagagaaaacacatttttgaggttagaagagaaggaagaactaatgcagaagggccccaaaaggcacaggtgcctgcaatctggatcagggacagattagctttggactcctacaaaagcaagaagggagaaaggaccatgtgactctagagatatttctggtaaaggaaaggtttaggaaaagatcttttgatgacctttattttaacagactttttttttctttttgagatggagtcttgctctgtcacccaggctggagtgcagtggcacgatctcggctcactgcaacctctgcctcctgggttcatgccattctcctgcctcagcctcctgattagctgggactacaggcacccgttaccatgtccagctaattttttgtatttttagtagagacggggtttcaacgtgttaggcaggatggtctccgtctcttgacttcgtgatctgcccgcctcggcctcccacagtctgggattacaggcgtgagccactgcacccggccagactttaaaaaaaaaaaaaaaaaaaaaaaaaactactgtgggaaaaaggatattatgtatagaaaagtctacacttcttgatacaactaactaaaaaaagcctgatacactaaacaaaacccaaataatgtcttccctaaaagtgggtaacttgaaaagcaatttgagcaaaaatcaaggagttcaattataaataagtatatcaacaaagtgaaagatgggtttaatttttcccacaaaaagttaaaagaaataacagcaggtttagaggaagaggaaaaaataataagaaaattatatgcagttgcaaaatgtgtgactatttacaaactctaacatataactacaaaatggaccagaagaatcattatcataggaagcaaagggtcatttcaaaaatcagaggagggatgattcatatttaatttaattctgtggaaaaaatttaagtaatgtttgaggacaaaaataggtgatgtgttgaaatgcgggaaaccacagtggaaggaaaaataattcaagaaagctcagtttcagtaaccagtatctagtaaaatcttcaggacctagaggctacaatctgcattaatagtgtctgaagacctagaaatgtcattaaataccattttggataattcttgtagacttgagatgatgtctatttaaagttacaaaatagtgcccatatttctgtattcattacagaaaacaattggatatggaaaagaaactaacatgctatgccacaatctctaaagaaagattagggaagtttcagcttaaagcaagaataatcacaataaagttttacaaccctttgcaagcatatatgaaaaacttacaaaaagtctgtaatgatcttttcttaagctaagagaacagaaaaaatgagaaaaattaaattataaaatgaaactttggtttagaggtaagaaacatttgatgacagtcaagagatcagggttgtacagtgtattatgtgaatgttgtgactcattggtttcatcttggatatcataacttgacattttgtaaaagtgatttttcatgggagtttcttcaggtgccctatgaagtcctgtccctttagaagcgaataatagtcttccacattcttgagatatcttaatgaataacatcttctacagtcttccattgtttagaccttggagagacacgcattagtgactgttaaggtacctgggttattaggtgcctgtagactatgcccagtgatatgtgcattaggtacatgctccctagctgtgctgacactgactgaagctgtgaggtttcacaatgacatgtcagccaaatacatatgctcagatttaccatttatcaagaggtcttcacactatcaattgtgcaattatcattctacacacaggcagcgataaagggagtaaaaaaacacagccatggatcgggagaccaaggtacctccagaggagtccagtgggtccagaagccctttggatgttggtcagaagctcctcttgggcagagatcacagcagcagccaacaggtctggagaagaccttacagttctcatggacaaagtttgtgaaggcatcttagacaagatcttgtctttgctggttttatgatcctctgcagatgggtctattctcattacctcagccacctttcacttcctatcagttcagttcaggtctctcatgatcccaggcagcagtagttgttatcacgtaagttcattcatatatgtttatctctggggatggggggacaacttcactgtggacttaattctactggagatgagtgaccccattttaagacaacaggatcacaaattattatcacatatcagcagggcagacaatagctacgacctggggctgaaagcaggtaactctatttattctgcaaaaattctgtcttgattatggtgccagttgctgtgagggatttcctttctagaacctgtttttcacaaggtttgagtctgaactgttaacattctactgatttctgggtgaagggactgactgcaccatcctagcctgtcagagcacttgccccaatacttccactttaagagttttccaccttgtccagaactacagtccactaatcccctcattttctctcttaagagaataaacaggccaggtgcggtggctcacgcctgtaatcccagcactttgggaggctgaggcgggtggatcatctgaggtcaggagttcgagaccaacttcgcctacgtagtaaaacctcgtctctactaaaaaaaaaatcacaaaaattagccgggcgtggtggcaggcacctgtaatcccagctactcgggaggctgaggcaggagaatcccttgaacctgggaggcagaggttgcagtgagccaagactgtgccacagaactccagcatgggcgacagagtgagactccctctcaaaaaaaaaaaaaaaaaaaaaaaaagagagaaaaagagagagacagagaataaacaacccatgtcaagtacacacccacatccctcttatcccaaataccaaacacacaaaaatccaatctgtctccttctacctaagcaattgcagatagtcacattcccataattaccttaagctccctgacttgctgctcgtcctttctctggcaaaatctcatccttggatgagcccgactttgtgtttgctcaatgacaccactcacctgaaccagaaaaaatatcaaaaagtggtcagagatatcatcataaattcaaattacttacataaaaaattggccctaaatgtttccagaaatcaataaaagttttgtttctccaaagacatcatttcttcagaaacccaacgtgtataacctattttttctatgttcttctaacattcattcaacttctctcatctgatatcttgccaaatcattcaaagagaaaatatatcccattagtcaagagccaaccatattcccatcacctgagaaaatcatatgcacaggatgcgcccacctcacctttctctgcctcatgtcagaaaaagtacccctccttttgtcacaaggcaaacctgagataaaagatttagatggcctgtaattccagcactaagggaggccaatgcatgcagattatttgagtctaaaaaagaagcctaagcaacttagggaaactgcatctctcaaacaaatacaaaccattagcctagcatggtggtgtggtggcacatgcctgtagtcccagctactcagggtggggagcactgaggtgggaggatcacctgagctggaaggttgtggctgcagtgagccgtgatcacgtcactgcactccagccagggtaacagatattttttaaaggatcttctctgttaaaaataatcaaataaacaggtggccatgaggctgaggtggctgcagtgcactcaattcctccttaaataacccaaaacttgactcagtgtaaataataaaaggaaacttaagtttaaccagtcagaaaccaccaactaacatctaactagagaccttccactgtaatgttccaaatgaggccactgctccacttcacccaatcaagtattttctttttcttccacattcaccatataaaattcttcccccaccctccctaagcctctctgtgggacctctgagctgcttgcagtctggggctgcctagtttatacatttctgaatgctcaaatatattttctaatgtttcaaagtggctctggtgtaggaggttgttggtggagtgacccgagagtatacaggaattgaggccatatgagatctctggaccctgtactccattttgctgtacactcaatactactctaaaataataatatatctttaaaaatctataactatcacgtagcccttttcaagtctccaactggttggagccagttcgattaaagctcagaaaaaactggttaataagctagttctgacccaactggcaagaagcggcaggaaagacccaggccaggggagcatattgcacatgcatgcaccaggaaactggaggaagcttggaggccctttagcctggtcctgagcccgctgaaactgcagttacaggcacagatgcctggggcaccaatctgaatctgccaacatccaaggccacatgaacacaaatgcacagtctcctctgcgatcggtagctaaggatgttaggccatgattggactaggatgggagatgaactgagaactctggattctgtaggttgttgttgtctcttcccacccccaagcaacaagtgatgaacacacacacacacacacacacacacacacacacacacacatcccgtagtgactaacaggatctccctccaggggatttgcaggaaggggagcagaaaacatcccaggggcctttcacagctacttccttgagccccctttcagacagtgctgtctagacctgtctcagcccaagcatcaccaccctgatacgcagaagctggcatccttacctgaaattcaacatcaagaaatgatctcttctactcaacactgatagaaatacctctaagcaacgtcctcattggcaggggtggagtgggggagtttcttaaaaagtgaggcctctgcctaccacctagagaacctggaaatttccatctgtgccacaaagtccaaatcactggccactgccccagtgtatggcagattagaacatctctccattggatctgggtttctattccattgagtgaaatgccttttctactacaggaacagaataagggatcaaaagggtcttacaactgaactccagtgtacagtctgcacagacactaggcttgtgcaaatatgacacagcgaggccccaggacccttaagccagctgaatgtactgagtttcaggaaacagtgagatacattcagcaaaacagtgggcttcatgctgaaagaagtcaatccaagtaaacacacatctcacacacacacacacacacacacacacacgcacgcacgcacgcagacaccctagtggccaataggtcctctcaccaaaaacctgcgatcaggagagcagaaagcctcccagggctccaccactgccctttctgtagccccttatcagacggccagcctcaggacagcactgtctgatcctggtccagcccaaaccgccatcaccctgtgatgtgggagcaggccacttcaccagaacctctgtggcagaaaaatttctttcttttaaaatgatgagggggaaccttcagacagtgtcctgattagggtgggtggagaggggggtttcccagaaagtcaggcagggcagggcagaagccctctgggttaactgtgtgcttttgatatgaaggcaggtaagactggacaggtgggggtgttagtgaggggatggtgtagggtgctgaagaactccacttgggctctgcgcaccagggaaaatgaccacaaaacatcccatcttcactgctcagagaaggctagatctgctgtgagctaggaagccatgtgggggcagctgatgagtcatcaaatgggagaaatctgagagccatgtgttccacaggcctctggtccttgttcaggcagcagggcactgtgagatgtggctccttggccctttccagccaccaccttgattgcctgctgcaaggaaagagactgaagcccaagaatggggtcttgctcaccataggatgatggctcagtgtgcagagctgagctatggcccaagaggcaaaaggtggggatgacccaggctgagctgggggatccaactgaacatgcacttgctaagaagctgtgggctatgatgccttgggaccccagtctgggtcgagaattgtagcaaaacaggctactggtaaaagttcttgggaagccaactcacttttgctttcatccgtgggcaaacaaacctctgatcaaccacaccacaatggtgtcactctgtaaggcacaggcagacaaggcatccagccttgcacactccagggcccacacatgtccagaatacaatggttcttgttgagactccactcttccaactcagacagaagctccccaatctcctcagccactcccaacaactggaggtctgaaaactttcatgcatgccgctatggtctaaaccactcgtggtggttttgattttcattttcctgataatcagtgatgctgagcacctttccatatgccttttcaccaactggatatcttctgtggctaaatgtctattgaaatccattgcccatttacaaatctgcttttttgtgggcttcttgatgtttttctttttttttttcctatttatttatacaagttccttagatattttggatatttttaaaaatgattttcaattccattgccccagttataaatcttttttttttttttttttttttttgagacagagttttgctgttgttgtccaggctagagtgcaatggtgcaatcttggttcacagcaacctccacctcccaaagtcaagcaattctcctgcctcagcctcctgagtagctgggattacaggcatgtgccaccatgcccggctaatttttgcatttttagtagaggcagggtttctccatgttggtcaggctggtcttgaactcccggtctcaggtgatctgtccaccttggcctcccaaagtgctgggattacaggcatgagccactgtgcccggccaattatccctttttgtggtttttttttggggggggtggggggaagaacagagtctcgctctgtcacccagtctggagtgcactggtgtgatctcggctcactgcagcctccgcctcccagattccagcaattctcctgactcagtttcccgggtagctaagattacgggcgcgcaacacatgcccagctaatttttgtatttttagtagagacggggtttcaccatgttggccaggctggtctcaaactcctgacctcaggtgatccacccacctcccaaagtgttgggattacaggcgggagccaccactcccggccccattttgtgttttaacatcagtcgacactcgtattttaaaataataacaatgaatggcggtaccttagaacaaggtaattatacatctttctcttgtcctagtgcagacattttgtctataaaatgttattcacagatgaattcatgaaaacattactgtgaattttaaatccatatacaagtgtatgcttgttcatgaatacttcaataaaataaaactaatagcaaaaaagaattccagagttgaagcagtttcaggaaaaaggagttggcagtatgaagtaaaatagaaaaaaatgggtttttttttaaatgggtatatttgtgtctacaacttttttttaattatagcattagacaatgtgtatatatatatacatatataaagcaatggaagtggcattgttttcatactagtctaggatattaaaatatatgtaatatgtgattggcaaaataatggccccccaaagatgtccacagattcctagaaccttacatgaaaacggtacatcatgcatgtgattcaggtaaagaccttgacatgaggagactaccctggtgctatggaatgaacgttgtgttccgtcaatgttcatgtgttaaaatcctaaccctcaaggtgatggtattaggaggttaagccttacgggagactctgccctcatgactgggattagcaccttattacaggcacaagggagcttgtttgttcctctcaccatgcgaagacacagcaagaaggaagcctctatgagaaagcaggccttcaccagacaccaagactgccggcaccttgatcttgcatttctcagcctccaggactgtgagaaacgaagttctgttatttataagctacctggtctaatgcatttccttgtagcagcctgtatggattaggacagtgggctcatgtggatgatgacggtgtgtccattcaggactaagtaagcacatgagtccttaacagtggaagagaagggggaaggaaagagccacagagacatgtggccacagaagaagggtccatgggatgcaaggttgctaatggtgagagtggagaagagcccaaagccaaaaaatgcaggcagactccagaatgtggaaaaggcgagaaaaaagatcccctagagcctctagagatgaaggtagcctttccaccacctagattttagcccagtgagatccacatcatactctgacatacaggagtgtaataaatttgttttatgccctgacatagtggtagtttgttgtagcagcaatggactagtaatatataaatatatatatacacacacacacacaaacactacccccccacca

SEQ ID NO: 11527 - DNA, 474 bp, Homo sapiens
tttgagatggagtctcactctgttgcccaggctggagtgcactggcacaacctcagctcactgcaaaatccatctctcaggttcaagcgattctcctgccccagcctccctagtagctgggatcacaggcgtgcaccaccatgcctggctaatttttgtatttttaatagagatggggttccaccatgttggccaggctggtcctaaacttctgacctcaggtgatccacccacctcagcctcccaaagtgttgggattacaggcgtgagccaccgtgcctggtcaaatttactttcttgataggtgtcagaaaataaggaaagtctgaagaaaaaaaaattgtctaaaatggctgcatcttggccatatgggtaatagaaaccgggcctatgaacgaaagctgaacctcacctgcaaggccagagtctgtcaaatatcacactgacaggcaccgattacaacctgcctattgg

SEQ ID NO: 11528 - DNA, 1349 bp, Homo sapiens
gtatgacataaattttccttccttttactttcagccttcaaatatttgaattcagtttcttgttcacatttgggtcatgtttgttgctgtttttttgttttgctttgttttttgtaaatttcactctgccatctctgtttttaattagtatatttagagtgcttatatttaatgtaattattgatatcttagggtttatatttgccattttatttttcttttctttttttacctctgtttcttatttctctttttataatcctgctttcctgtggattacttgaatatacttttaaattccattataatttatctatagtgttttatatgtatttctttgtaggctttttttagtagttgttcttcatattacattatagataacttattgccatctattggcatctgatcataccattgtctgtgaagtgaaaaacacttaccttcttgcagattcttttggtcttttttatttagaagataattatcttaaatatttcatctttatatatttagttatataatctttgcttcaaccattaggtatgatttagaaatctcaaaagaagaagaaacctactgtgtttccccatagttaaactcactctgatcttcttttcttcctgatcttccaagatatcctcttttattgttttctttctgtttagagatgtttctttaactgttctcttaggataagtgttttggttacaaatctcagaactcttagggtttttgtttctttcttttttttttttttttagttttgttttaaacgtgaagatttcttgatttccccttcattcttaaaggatattttcatgatagaattctgaatggactgcccccttgcctactttttttttttgctatacttgaacaatattatgccacttatcctggaacttcacagatatttatgagaaatctactctcatttgaattcccatttttctatcattgcctctaagatttttttaatccaataaaaaatacaaagttttagcaaaaacatggtaaattccagcaagaaatagaagatacaaatttgtttttattaggagttattatatatttatggcatgttcatcctgactagggaaatcgcaaatcctcctttaatatccatcagccatcaaaattatttaatatataaaacaaaattatttaagatataaaagagaatcacatggatattttcaaattataaatatgataactgaaataaaaaatctaaaggagggctcaaaagcaaaatgtaggtgatagtgagaagaagcaaagaacttgaaaacataaaaattacccagtatgatcaacagagagaaaataaaccagaaaaaaaccaa

SEQ ID NO: 11529 - DNA, 302 bp, Homo sapiens
tttttttttttttttttttttttgacagagtcttgctctgtcgtccaggctggagtgcagtggcgcgatctcggctcactgcaagctccgccttccgggttcacgccatcctcctgcctcagcctcccgagtagctgggattacaggcgcccgccaccacgcccggctaattttttgtatttttagtagatacagggtttcaccatgttagccaggatggtctcgatctcctgacctcgtgatccacccgccttggcctcccaaagtgctgggattacaggcgtgaaccactgtgcccggcc

SEQ ID NO: 11530 - DNA, 10364 bp, Homo sapiens
cccctactcgcccttccgcatccatgctctgcccactggggatgccagcaagtgcctcgtcacaggtgggtgcccacccgctgcccgtgccctgctcaccacccagcccctcaaagcccctccagaacctggcctggtccccaggggtctgctggtcggagagcacacatgccctagccctggcccctccctccctcacccccgcccaatgccccagcccacgttgagcaccgcctggcctcacactcttctctctttccagtgtccattggaggccatggcctgggtgagtgccctttctctcctcttcttggtgtgggccagggtggttggcggtagggggcgggcagcgggaacagagagggctggctccagcccaccagctccctgagcaggatctcccgcatggcaggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggtaagttctgtagccacagcaagactagatggctggggaggggggcctggcccttttagcagcagcagggatcccagataactgtccccaaggaatcccacttctctgagggctcctggggccagagtgctccaggatggagccttaactttccccacagcacccccgaagtgggaggagagcatggccctgccccctgcccagtgctgtcagctgtctctggaggaacccgctgtgctctccaccatccccagctccatctccccagaggctgccctgcaggaggatgaacacccaaattatcacccagcatttcaggttcctgggccattctctgagtcagcccctaggcctgtgaggctgccacaccctgtgcccccgtgccttgcctccccaggcgtgtgaccccctgccgcacgaggaggagccctctgaagtgccacagctgcgccagccctacgctcctccccggcccggcgcccgccccacacactgggtactgcgcctcccaccaggcgatgtcctcctcctcctccccttccttcatttcttctctctactcctctgcagccagggcggggacatggtctgggggcctcttggggagcaggcaagagttaggctgggcagatggaaccccacttgggcacagcactccttctcttgcagctgacgcacctctcctgccacgctggtttcatgattaactaccttgttctttcctcactctccagcttcagtcatagcatgggtcaaactcctgggccttccccagtcactgactgttccctctcacctgctgcaggccacagaggagccagtggtgcctgtggagccaatggagtccatgctgaggcccttcaacctggtcatccccttcgcggtgcagaaaggggagctcacaggtactgccctgtggctcccaggcatgagggctgaggggagaaaccctcttccaggcccagtcctgtgtcttaatgatgaaaacaaaggcccagagagaggaagtgagctctacccagggtcacacagcaagttgggcagagccagaactcaggtgcaagccatctgtccccagttcagggctcaggccactgccacaggctgtctcttgatgcctggcttctcgggtggcagcagaagcactcaggaccaggcctgggacagcagggaggttgcagtgggggaaaccagggtctccacgtaactgtgtctgccctgcaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctggtgagttaggggctgggctgggctggggcttgggtgagaggagcaggccgtagcttcagtcctgccttccctctttcaacaaatatttattgagcacccgctgtgtgcagacaccaggcgaggccccagggaggcttataccctggtgggaagcagacctccaccagctgggtccctacggcacagacggagggggttggcagggaggctgctggaaggtgctggggccaaggtgggctcagataatccctgatgctgacccagccccctttttctctgtatccccagggagccccttacagttctatgtggatgccatcaacagccgccatgtcagtgcctatgggccaggcctgagccatggcatggtcaacaagccagccaccttcactattgtcaccaaagatgctggagaaggtgagggagctgcaggtcgcaggctggggtggagactcaccaggggcaggggtgagggcaggacctctgatcttggccacacctccacctacagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgaggcgggtgtatgggcatgtacagcccatgaggcacacacaccgcatacagtgcactcatgtgcaagcccagcccgttcaagtcactcgtgacattagggcagaggcccttcaaggtgtgaggggtcatattttgataaatgtaaaaacactctgttctccacggcagctaagaagcagtcagccactccttgtgcctgaaaacacattgcctcatttagtctttgaagtcatttgttttgtttttgtttttgagagggagtcttgctctgtcacccaggctggagtacagtggcacgatctcggctcactgcaacctccgcctcccgggttcatgccattcttctgcctcagcctcccaagtagctgggactccaggcgcccgccaccatgcctggctattttttgtatttttagtagagacagggtttcaccgtgttagccaggatggtctcgatctcctgaccttgtgatccacctgcctcggcctcccaaagtgctgggattacaggtgtgagccaccacgcccagcatgaagtcactcttaagaagttagggcacggataatccttttgatagataaggaacccctgtcccagagaggccaagcaacatgattacagccacacagcgaggaaggggtctgggcggtccagtctagtgttttgttatcacaacatcatgtgactcagggttaaaatgcaggaggtttcctttagggatttagcccacaaggactgaggcagccacagtggaattggggtacaggcccctcttagtctctggcagctcacatgtgagtgcagactgcactttccaggccttgggcctccgtgcacctgggagtggccccccgtgtctgttgagtccagggggggctgctcaggagggttcctgagccctgtgagggcagggcctgcctggagtcatagcagcctgatgccccaactcccccaccaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattggtgagcgtggggcctcacggggacctcaggggtgggggcccacaggatgctctgcctaacacccactttccacagggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggtacctcctgccccagagagcccccattccagcgggtgcctcccacaggcacttgtcctcgtcctgcccagcacccccttggccgcactctctcctccctgaaacttcctgaccagtctgcgtcaggattcgcattctggggccccttgcgggaaagtgaatggccccgcatcagttctctcccttttaagagaaagctcagctgtcctgagtttctgtccctcccttgctcactggaatccaagaggcttaccttagggaattttccagaccgcctgtcccgtggtgcccccgctcctcccactgagccatttttgttagtggtcactacacacatcggtgcccattctgggtggagcctgcagtctggggagaggaaagcattgtggcttggccagcctaggactgagggagatgtgttccttgctttcccccaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggtaaggctctgggcagaggtcggtggcgagagacagggaggccaggaggctggggctctgaggttcctgacccaccctttgtccccacttcaggaagccccttcactgtgaaggtgaccggcgagggccgcatgaaggagagcatcacccggcggagacaggcaccttccatcgccaccatcggcagcacctgtgacctcaacctcaagatcccaggtagaagcctggaggaccctgggtggggcgggtggtgggagagggctggcccgggccagagcccacctgtcgggcctccaccctgcttcctcacccctcgcttccctccctcaccctggctcccttgaccacacaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgagcaccgcacactgggccggccgggtcctcacggcgggatgggagggtgctgcggaccaggcttgatgctggcagactggccccgaaggccagggcaggtctgagcagaggaggaggtttaactgatgggggagggaagggccagggctaggaggaatcccagtgttgccctgacatcccccaaaccctgcaggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccaggtaaggggcaggtggccaggagtggggatgaagtcagggcagccagtgtgaggggcgatgatgctgaagtccactaccttgcctgtccccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgggcgtccacactggcagtggggctgggcctgcctgaccttccagactgggtttctgcccactggccaggcaggagatgcttggggccacagaactcccctccccggagccccctgctcttcctctgccccgtctccctctaccccacaccctcagaaacatgtgtctgcctccagatctgagcgctgaccacagagcctttcctgggataaggccagggtggggaggctcccgccctgccaacctccatcccggaacctgtgctgactggtctctctccccaggtgactatgaggtctccatcaagttcaatgatgagcacatcccagacagcccctttgtggtgcctgtggcctccctctcggatgacgctcgccgtctcactgtcaccagcctccaggtttgtgcccagggtgggggtggagggtttctgctatctgagagatgggcaggagttgaggacagcaggtccatggggccagggatttagcagtgaccttggaagggccagttaggagtcccttctcataaggcacgaggcagggcccttggggacggtgggctcccaccctgggggcttgcccgtgcactcaggcatgccacgcctcgttctgcctttctcagggtgtgtctgcctgtcctactgccacctgccatttcttgttacagtttgttccaccttctgttgtaagaatgctagatgacaacatttataagaatgagagcataaaatctatacaaactaagagtaaaccagtttgcacagagggtgtgagaggctcctctaaagggaatgcctatgggctgcagagcctgggctgcatcctcttcaggccgctgggggcctggcttgctttctcttgctgctgacttctagagatgtggtgtgttcctttcattctgtcacagcggacatgtgcaaggaaggctttcagcaagtcacactgaaacatgcaaaccagggggccaggtgtccaggggacacattgtaaaggagcttctgcataaggcgcacagaatgggcttcaccccacctccttctcccacgcgcctcctggctgcccctcagggtggtcacattggcccatccagagtccttgtgcatctcctcctcccactcctgaactgggctccccgatgcaggctccaatccctcccccagagcccttctgtgcttcttctggtcctccctgttggtccaccttctccaggaagctctcccaggccaggccagtgaaactcagcttcctacctcagagctctctggcacccccagcccacacagcccatcaggcacttgccctccgccctcagcctgcttcacacagagtggggcccttccttcctcagccaggacagggcacatcgtctgtcatctcccacacaccaagcacagctaggatagcaggtgcacacatagggttgcataccggaccctggctcctcctgctcccaggctgggctggcaggcaggggccaggctgggcatggggtggcagcagcctttgggctgggcttacagtgagcaccgtgtggggcttcagagaagactgctccagccccggcctcccaggagtctgagcatcctccgtggcctttgcaggagacggggctcaaggtgaaccagccagcgtcctttgccgtgcagctgaacggtgcccggggcgtgattgatgcccgggtgcacacaccctcgggggctgtggaggagtgctacgtctctgagctggacagtggtgagctggccctgcccctgccaactcccttccgggctggggccttctggggaggggaaggatggaggctaagccaccaaccctttatccacagacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgagtgcctggagctggggaacagggtgacttctgggggtgcttggccactagtctggtgctgctttgctccagaggtaggggccctgcttcctaagccaggagtccccacagaggctgtccagggagctggggcccagtccctcttgggccacaagcccttcctgccctcagccttgctacctctggcccccaggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtgagtgccagtttgggggaggtccacccagcctgcagcccagcccagcctggagggctccggtggccacgcacatctaggccatagtctgcccccagacatcatggtcagtttaccagggctagaggtgggcctggctctacacagtacacgttctgtggagtcgggcatgatcacgtaaaaatgccattcttcctctccatcgtggcccctcactccttcagctctggcctgcgctggctcctcaggctctagcaccactttcttccctcctggcttcccatattcctccgctccaagaagacacagtcggtattgagcaagcttcccctcttgaggctgtctgtaggatgagttgggtgggtgttcctttgtaaagtggctcttaccctgtgagttagcctgagttcccagacaaagcctgcaaggatgagggacgcagcatctgaggccccagccctagggtggagcaccagttggagctggcagctcagggccctggctgggaatgaggctgtgctcctagagtggcccttggaggaatttgagggggagcctcaaatgcaggcagtgagtcccacagggtggcagtgctggccgagggtcccctgcctggggaagaacaggaagcccttctgactaggtttgtgccccctccacccacccctcaggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaggtggcggggggagggcgtctcccggggtgtgagcaagaagccgtcagggagcagggtgtgggtcacagtaggggactccctggtgtgagcctgtccctctgcctccctctccaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgcagagggttggc

SEQ ID NO: 11531 - DNA, 6673 bp, Homo sapiens
cacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattggtgagcgtggggcctcacggggacctcaggggtgggggcccacaggatgctctgcctaacacccactttccacagggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggtacctcctgccccagagagcccccattccagcgggtgcctcccacaggcacttgtcctcgtcctgcccagcacccccttggccgcactctctcctccctgaaacttcctgaccagtctgcgtcaggattcgcattctggggccccttgcgggaaagtgaatggccccgcatcagttctctcccttttaagagaaagctcagctgtcctgagtttctgtccctcccttgctcactggaatccaagaggcttaccttagggaattttccagaccgcctgtcccgtggtgcccccgctcctcccactgagccatttttgttagtggtcactacacacatcggtgcccattctgggtggagcctgcagtctggggagaggaaagcattgtggcttggccagcctaggactgagggagatgtgttccttgctttcccccaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggtaaggctctgggcagaggtcggtggcgagagacagggaggccaggaggctggggctctgaggttcctgacccaccctttgtccccacttcaggaagccccttcactgtgaaggtgaccggcgagggccgcatgaaggagagcatcacccggcggagacaggcaccttccatcgccaccatcggcagcacctgtgacctcaacctcaagatcccaggtagaagcctggaggaccctgggtggggcgggtggtgggagagggctggcccgggccagagcccacctgtcgggcctccaccctgcttcctcacccctcgcttccctccctcaccctggctcccttgaccacacaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgagcaccgcacactgggccggccgggtcctcacggcgggatgggagggtgctgcggaccaggcttgatgctggcagactggccccgaaggccagggcaggtctgagcagaggaggaggtttaactgatgggggagggaagggccagggctaggaggaatcccagtgttgccctgacatcccccaaaccgggcaggtgaggccagctctcaggacatgactgcacaggtgaccagcccatcgggcaaggtggaaaacagcagagatcgtcgaggaaaaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccaggtaaggggcaggtggccaggagtggggatgaagtcagggcagccagtgtgaggggcgatgatgctgaagtccactaccttgcctgtccccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgggcgtccacactggcagtggggctgggcctgcctgaccttccagactgggtttctgcccactggccaggcaggagatgcttggggccacagaactcccctccccggagccccctgctcttcctctgccccgtctccctctaccccacaccctcagaaacatgtgtctgcctccagatctgagcgctgaccacagagcctttcctgggataaggccagggtggggaggctcccgccctgccaacctccatcccggaacctgtgctgactggtctctctccccaggtgactatgaggtctccatcaagttcaatgatgagcacatcccagacagcccctttgtggtgcctgtggcctccctctcggatgacgctcgccgtctcactgtcaccagcctccaggtttgtgcccagggtgggggtggagggtttctgctatctgagagatgggcaggagttgaggacagcaggtccatggggccagggatttagcagtgaccttggaagggccagttaggagtcccttctcataaggcacgaggcagggcccttggggacggtgggctcccaccctgggggcttgcccgtgcactcaggcatgccacgcctcgttctgcctttctcagggtgtgtctgcctgtcctactgccacctgccatttcttgttacagtttgttccaccttctgttgtaagaatgctagatgacaacatttataagaatgagagcataaaatctatacaaactaagagtaaaccagtttgcacagagggtgtgagaggctcctctaaagggaatgcctatgggctgcagagcctgggctgcatcctcttcaggccgctgggggcctggcttgctttctcttgctgctgacttctagtagatgtggtgtgttcctttcattctgtcacagcggacatgtgcaaggaaggctttcagcaagtcacactgaaacatgcaaaccagggggccaggtgtccaggggacacattgtaaaggagcttctgcataaggcgcacagaatgggcttcaccccacctccttctcccacgcgcctcctggctgcccctcagggtggtcacattggcccatccagagtccttgtgcatctcctcctcccactcctgaactgggctccccgatgcaggctccaatccctcccccagagcccttctgtgcttcttctggtcctccctgttggtccaccttctccaggaagctctcccaggccaggccagtgaaactcagcttcctacctcagagctctctggcacccccagcccacacagcccatcaggcacttgccctccgccctcagcctgcttcacacagagtggggcccttccttcctcagccaggacagggcacatcgtctgtcatctcccacacaccaagcacagctaggatagcaggtgcacacatagggttgcataccggaccctggctcctcctgctcccaggctgggctggcaggcaggggccaggctgggcatggggtggcagcagcctttgggctgggcttacagtgagcaccgtgtggggcttcagagaagactgctccagccccggcctcccaggagtctgagcatcctccgtggcctttgcaggagacggggctcaaggtgaaccagccagcgtcctttgccgtgcagctgaacggtgcccggggcgtgattgatgcccgggtgcacacaccctcgggggctgtggaggagtgctacgtctctgagctggacagtggtgagctggccctgcccctgccaactcccttccgggctggggccttctggggaggggaaggatggaggctaagccaccaaccctttatccacagacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgagtgcctggagctggggaacagggtgacttctgggggtgcttggccactagtctggtgctgctttgctccagaggtaggggccctgcttcctaagccaggagtccccacagaggctgtccagggagctggggcccagtccctcttgggccacaagcccttcctgccctcagccttgctacctctggcccccaggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtgagtgccagtttgggggaggtccacccagcctgcagcccagcccagcctggagggctccggtggccacgcacatctaggccatagtctgcccccagacatcatggtcagtttaccagggctagaggtgggcctggctctacacagtacacgttctgtggagtcgggcatgatcacgtaaaaatgccattcttcctctccatcgtggcccctcactccttcagctctggcctgcgctggctcctcaggctctagcaccactttcttccctcctggcttcccatattcctccgctccaagaagacacagtcggtattgagcaagcttcccctcttgaggctgtctgtaggatgagttgggtgggtgttcctttgtaaagtggctcttaccctgtgagttagcctgagttcccagacaaagcctgcaaggatgagggacgcagcatctgaggccccagccctagggtggagcaccagttggagctggcagctcagggccctggctgggaatgaggctgtgctcctagagtggcccttggaggaatttgagggggagcctcaaatgcaggcagtgagtcccacagggtggcagtgctggccgagggtcccctgcctggggaagaacaggaagcccttctgactaggtttgtgccccctccacccacccctcaggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaggtggcggggggagggcgtctcccggggtgtgagcaagaagccgtcagggagcagggtgtgggtcacagtaggggactccctggtgtgagcctgtccctctgcctccctctccaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgcagagggttggc

SEQ ID NO: 11532 - DNA, 10368 bp, Homo sapiens
cccctactcgcccttccgcatccatgctctgcccactggggatgccagcaagtgcctcgtcacaggtgggtgcccacccgctgcccgtgccctgctcaccacccagcccctcaaagcccctccagaaccctggcctggtccccaggggtctgctggtcggagagcacacatgccctagccctggcccctccctccctcacccccgcccaatgccccagcccacgttgagcaccgcctggcctcacactcttctctctttccagtgtccattggaggccatggcctgggtgagtgccctttctctcctcttcttggtgtgggccagggtggttggcggtagggggcgggcagcgggaacagagagggctggctccagcccaccagctccctgagcaggatctcccgcatggcaggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggtaagttctgtagccacagcaagactagatggctggggaggggggcctggcccttttagcagcagcagggatcccagataactgtccccaaggaatcccacttctctgagggctcctggggccagagtgctccaggatggagccttaactttccccacagcacccccgaagtgggaggagagcatggccctgccccctgcccagtgctgtcagctgtctctggaggaacccgctgtgctctccaccatccccagctccatctccccagaggctgccctgcaggaggatgaacacccaaattatcacccagcatttcaggttcctgggccattctctgagtcagcccctaggcctgtgaggctgccacaccctgtgcccccgtgccttgcctccccaggcgtgtgaccccctgccgcacgaggaggagccctctgaagtgccacagctgcgccagccctacgctcctccccggcccggcgcccgccccacacactgggtactgcgcctcccaccaggcgatgtcctcctcctcctccccttccttcatttcttctctctactcctctgcagccagggcggggacatggtctgggggcctcttggggagcaggcaagagttaggctgggcagatggaaccccacttgggcacagcactccttctcttgcagctgacgcacctctcctgccacgctggtttcatgattaactaccttgttctttcctcactctccagcttcagtcatagcatgggtcaaactcctgggccttccccagtcactgactgttccctctcacctgctgcaggccacagaggagccagtggtgcctgtggagccaatggagtccatgctgaggcccttcaacctggtcatccccttcgcggtgcagaaaggggagctcacaggtactgccctgtggctcccaggcatgagggctgaggggagaaaccctcttccaggcccagtcctgtgtcttaatgatgaaaacaaaggcccagagagaggaagtgagctctacccagggtcacacagcaagttgggcagagccagaactcaggtgcaagccatctgtccccagttcagggctcaggccactgccacaggctgtctcttgatgcctggcttctcgggtggcagcagaagcactcaggaccaggcctgggacagcaggggaggttgcagtgggggaaaccagggtctccacgtaactgtgtctgccctgcaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctggtgagttaggggctgggctgggctggggcttgggtgagaggagcaggccgtagcttcagtcctgccttccctctttcaacaaatatttattgagcacccgctgtgtgcagacaccaggcgaggccccagggaggcttataccctggtgggaagcagacctccaccagctgggtccctacggcacagacggagggggttggcagggaggctgctggaaggtgctggggccaaggtgggctcagataatccctgatgctgacccagccccctttttctctgtatccccagggagccccttacagttctatgtggatgccatcaacagccgccatgtcagtgcctatgggccaggcctgagccatggcatggtcaacaagccagccaccttcactattgtcaccaaagatgctggagaaggtgagggagctgcaggtcgcaggctggggtggagactcaccaggggcaggggtgagggcaggacctctgatcttggccacacctccacctacagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgaggcgggtgtatgggcatgtacagcccatgaggcacacacaccgcatacagtgcactcatgtgcaagcccagcccgttcaagtcactcgtgacattagggcagaggcccttcaaggtgtgaggggtcatattttgataaatgtaaaaacactctgttctccacggcagctaagaagcagtcagccactccttgtgcctgaaaacacattgcctcatttagtctttgaagtcatttgttttgtttttgtttttgagagggagtcttgctctgtcacccaggctggagtacagtggcacgatctcggctcactgcaacctccgcctcccgggttcatgccattcttctgcctcagcctcccaagtagctgggactccaggcgcccgccaccatgcctggctattttttgtatttttagtagagacagggtttcaccgtgttagccaggatggtctcgatctcctgaccttgtgatccacctgcctcggcctcccaaagtgctgggattacaggtgtgagccaccacgcccagcatgaagtcactcttaagaagttagggcacggataatccttttgatagataaggaacccctgtcccagagaggccaagcaacatgattacagccacacagcgaggaaggggtctgggcggtccagtctagtgttttgttatcacaacatcatgtgactcagggttaaaatgcaggaggtttcctttagggatttagcccacaaggactgaggcagccacagtggaattggggtacaggcccctcttagtctctggcagctcacatgtgagtgcagactgcactttccaggccttgggcctccgtgcacctgggagtggccccccgtgtctgttgagtccagggggggctgctcaggagggttcctgagccctgtgagggcagggcctgcctggagtcatagcagcctgatgccccaactcccccaccaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattggtgagcgtggggcctcacggggacctcaggggtgggggcccacaggatgctctgcctaacacccactttccacagggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggtacctcctgccccagagagcccccattccagcgggtgcctcccacaggcacttgtcctcgtcctgcccagcacccccttggccgcactctctcctccctgaaacttcctgaccagtctgcgtcaggattcgcattctggggccccttgcgggaaagtgaatggccccgcatcagttctctcccttttaagagaaagctcagctgtcctgagtttctgtccctcccttgctcactggaatccaagaggcttaccttagggaattttccagaccgcctgtcccgtggtgcccccgctcctcccactgagccatttttgttagtggtcactacacacatcggtgcccattctgggtggagcctgcagtctggggagaggaaagcattgtggcttggccagcctaggactgagggagatgtgttccttgctttcccccaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggtaaggctctgggcagaggtcggtggcgagagacagggaggccaggaggctggggctctgaggttcctgacccaccctttgtccccacttcaggaagccccttcactgtgaaggtgaccggcgagggccgcatgaaggagagcatcacccggcggagacaggcaccttccatcgccaccatcggcagcacctgtgacctcaacctcaagatcccaggtagaagcctggaggaccctgggtggggcgggtggtgggagagggctggcccgggccagagcccacctgtcgggcctccaccctgcttcctcacccctcgcttccctccctcaccctggctcccttgaccacacaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgagcaccgcacactgggccggccgggtcctcacggcgggatgggagggtgctgcggaccaggcttgatgctggcagactggccccgaaggccagggcaggtctgagcagaggaggaggtttaactgatgggggagggaagggccagggctaggaggaatcccagtgttgccctgacatcccccaaaccctgcaggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccaggtaaggggcaggtggccaggagtggggatgaagtacagggcagccagtgtgaggggcgatgatgctgaagtccactaccttgcctgtccccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgggcgtccacactggcagtggggctgggcctgcctgaccttccagactgggtttctgcccactggccaggcaggagatgcttggggccacagaactcccctccccggagccccctgctcttcctctgccccgtctccctctaccccacaccctcagaaacatgtgtctgcctccagatctgagcgctgaccacagagcctttcctgggataaggccagggtggggaggctcccgccctgccaacctccatcccggaacctgtgctgactggtctctctccccaggtgactatgaggtctccatcaagttcaatgatgagcacatcccagacagcccctttgtggtgcctgtggcctccctctcggatgacgctcgccgtctcactgtcaccagcctccaggtttgtgcccagggtgggggtggagggtttctgctatctgagagatgggcaggagttgaggacagcaggtccatggggccagggatttagcagtgaccttggaagggccagttaggagtcccttctcataaggcacgaggcagggcccttggggacggtgggctcccaccctgggggcttgcccgtgcactcaggcatgccacgcctcgttctgcctttctcagggtgtgtctgcctgtcctactgccacctgccatttcttgttacagtttgttccaccttctgttgtaagaatgctagatgacaacatttataagaatgagagcataaaatctatacaaactaagagtaaaccagtttgcacagagggtgtgagaggctcctctaaagggaatgcctatgggctgcagagcctgggctgcatcctcttcaggccgctgggggcctggcttgctttctcttgctgctgacttctagagatgtggtgtgttcctttcattctgtcacagcggacatgtgcaaggaaggctttcagcaagtcacactgaaacatgcaaaccagggggccaggtgtccaggggacacattgtaaaggagcttctgcataaggcgcacagaatgggcttcaccccacctccttctcccacgcgcctcctggctgcccctcagggtggtcacattggcccatccagagtccttgtgcatctcctcctcccactcctgaactgggctccccgatgcaggctccaatccctcccccagagcccttctgtgcttcttctggtcctccctgttggtccaccttctccaggaagctctcccaggccaggccagtgaaactcagcttcctacctcagagctctctggcacccccagcccacacagcccatcaggcacttgccctccgccctcagcctgcttcacacagagtggggcccttccttcctcagccaggacagggcacatcgtctgtcatctcccacacaccaagcacagctaggatagcaggtgcacacatagggttgcataccggaccctggctcctcctgctcccaggctgggctggcaggcaggggccaggctgggcatggggtggcagcagcctttgggctgggcttacagtgagcaccgtgtggggcttcagagaagactgctccagccccggcctcccaggagtctgagcatcctccgtggcctttgcaggagacggggctcaaggtgaaccagccagcgtcctttgccgtgcagctgaacggtgcccggggcgtgattgatgcccgggtgcacacaccctcgggggctgtggaggagtgctacgtctctgagctggacagtggtgagctggccctgcccctgccaactcccttccgggctggggccttctggggaggggaaggatggaggctaagccaccaaccctttatccacagacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgagtgcctggagctggggaacagggtgacttctgggggtgcttggccactagtctggtgctgctttgctccagaggtaggggccctgcttcctaagccaggagtccccacagaggctgtccagggagctggggcccagtccctcttgggccacaagcccttcctgccctcagccttgctacctctggcccccaggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtgagtgccagtttgggggaggtccacccagcctgcagcccagcccagcctggagggctccggtggccacgcacatctaggccatagtctgcccccagacatcatggtcagtttaccagggctagaggtgggcctggctctacacagtacacgttctgtggagtcgggcatgatcacgtaaaaatgccattcttcctctccatcgtggcccctcactccttcagctctggcctgcgctggctcctcaggctctagcaccactttcttccctcctggcttcccatattcctccgctccaagaagacacagtcggtattgagcaagcttcccctcttgaggctgtctgtaggatgagttgggtgggtgttcctttgtaaagtggctcttaccctgtgagttagcctgagttcccagacaaagcctgcaaggatgagggacgcagcatctgaggccccagccctagggtggagcaccagttggagctggcagctcagggccctggctgggaatgaggctgtgctcctagagtggcccttggaggaatttgagggggagcctcaaatgcaggcagtgagtcccacagggtggcagtgctggccgagggtcccctgcctggggaagaacaggaagcccttctgactaggtttgtgccccctccacccacccctcaggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaggtggcggggggagggcgtctcccggggtgtgagcaagaagccgtcagggagcagggtgtgggtcacagtaggggactccctggtgtgagcctgtccctctgcctccctctccaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccaggggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgcagagggttggc

SEQ ID NO: 11533 - DNA, 276 bp, Homo sapiens
gagagggagtcttgctctgtcacccaggctggagtacagtggcacgatctcggctcactgcaacctccgcctcccgggttcatgccattcttctgcctcagcctcccaagtagctgggactccaggcgcccgccaccatgcctggctattttttgtatttttagtagagacagggtttcaccgtgttagccaggatggtctcgatctcctgaccttgtgatccacctgcctcggcctcccaaagtgctgggattacaggtgtgagccaccacgccc

SEQ ID NO: 11534 - DNA, 819 bp, Homo sapiens
gaagtaaggcaaaactgagactcatgggtgtggtctttgacagtgaaatcttttagctcttgcaagatcacatagaaaatttcaccaagttctaacatccagcaaaatggagaacatgtactggggacctttgggtttaaccagtgagactgtcttgtttatcctgttgcatttagccttccagcttatggaaaaatacaaaattcaaattctaacactgctggatttatgatatttaaggtttctattatatcagctgcctggatggagcacagaaacagcgtagtacaatatgctatgggtatattcatgaccaaagtttacaatgtggaaggagaatagaaatgcaagaggtcagttggggaattagctgcttgtgttatataactccttaaaagtggaaaatgatcacaagtaaatgtgagtagtgacagttctcttccatttcctttcttcaggtaaggaaaacacacttaatatttttgagtgtctttaaagatcttcctaaccatccaaaagagaagatgtcttatttatgtgtatatgtcgtgttgttgactgatttttttgctttttactcctgatgtgttttgtgggtgagaaggcaagcatgtaactaagatacagaaaagaccaagatgtagtggggcacagtggcttgacgcctataatctcaactactcagaaggctgaggtggaaggattgcttgaggcgaggagtccaggctgcagtgggctatgattgcaccgccacacttgctgcactctacccttgggggacagagtgaagctctgtctcaaaaaaaaaacaaaaaacaa

SEQ ID NO: 11535 - DNA, 819 bp, Homo sapiens
gaagtaaggcaaaactgagactcatgggtgtggtctttgacagtgaaatcttttagctcttgcaagatcacatagaaaatttcaccaagttctaacatccagcaaaatggagaacatgtactggggacctttgggtttaaccagtgagattgtcttgtttatcctgttgcatttagccttccagcttatggaaaaatacaaaattcaaattctaacactgctggatttatgatatttaaggtttctattatatcagctgcctggatggagcacagaaacagcgtagtacaatatgctatgggtatattcatgaccaaagtttacaatgtggaaggagaatagaaatgcaagaggtcagttggggaattagctgcttgtgttatataactccttaaaagtggaaaatgatcacaagtaaatgtgagtagtgacagttctcttccatttcctttcttcaggtaaggaaaacacacttaatatttttgagtgtctttaaagatcttcctaaccatccaaaagagaagatgtcttatttatgtgtatatgtcgtgttgttgactgatttttttgctttttactcctgatgtgttttgtgggtgagaaggcaagcatgtaactaagatacagaaaagaccaagatgtagtggggcacagtggcttgacgcctataatctcaactactcagaaggctgaggtggaaggattgcttgaggcgaggagtccaggctgcagtgggctatgattgcaccgccacacttgctgcactctacccttgggggacagagtgaagctctgtctcaaaaaaaaaacaaaaaacaa

SEQ ID NO: 11536 - DNA, 311 bp, Homo sapiens
gaagggtctactgaaaataggttgctaacattgacaacaaagtattttaagtcattgcagtaaggaattactggaaattgagtagacaaagaaaattaatatgagttccattttgatggttacttagcaagttgaacttatgagagtctttgaaatagttgcagtatgagaattgttctattgaacagcgaaacaacccaatcaggtaatagtttttccagagagtgacttgctataagggacagaagttagagacttagattctttcaaaataaaggattttttttaattgcttgaagaaggatttttgg

SEQ ID NO: 11537 - DNA, 86 bp, Homo sapiens
tttgtttttgttttttgagatggagtctctctctgtcacccaggctggagtgcagtggcgcgatcttgtctcactgcaagctccgc

SEQ ID NO: 11538 - DNA, 86 bp, Homo sapiens; identical to SEQ ID NO: 11537

SEQ ID NO: 11539 - DNA, 6943 bp, Homo sapiens
agggtacttgacatgtccacttggatgtttgataatcatttcaaacttaacatattcaaaacagaactcttaatttctacccacgccctaacctacacaaacactggaaactgtccatctcccaattattcttatctcaataaatgaaatgacaccaccagccatcaaccagggatcctgtacctcaccttccacatccaaactatcaaaagctcctcctgttttatgcccaatcagatatcgagtcatttcacctctttctgtctcctctgctacttctctcagacatgttgcttcaatttctcacctgaactactacattagcctcctacctggctctgctttcattcctgcctccctgcagttcattcttacagagaatctagaaaaagctcttcaaaagcaacaatcagatgtcactctcctactttctaaaaacttttaaagaggacctcttcttctgccagtataacagactttgtactccaaaggatatctctgttgcattttagaactcctaggaagtaatgaaaatatctaagaaaaaaaatacaagtagctaagtgcatatatgtcaacagtaaacaagccagaaaaggcagaattggccatcccttgtgtttgtgtgtgacggtcatgtgggggtgcaaatggggaccgtactgcaactcccagtttaagcctgggattctagaagggagataaaatagcccaggttggtagtaccactaaattccagataaagcaaatgtaatttaggcttctagttttttttcacagattgggatcttgagctttcaaaaaagattatcaaacaaggaaacaaaccaccgtgagtgaaaatcagcaaaactagcgttaatatattaattactccttccccaccaagggctttagatgtttgaagtatcagataagaagaaactagactaccttatataaagaaaaattaacttaaatatagactacaaaaatggtgaatggtgaacaacaatggtctctcacaatcaccaggcacttctgaaaaagagctaaagaaaaccttcagtaataaaaaaaaattatcaaaaaatttagtggataagcttttttgtaatggactaattaatgaactggaaaataaaactaaaatagtttcatgcaatggagcacagacaaagagatggaactataaggaagagaggttaataagtttggagggcagaataagcaagcctaactaaagcctatttagagcgtgaaaggcaacaaaaatatgcagaatggagatgagacaatgtttaaagagattgtggctcagaatttttctttttttttaagtgaagagttttatcttttgtgttttttgtttgtttgttttctttgtttttttttttactgttattatactttaagttttagggtacatgtgcacgacgtgcagcttcgttacatacgtatacatgtgccatgttggtgtgctgcacccattaactcgtcatttagcattaggtatatctcctaatgctatccctcccccctccccccaccccacaacagtccctggtgtgtgttgttccccttcctgtgtccatgtgttctcattgttccattcccacctatgagtgagaacatgcggtgtttggttttttgtccttgtgatagtttgctgagaataatggtttccaacttgatccatgtccctacaaaggacatgaactcatcattttttatggctgcatagtattccatggtgtatatgtgccacattttcttaatccagtctatcattgttggacatttgggttggtaccaagtctttgctattgtgaatagtgctgcaataaacatacgtgtgcatgtgtctttatagcagcatgatttataatcctttgggtatatacccagtaatgggatggctgggtcaaatggtatttctagtcctagatccctgaggaatcaccacactgacttccacaatggttgaactagtttacagtcctaccaacagtgtaaaagtgttcctatttctccacatcctctccagcacctgttgtttcctgactttttaatgatcgccattctaactggtttgagatggtatctccttgtggttttgatttgtattcctctgatggccagtgatgatgagcattttttcgtgtgtcttttggctgcataaatgtcttcttttgagaagtgtctgttcatatcctttgcccacttgttgatggggttgtttgtttttttcttgtaaatttgttggagttcattgtagattctggatattagccctttgtcagatgagtagcttgcaaaacttttctcccgttctgtaggttgcctgttcactctgatggtagtttcttttgctgtgcagaagctctttagtttaattagatcccatttgtcaattttgtcttttgttgccattgcttttggtgtttcagacatgaagtccttgcccatgcctgtgtcctgaatggtaatgcctaagttttcttctagggtttttatggttttaggtctaacatttaagtctttaatccatcttgaattaatttttgtataaggtgtaaggaagggatccagtttcagctttctacatatggctaaccagttttcccagcaccatttattaaatagggaatcctttccccatttcttgtttttgtcaggtttgtcaaagatcagatagttgtagatatgcggcattatttctgaggactctgttctgttccattgatctatatgtctgtcttggtaccagtaccatgctgttttggttactgtagccttgtagtatagtttgaagtcagctagtgtgatgcctccagctttgttcttttggcttaggattgacttggcgatgcgggctcttttttggttccatatgaacttgaaagtagttttttccagttctgtgaagaaagtcattggtagcttgatggggatggcattgaatctataaattaccttgggcagtatggccattttcacaatattgattcttcctacccatgagcatggaatgttcttccatttgtttatatcctcttttatttcactgagcagtggtttgtagttctccttgaagagctccttcatatcccttgtaagttggattcccaggtattttattctctttgaagcaattgtgaatgggagttcactcatgatttggctctctgtttgtctgttattggtgtataagaatgcttgtggattttgtacattgattttgtatcctgagactttgctgaagttgcttatcagcttaaggagattttgtgctgagacagtggggttttctagatatacagtcatgtcatctgcaaagagggacaatttgacttcctcttttcctaattgaataccctttatttccttctcctgcctaattgccctggccagaacttccaacactatgttgaataggagtggtgagaacgggcatccctgtcttgtgccagttttcaaagggaatgcttccagtttttgcccattcagtatgatattggctgtgggtttgtcatagatagctcttattattttgagatacgtcccatcaatccctaatttattgagagtttttagcatgaagcattgttgaattttgtcaaaggccttttctgcatctattgagataatcgtgatttttgtctttggttctgtttatatgttggattacgtttactgatttgtgtatgttgaaccagccttgcatcccagggatgaagcccacttgatcatggtggataagctttttgatgtgctgctggattcagtttgccagtattttcttgaggatttttgcatcaatgttcatcaaggatattggtctaaaattctctttttttgttgtgtctctgccaggctttggtgtcaggatgatgctggcctcataaaatgagttagggaggattccctctttttctgttgattggaatagtttcagaaggaatggtaccagctcctctttgtacctctggtagaattcggctgtgaatccacctggttcctggactttttttggttcgtaagctattgattattgcctcaatttcagctcctgttattggtctattcagagattcaacttgttcctggtttagtcttgggaggatgtatgtgtcgaggaatttatccgtttcttctagattttctagtttatttgcgtagaggtgtttatcatattctctgatggtagtttgtatttctgtgggattggtggtgatatcccctttatgattttttattgcgtctatttgattcttctctcttttcttcttgattagtcttgctagcagtctatcaatgttgttgatcttttcaaaaaaccagctcctggattcattcattttttgaagggttttttgtgtctctatttccttcagttctgctctgatctcggttatttcttgccttctgctagcttttgaatgtgtttgctcttgcttttctagttcttttaattgtgacgttagggtgtcaattttagatctctcctgctttctcttgtgggcatttagtgctataaatttccctctacacactgctttgaatgtgtcccagcgattctggtatgttgtgtctttgtcctcgttgatttcaaagaacatctttatttctgccttcatttcattatttacccagtagtcattcaggagcaggttgttcagtttccatgtagttgagcagttttgagtgagtttcttaatcctgatttctagtttgattgcactgtggtctgagagacagtttgttataatttctgttcttctacatttgctgaggagtgctttacttccaactatgtggtcaattttggagtaggtgtggtgtggtgctgaaaagaatgtatattctgttgatttggggtggagagttctgtagatgtctattaggtccgcttggtgcagagctgagttcaattcctgggtatccttgttaactttctgtctcgttgatctgtctgatgttgacagtgggatgttaaagtctcccattattattgtgtgggagtctaagtctctttgtaggtcactcaggacttgctttatgaatctgggtgctgctgtattgggtgcatatatatttaggatagttagctcttcttgttgaattgatccctttaccattatgtaatggccttctttgtctcttttgatctttgtttgtttaaagtctgttttatcagagactaggattgcaacccctgcctttttttgttttccatttgcttggtagatcttcctccatccctttatttggagcctatgtgtgtctctgcacgtgagatgggtttcctgaatacagcacactgataggtcttgactctttatccaatttgccagtctgtgtcttttaattggagcatttagcccatttacatttaaagttaatattgttatgtgtgaatttgatcctgtcattatgatgttagctggttcttttgctggttagttgatgcagtttcttcctagccttgatggtctttacaatttggtatgtttttgcagtggctggtaccagttgttcctttccatgtttagtgcttcctgcaggagctcttttagggcaggcctggtggtgacaaaatctctcagcatttgcttgtctgtaaagtattttatttctccttcacttatgaagcttagtttggctggatatgagattctgggttgaaaattctttctttaagaatgttgaatattggtccccactcttctggcttgtagagtttctgccgagagatcagctgttagtctgttgggcttccctttgtgggtaacctgacctttctctctggctgcccttaacattttttccttcatttcaactttggtgaatcttgacaattacgtgtcttggagttgctcttctcgaggagtatctttgtggcgttctctgtatttcctgaatctgaatgttggcctgccttgctacattggggaagttctcctggataatatcctgcagagtgttttccaacttggttccattctccccgtcactttcaggtataccagtcagatgtacatttggtcttttcacatagtcccatatttcttgaaggctttgttcgtttctttttattcttttttctctgaacttctcttcttgcttcatttcattcattttgtcttccatcactgataccctttcttccagttgatcgaatcggctactgaggcttctgcattcgacatgtagctctcgtgccttggttttcagctccatcgggtcctttacggacttctctgcattgattattctagttatccgttcgtctaattttttttcaaagcttttaacttctttgccattggttcaaagctcctcctgtagctcagagtagtttgatcatctgaagccttcttctctcaactcagcaaagtcattctccatccagctttgttccattgctggtgaggagctgtgttcctttgaaggaggagaggcactctgatttttagagtttccagtttttctgctctgtttttttcacatctttgtggttttatctacctttggtctttaatgatggtgacttacagatgggtttttggtgtggatgtcctttccgtttgttagttttccttctaacagacaggaccctcagctgcaggtctgttggagtttgctagaggtccactccagaccttgtttgcctgggtatcagcagcggtggctgcagaacagcagatattggtgaaccacagatgctgctgcctgatggttcctctggaagttttgtctcagaggagtacccggctgtgtgaggtgtcagcccgcctctactggggggtgcctcccagttaggctcctcgggggtcagggacccacttaaggaggcagtatgcccgttctcagatctcaagctgtgtgctgggagaaccactactctcttcaaagctgtcagagagggacatttaagtctgcagaggttactgctgtcttt

SEQ ID NO: 11540 - DNA, 1607 bp, Homo sapiens
agggtacttgacatgtccacttggatgtttgataatcatttcaaacttaacatattcaaaacagaactcttaatttctacccacgccctaacctacacaaacactggaaactgtccatctcccaattattcttatctcaataaatgaaatgacaccaccagccatcaaccagggatcctgtacctcaccttccacatccaaactatcaaaagctcctcctgttttatgcccaatcagatatcgagtcatttcacctctttctgtctcctctgctacttctctcagacatgttgcttcaatttctcacctgaactactacattagcctcctacctggctctgctttcattcctgcctccctgcagttcattcttacagagaatctagaaaaagctcttcaaaagcaacaatcagatgtcactctcctactttctaaaaacttttaaagaggacctcttcttctgccagtataacagactttgtactccaaaggatatctctgttgcattttagaactcctaggaagtaatgaaaatatctaagaaaaaaaatacaagtagctaagtgcatatatgtcaacagtaaacaagccagaaaaggcagaattggccatcccttgtgtttgtgtgtgacggtcatgtgggggtgcaaatggggaccgtactgcaactcccagtttaagcctgggattctagaagggagataaaatagcccaggttggtagtaccactaaattccagataaagcaaatgtaatttaggcttctagttttttttcacagattgggatcttgagctttcaaaaaagattatcaaacaaggaaacaaaccaccgtgagtgaaaatcagcaaaactagcgttaatatattaattactccttccccaccaagggctttagatgtttgaagtatcagataagaagaaactagactaccttatataaagaaaaattaacttaaatatagactacaaaaatggtgaatggtgaacaacaatggtctctcacaatcaccaggcacttctgaaaaagagctaaagaaaaccttcagtaataaaaaaaaattatcaaaaaatttagtggataagcttttttgtaatggactaattaatgaactggaaaataaaactaaaatagtttcatgcaatggagcacagacaaagagatggaactataaggaagagaggttaataagtttggagggcagaataagcaagcctaactaaagcctatttagagcgtgaaaggcaacaaaaatatgcagaatggagatgagacaatgtttaaagagattgtggctcagaatttttctttttttttaagtgaagagttttatcttttgtgttttttgtttgtttgttttctttgtttttttttttactgttattatactttaagttttagggtacatgtgcacgacgtcgagcttcgttacatacgtatacatgtgccatgttggtgtgctgcacccattaactcgtcatttagcattaggtatatctcctaatgctatccctcccccctccccccaccccacaacagtccctggtgtgtgttgttccccttcctgtgtccatgtgtctcattgttcattccacctatgagtgaga

SEQ ID NO: 11541 - DNA, 516 bp, Homo sapiens
gacgtacaaaacctaagggagtttaccaccagcagacttacactgaaggaacttgaaagaatatacttcaggctgggtatggtgacacacacctgtaatcccagcattttgggaggtcaagccaggaagattgcttgaggccagttcaagaccagtctgcacaatacagtgagaccctagctctacaaaaataaataaataaattagccaaatgggtggtgtatacctgtagtcctagctactcaggaggctgaggcgggagaatcactagagcacaggagttgaagactgcagtgagccttgatcacaccactgtactccagcttggatgacaaagtacaaccctgtctctaaataaaagaaaaaaaaagcgtatacttcagaaagaagaaaagagatagcaaaaggtctgaaaaatagaaattgtaagcaaagaaattggtaaacatgtaggcaaatctaaacaaatattgctggtttaaaatactgtgtaaaactccctatatatgaggaagg

SEQ ID NO: 11542 - DNA, 1370 bp, Homo sapiens
gcttttgtcggacatctttaaagcatttttctttttatagaatttcacttaatgtccaatactgatttaatgagcttgggtttacacattatctcttgaagaaaacaaatgaacctttgtgttccaaagcaatccatgtttaaagggaaaaaattatgcataactctgcccagcttcacagtaacctttggcaggtgccttaggtcctctgggactcttttccttatctgaaaaatgaaggacttggatcaggtgaatggttcccagctctgcaacttatgtggctcctcagaggcacacaagctcttttccattatttgccaaataatggaggccctgtctttaactgcagtacaactacacaaaatacttgaaactacagtcttcctggtttttggttggaactgaatcagtgcactctagcaacacttatttcttgctgttcgtaggcttcattatgtgtttggttaattttttaaaacaacaataacatattccataataattacagcttaattggcagactgtttcagtctataggatctgcaggaaggaggagtaataaagggatttttgactgagctcttatggaacagagtctctctaggcccctgtcatatctgcccttctgggccctggggaaaagttggcatccccagttgtggtgctctccaggtgccctcaggctgtggtggagggagcttcccattctctccttcagcccactcaattcagaggctaggggctgaaagaagcttctctacaactggctgttcactgggaggttaagggatgaccatccagccaggccttcctcaggacatgggagggcttatgctttaacatgtgtaaatccactgcaataatgactggttcttttaccccataaggttgagaatttacctgtaaacatttttgtctgaagaatttggatgtaagtgagggctgggcctctatcttatctcacttggcttctctcagcacagcaccttgcctgcttgttcttacacatcctagatgcacagtaactatttcctaattattagaaatctattagaatcaattgatttcagctgggcttggtggctccttcctgtaatcccagcactttgggaggccaaggctggaggatcacctgagtccaggagtttaagaccagcctgggcaacatagggagaccctgtctctacaaaaaataaaaaattagccaggcatggtggtgtgcacctgtagtcccagctactcaggaggctgaggcaggaggatctcttgagcctgggaggtcagactacagtgagcaatgattgtgccactgcactccagcctgggtgacagagtaagactctgtctcttaaaaaaaaaaaaaaaaa

SEQ ID NO: 11543 - DNA, 346 bp, Homo sapiens
gacctggattatggctggcattcaataaatagtagctgttaattgatagctaagctagaactctgaagtctaccatggcaacttcttaagtggtctgagaacccagttgtgttctgtggcaaaacacagcttagggatccatacccagccctcctgtcagctgttcaccttccagttcttcagagacatgtgtggcagtgactttggccacatagctggctgtgccctttaaaggcattccttgacacagatatgtggactggtgacgttgctctccagccaggtgttcttcccagcaggctggcctggctgtctcctgcatgcctgtacttgtttgtctccctgc

SEQ ID NO: 11544 - DNA, 1031 bp, Homo sapiens
aggttgcagtgagctgagactatcctattgcacttcagcctgggtgacagtgcgagactccatctcaaaaagaaaaaaaaaagggagcaagttctagtactgggtggatattttattgcaccaatttaggcttctccccagagatttcttaaaacagaaaggcagttgtaataccaagtattgctgtatcaggccacctgctactccaaagccatgaattaacttgttctaagccctcaaggaaagaaaagaggaaacagaggtttattccctatcaagacagtccacttgagaaagttctgtcttggttgtaacttcaggtttctttcttacacaggcattttattaatgcttttacgagttagaagagttgggataatttgccatctggagtttctctgccttgctgatctgagctcagacctgccaatttaccagagataattgataacaccctgtaacagctgagtaagtagattcttctgttttactgcttttaaaaaaagtttaaagttttaaaatagtataaactttaattgggttctttaaattttgttgttgaataatgcaattattatgatattttgtgaatatttgtaaataatgggattctggaataaattaatccccgatgatagaaaagagttaatgaacactttctccatacataacactttagcattcaagaaacataggacttaaatacatatattaaaaatttaggccaggtgcagtggctcacgcctgtaatcccagcactttgggaggctgaggcgggcagatcacctgaggtcaggagtttgagaccagcctagccaacatggtgaaatcccatctcggctaaaaatgcaaaaattagccaggcatggtggcaggtgcctgtaatcccagctactctggaggctgaggcaggagaatcacttgaacctgggaggcagaggttgcagtgagctgagactgtgccactgcactccagtctgggcgacagagaggctctgtctcaaaaaaaaaaaaaaaaaaaaaaaaaattt

SEQ ID NO: 11545 - DNA, 1031 bp, Homo sapiens; identical to SEQ ID NO: 11544

SEQ ID NO: 11546 - DNA, 129 bp, Homo sapiens
ggtgcggtggctcacgcctgtaatcccagcactttgggaagccgaggtgggtggatcacctgaggtcaggagtttaagaccagcctggccaacatggcgaaaccccgtctctactaaaaatacaaaaat

SEQ ID NO: 11547 - DNA, 551 bp, Homo sapiens
tacaatatgtagtatattagaaagcaatgagtgctttggagaaatgtaaggcaggcaagagtaagggctgaagagttgactggtaaagagaatgtttagggaaggcctcagtgagaagttgtgaagaagttgatggaaagagcctgtgggtgtttgggggaagagtgttgtaggcagagaggatagcaaatgcaaagaccttgaggcagaagcatgcctggcttgtttgaaaataggaggaggctagtgaatggagtggagtgagtgaaggggctgtaatcccagcactttgggaggccaaggccaggtggagcacgaggtcaggagatcaagaccatcctggcgaacatggtgaaatcccgtatctactctaaaatacaaaaaattagccaggtgtggtggtgggtgcctgtagtcccagctactcaggaggctgaggcaggggaatcgcttgaacctgggaggcagaggttgctgtgagctgagatcgtgccactgtgctctagcctggcgacagggcaagactctgtctccaaaaaaaaaaaaaaaag

SEQ ID NO: 11548 - DNA, 549 bp, Homo sapiens
tacaatatgtagtatattagaaagcaatgagtgctttggagaaatgtaaggcaggcaagagtaagggctgaagagttgactggtaaagagaatgtttagggaaggcctcagtgagaagttgtgaagaagttgatggaaagagcctgtgggtgtttgggggaagagtgttgtaggcagagaggatagcaaatgcaaagaccttgaggcagaagcatgcctggcttgtttgaaaataggaggaggctagtgaatggagtggagtgagtgaaggggctgtaatcccagcactttgggaggccaaggccaggtggagcacgaggtcaggagatcaagaccatcctggcgaacatggtgaaatcccgtatctactctaaaatacaaaaaattagccaggtgtggtggtgggtgcctgtagtcccagctactcaggaggctgaggcaggggaatcgcttgaacctgggaggcagaggttgctgtgagctgagatcgtgccactgtgctctagcctggcgacagggcaagactctgtctccaaaaaaaaaaaaaaa

SEQ ID NO: 11549 - DNA, 1693 bp, Homo sapiens
tggcctcaggactcatctctgtcttctccaaccccagctggcctccatgtcccctgggggctttctgctgctgaccagcttgggccctactataggttttcttgctgggcttaggagcctgagagaggtagccatttccaaaagaaaagatttctatctcagattatctgggaaagaggctgagtaggtcccttctctgaggaaacaggcagcaggacataggatggggcagtgggaggaaaagggtctgcactatggggtccttgggctgtgcactcctgaccttatcacttcacagttcccaccagatctgacttgacctccgggccatgacccagtccctcccccactctggaaacctctgtgtcccctcctgctcctttcactcccacctgggaggctctgagcaggccagggtccctctctccaggcctgctcctccctttctcctcctgtccccccagccatccccccagccaggctctcccacctctggccccacctcacctcttggccttcttctttccctcgggcgatgggagcctggtttggctgcccagggaagattgtatctgaccacaggagggagggctgagggcactgctgggtgagctgaggcctccttaggttcttgctgtagtctgagttcaagtcatttagaatgagtgacttgaggaagagggagctgggagcccttttcaccagcagggggactggaggagtcgaatggggtggggtcttctcgttttgattagcttctggtggaggtcccaggctttggcgtgctcaagcttggagtggcagggagcaggcctggcttgaccttctttccttcctgctccctctcctcacccctccctgcagctctttcactccgtctctctctctacagatgggacccaggtgagcccgggtgcccactactgcagccccactggcgcaggtaagagtcaaacccgggggagtccatggtagggagtggaagatgaggggtggaaaggctgtaagaacgcgagaagctgaggggttagagaagcagggtcgctggctgatctgccagagagccaggaggtggcggctccagggaggggcgaggagccggggtaagagaggcagctctggatgctggctgggcacagtgctaggaaacacaacaggaaaaggaaacacaggatgcccgtcttgtccttgctgggagcagtgaaacaggaaggaaagtaagaagctaatatttatactgagacccctaccccatgtcaggcaccaggcaaggtgtgttcttgtgtgtggactcggtcctcacaccggctctgcaaggtgggcatggcagcccttgcaggactgctctgctggaggggaagtgttctctcactgtctgcgcctcctccctctgctggcccgagcctcctctgctgctaggctgccctggggaaggactggacttcctgctgctgctttggtttaggacatgcccatggggccaggtctggactagacgcggtctgcccttcctttagtgtagccagtatcaaccaagggcctactgagtgcaagatatacagcctgatgcctaataattccatatagcagggagaaatggaacccaggtatcctccttgcttcagtcctggctgttgaaaagctaacaggcaggttagggaggaagcacacacaaatacaaagcgaaaaaaaa

SEQ ID NO: 11550 - DNA, 595 bp, Homo sapiens
ttttttttttcaggctgaccccaaattagtagtaacagccctcggagagaggcagtgatgggaaaagaggtcccacactcaagccagaactgggaggcaggatgttcatgctctggcttcagttcagctactgacggggtgccagtagatacctttcctctctctaggacacaaagagagctgttcctgggtcttaatctctgtcgctctgcgctcttctgaacttgatggccctcagcacggggccagggagcgggggaaaagcagaactttttccaggaattgctattggaagcagccccgttgccaacacgcatgcacacatgcacacagcttttctggacagaccttatattatggattatcaccacaaaacatccctttggggcctggtagcccacaccacagaattcagggtcattaatttttctcctatccagagagtgcatggtgtccggaatctgtggttaccaggggagcaaggcacagagaacctggctctgctcccaagcatgaatgctgctgaccagcccctgggtagggactggggaggtgggacagaattcccaggaggcaggggactcagcctgacaca

SEQ ID NO: 11551 - DNA, 399 bp, Homo sapiens
aaagccccttgaggggaggtgaattcctgaaagttggtgggaaactggagtacctgccttggtaggaccagaacccatgctagctctgcccctagcagggtgactttggacagggcccttcacctccgagcctcggtttccttatttaggataacaagatagtaatgactaccccccggggccagtggcttgatgtagctgctcatgcacaagtgctgtagatgtaaagattgtggttaggagtggccagcttgggcctggaggctatgatttctgactcctggactggtactttgccacaggcctttccagccctcctcagccccaatccctgaggacagtctgtggctgccccactgggagatgcccagcgttggaattgctgaaggaggcctctcc

SEQ ID NO: 11552 - DNA, 1521 bp, Homo sapiens
aatcccttgagggcctgaataaaataaaagacaaagagagagcaaatttgtactcagcttgagcttggatatccctcaggccctccctcaggccttctcatcagactgagatttaacactattagctctgtcggcctccagcttgcacacggcagactgtgggactttctagcctccataattgcatgagccaatccctcataataaatctgtttctatgtatctatattttgttggttctctctggagaaccctgactaaatacactgtttaagaaaggagtaaaacttgcactgagatgtttagagcagctttattcatagtttatcaaaatgtggaagcaatcaaggtgttctccagtaggggaaggaataaataaactgtggtatctccgtaaaatggaatgttattccacactaaaaagaaatgagctatcaaccatgagaatacatggaggaaccttaaatgcatattactaggcaaagaagccattctgaaaaggctatatactgtgtgattccaacttcatgacattctggaaaaggcaaaactatggagacaataaaaggatcagagatgccaggggttgggaaggagggtaaattaataggtggaacacaggatttttagagcagtgaaactattctgtatgatataacaatggtggatacatatcattattcatttgccttaacccacacaatgtacagtaatgaaagtgtactgttaggtaaactgtggactttagatgatgatgtgtcactgtaggttcatccattggaataaatgcaccactcttgtgtgggatattgatagtgggaagactgcccaattaagaaatctgtactttctactcaattttgctgtacatttaaactgctctaaaaaataaactctgttttagcctgtaaccccagcactttgggaggctgagggggtgtatcacttaaggccaggagttcctgaccagactggccaacatggtgaaaccttgtctctactaaaaatacaaaaattagccgggtgctgtggtgcatgcctgtaataccagctatttaagaggcatgagaatcgcttgaacctgggacgggggttgcagtgagccaagatcctggcactgcacttcagcctgggtgacagagcgagactctgtctcaaaaataaatacataaatacataaataaactctgtttttaaaaatgagcaaaaggccaggcacggtggctcacacttgtaatcctagcactttgggaagccgaggcgggaggatcacttgaggtcaggagttcaagaccagcctggccaacatggcaaaaccccatctttactaaaaatatcaaaattagccaggcatggtggcatatgcctgcagtcccagctacttgggaggctgaggtgggagaatcgcttgaactcgagaggtggagaatgcaatgagctgagatcacaccactgtactccagcctgggcaacagagcaagagtccgtctcaaaacaaacaaacaaacaaaaagagcaaaa

SEQ ID NO: 11553 - DNA, 1570 bp, Homo sapiens
cctctccctctctttccacagtctccctctccctctctttccacggtctccctctgatgccgagcggaagctggactgtactgctgccatctcggctcactgcaacctccctgcctgattctcctgcctcagcctgccgagtgcctgcgattgcaggcgcgcgccgccacgcctgattggttttcgtatttttttggtggagacgggatttcgctgtgttggccgggctggtctccagctcctaaccgcgagtgatccgccagcctcggcctcccgaggtgccgggatggcagacggagtcgcgttcactcagtgctcaatggtgcccaggctggagtgcagtggcgtgatctgggctcgatacaacctccacctcccagctgcctgccttggccccccaaagtgcggagattgcagcctctgcccggccgccaccccgtctgggaagtgaggagcgtctctgcctggccgcccatcgtctgggatgtgaggagcctctctgcctggctgcccagtctgggatgtgaggagcgtctctgcccggccgccccatctgagaagtgaggagaccctctgcctggcaaccgccccgtctgagaagtgaggagcccctccgcccggcagccacaccgtctgagaagtgaggagcccctccgcccggcagccaccccgtctgggaagtgaggagcgtctccgcccagcagccaccccgtccgggagggaggtgggggtcagccccccgcccggccatccacctcgtccggaagggaggtgggggggttaggccccagcccggccagccgccccgtcctggagggaggtgggggggtcagccccccgcctggccagccaccccgtccgggagatgaggggcgcctctgcccggccgcccctactgggaagggaggagcccctctgcccggccaccaccctgtctgggaggtgtactcaacagctcattgagaacgggccatgatgacaatggcggttttgtggaatagaaaggggggaaaggtggggaaaagattgagatatcggatggttgccgtgtctgtgtagaaagaggtagacatgggagacttttcattttgttctatactaagaaaaattcttctgccttgggatcctgttgatctgtgaccttacccccaaccctgtgctctctgaaacatatgctgtgtccactcagggttgaatggattaagggtggtgcaagatgtgctttgttaaacagatgcttgaaggcagcatgctcgttaagagtcatcaccactctctaatctcaagtacccagggacacaaacactgtggaaggccgcagggtcctctgcctaggaaaaccagagacctttgttcacttgtttatctgctgaccttccctccactattgtcctgtgaccctgccaaatccccctctgcgagaaacacccaagaatgatcaatttaaaaaaaaaaaaaaaaaagagcaaaagacttaaacagatacttcacaaaataagatctcaaaatacccccaaaatgtgaagaaaaccctagaattgctaaaataaaaaagtactaacaataccaa

SEQ ID NO: 11554 - DNA, 1426 bp, Homo sapiens
aggcaacattatctgcctttgaaacaccacctccgtggattaccatttggcccaatgggagggtctggataatgcccattatattatcctaattccctgctacctcagaggttgttaaggggcacttctgctgtttccctctgagtgacctctggctgccactctcttgcagatgctccttttcctctcagggatgagtcggagctgggactgggaaaggcagccctcttgtttctgttcaagttggccaggaatgcccaggaatgatgattctgttttgccagcttcttgccgtgaggctggggttgctgtgtttacagcacaaccaaccctaaagtcagtgcaattcactgtggatttattgagcacctgctagtatgtgcgtgtgttgggggtggtatatgaaaatgatggaggcaggtctctgccttaaatgagggagggtgggcaaacagctcccacggtcggcggttgaaccagttcctattctttctcataggaagtgtccataaacattgtcttgtctcatttgcatggttgttgagaggtttgaatgtagtggtaatgaattgagagtgcttctaaaggtattaagctcttgatttatgtaaaactttcttcagtattactaggcaggctgataataaaagctaacatatattgaatgctttctatttgccaggcactgccctaagtgctttctatatattagcttatttaatctttatagcaactttgaagtagattgcttgtgtacccacttaaaagaggattaaaaaaacttgccgaggatggcacagcaggtaagtagcagagccaggcagtctgaacgtttggccaaacactggccactgtaaagatcttgtggaagtcagggagtagaggtggtctctctcccccaagtgaaggcagcagccaggacctaccgtcagagaccagcaaggagcagagaaaggtcaggctggtgcctcagaaagcatcagcatttctgcacaacttaattaaattactgaaaccttttctgagcttggagccatctttcttggagagtaatacaattgaaacagataatttaagccaaggaggaaggacagaattggtgagctcacatatgtagatggacatgtaatgacgtctgactaaaacacagaggaaaaaccttaaagtgaatcatgtttattcaatttccaaacaagtgcaaagacccaggcagcgtgcttcatgtttggactcttgaagaacacacatggaaaaaaaaaaagaaaaaaacctcttcccctctcaacccttttctaagtttttattaagaatatattaatttgagcattaatatgcaatgtatccatctttgtcagttattttccagaaaaatctagctcattttttgaggcaacttctagccaagttgtttcagttgtggagaatt

SEQ ID NO: 11555 - DNA, 111 bp, Homo sapiens
ttacaggcacctgccaccacgcccaggtaatttttggatttttagtagagacggggtttcaccatgttggccaggctggtctggaactcctgacctcaggtgatccaccca

SEQ ID NO: 11556 - DNA, 363 bp, Homo sapiens
cttggataggttatttagcccttctgcttctgttttttgttttgttttgttttgcctaaaacggatataacagtacctaccttttaaggttgttgcaaggattaaataagatattagatgtaaaatgcttacatctgtgcgcagtgactaagcactcaaatgccagttaataataataattctgtgattatcctgaggtttcatgtttctggagtaggattatgaccacaacatttacagaatgaagtcctgcaggatgacaaaacatccctgtccccattgacacagccccaagtcacgggcttgcaaaagaatgtttgccatccctaggaagcctaacacagggcgctgggaaatgcttgc

SEQ ID NO: 11557 - DNA, 11838 bp, Homo sapiens
agcctaggcaacagagcaagactctgtctttaaaaaaaaagaaagaaagttatgtttttattctgtaactgcttctaaatattcttcagtaccccattcaacccgagaaactactgtcacagctgacaggagttattaacctctctaaatttcagggggaaaatgtataaatatgtcatgtatttgataaatagttttccctttttttaatgaaaagattatctgattggattgacctgcctactaatttttgctattaactttttcattcttaggcaataagcaacaaagaccagcatagcatatcatatactttatctcgggcccagactgtggtggttgaatatactcatgacagcaacaccgatatgtttcaggtattacaacatcttaaattttttttcttaagaaacgaaaaagttaaaaatctattgttggtgacttttgctgaggtcagaggattatcagatttttatattgtattttattaaaatatagattgattgctaacccttataaatagaagtcaatctagcatggttgagatgggctccagaataagaattactggtaaatattacataaccattatatgcctcagtttcctcctctgtaaagtgcagataatagactctcccctatgactgttaagaggcttaaatgatctagtacatgtagagtactcagcactgtgccaggcacttagtaaaaacacttagtgaatagtagctattatccaaaaaagaaaacagtaaatactctgcatacatttatgactttttctaccactacctcccaccttcctctctagacaataaacaatccaggcacttgctaactatttgtattatctatgtgaaatcaaacctttttctcagcatgtatttggtcaatgctactcatgcaataaaagtatttttctcttactttttgtaccaatccagtgctgatattttataaactgatagattttaggacagtcagttccaaagatgtaaatagaatccttgatcttctcccttaatattgagctctctgaagcttaggctttttaaaaacaaacttaagtacaacataaattgcctgataatgttgcttttataattattgtcacattgacttccatttttctttattttacaaggcaaataaaagtgaaaagacctggaaatatatttaatttcagtcaatagtgaaatatttctttgaagccactccctctgcccaacccttttaatgagatgagatactgaatttcttttctctagttaatattagaatgtgggcatttattatgttttcctcacttttaccaaaaataaataagatctttaaggaagattaatgtttagatccaagaaaaaccgaacacaaagctttaggatgatttttcacattttgtttcactgacaagcagtgaaaatgaatgagcttagcttttttttaaaatcaagatgctactaggcctgtagtctcagttactcagggggctgaggtgggaggatagcttgaggccagcctgggcaacatagtgagacttcgtctctttaataaaatatagataaatatatatgtgtgtgtgtgtgtgtgtgtgtgtgtgtgtgtgtgtatctccaagatatttggtcacaggctagaattttagcttcagaaagtacgttatatttatttgtttaccgcttatcttttgtagatgaggttaactgaaatcttgtgagttaaagatgatagagttacttgggggcaaaactgaaattaaaccaggcatcctgaattctgaaacaatgtcttcaccatctaatgaaggcccttgaataagttttaacagtttgggttttgtctttttcataaagtagagaattttccccagtatcataaactgattatgccctttctacaggtattatacctttggaaaatccaaacatttctgcatcaaaaagactgtgatgtatcagaaactaccttgataaactagccagtctttgaggaattgtactggaaacattctaggattgtctaccctgtaaactgaacaagaacatttattgttcaagtcatcagatattccaactccaactctatgccttgtttgtcactatgaagtacataagggagacattacaagctgattacatgcctaggtgctgtactgaccctgtaaatcttaagcacattgattgtgttgaagaaggatggagaaaagactttacactggtgccttttcatgtagatctttttatcaggttaagtaggatttttgccagcaaccggtagaaaagcattctagcaaaagagatggcaaagaagcaaagaagtagtacacagtgtggtgaaagattgacgaataagctgttgtagcttgtatacacaaatagcaggaaattcggctggattggtagatgggaggcaaatcttgagtcagtttctaactattatcagaaataataaactacaaattttggataagctataaggaaccattgagttttctcatgagggtaagggagagtaacaaaagagctgtatttttaatgctaataatagcaggggaagaattattaacaatcatattttggcatctgatcacattcatggtggtttttttctctttatagatacttaagtttcttccttctcattgtcattacaaatattgcttcagtgtcttaaatattctcttccaagacccagttgaaatgtcagctctctggaacagtctctttccaaataagtgctacttctgttgattctgaatattagttcaatccttggcctatatcttttagcttttaaagagcctttttatttgggggaatattttttgtttcaaagatctgaggccatttaaggtatctttatttttaagaataaagaaaaggaatatccaatcttatatttgttaactagtttccctctaaaactatccaatctaaataaaaagactttatacttgacagttggacaaaaacactaaagaggtttatctgaaagtgtgccgatatgaggaacttgaggctaaaatatgtaaagaatgacttttaagagtctttatctttgtagagggtcagtattttttctcagtacccacattcttcaattttatggtactactttataacaaatacattcatgaactgataatttccaaatgtttgctttaaagccccgtgacacttgtcacttttgtcatctccccattgatttccttttttctttcaactttcaaaatgaaattaacttatttactagctagtacctctgaagatatttttaaatctctgacacctcactcatccagaactcttatctgggaaccttgtctctctgaaatatccctaagaaccaggaagagtatatatataaaataaatgccacaaagttgatgtagtgaaattccttttctattctccctagaggatcccttaggctctcaccagaaccttttgaaatacttttctctgaaataggttatttgatttctcaacccataacagagtaagagtagccagttaaaagaggggcttgttgctggaaacaagcatgaccaaaaacaaggagtgatagctgacaacctgacagaaaagaaacaagaaaatatatgaagtatacataagacctcaaagcaaggctgtgtaagcccttgacataaggaccagcagccttgtatacctcttgtagcacctgaagacatcactgcatttcagcttaacgtaagtggtatttatagtgtaatgttctgcagtcatcctaaaagatttacttatatatgttcactatattctgttaaataaggtagaatatctctttaaatatctctaaagagaaaaaaactacatgatacacatatttccatccaaaagggttaaaattaaaatctgcagccatctagaaatctcagccgttcctgaattcttcattccctaagggtttcgtatattattgtaagttctcatttaattccatgctctaagtgattacttcatcagagacagtctgactgattagttttcaagagtatagatgcccccagcgttaagtatggtaaacttcaactttagaaatttcagagacctaatgttctctccttattgtgcccttcttgaatggattttccactgtgctctttgaatgggtttataggtatttttttttttccctcagattggccggtcgactgaaagccccattgattttgtagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggtaaaaagctttttttctaaatgatgctttcttttatactagctttcattccaagttacaagttacaagttggaagctcactgctattatttctactaggagaaggctgccaaatggaagacatcagatggacagatggatggcttgaccactaatggtgttcttgtgatgcatccacgcaatgggttcacagaagactccaagcctggaatatggagagaaatatcggtgtgtggaaatgtatttagcctacgtgaaaccagatcggctcagcagagaggaaaaatggtaaatactgaatggtattttcttaattagctacaataaacacataggatgagtagaactgaatgcattacatacattccagaaaactcttaaatctattgccaacacagaatactaagtctatcaaacactgactaccaaattctatactagaggacagtctctttaatatttcgtttagtagccgggcgcggtggctcacacctgtaatcccagcactttggaaggccgaggcagatggatcacctgagatcaggagttcgagaccagcctgagccacatggagaaaccctgtctctactaaaaatacaaaataagccaggcatggtggcgcatgctgtaatcccagctactcgggaggctgaggcaggagaatagcttgaacctggcaggcagaggttgcggtgaccaagattgcgccattgcactccagcctgggcaacaagagcatttagtaactctggaagttcattcttctgtcatatcatgttaatatattttaaaacctaagctttcttaaactaaacagcactccctctgatcttttctgttgccatctgtatatcttaaaccatatttacctcattaaaaatattagacttattgattagccagatgttttaatcataagttgtctttaccataaggctaaaaagaaatatgttaatgtttgatattttatccttgattttcaaacttaacatttttcataactactgtcagtttcttgaatatttagtgaaaatcctaggaaacctcatttcttgagtaaggagtacttaaaaccaaaacacttatgtaaaaatccaaaacagagtggtgaatatgtttttcaactcttgtctcctctaggtggaaattgaaaccaatcagttacaagatggctcgttaattgacctctgtggtgcaacattgttatggcgtactgcagaaggcctttcccacactcctaccgtgaagcatttagaagctttaagacaggaaatcaatgcagcacgacctcagtgccctgtagggttcaacacactagcatttcctagtatgaagaggaaagacgttgtagatgaaaaacaaccatgggtatatctaaactgcggccatgtacatggctatcataactggggaaacaaagaagaacgtgatggaaaagatcgtgaatgtcctatgtgtaggtctgttggtccctatgttcctctgtggcttggatgtgaagctggattttatgtggacgccggccctccaacccatgcgtttagcccgtgtgggcatgtgtgttcagaaaagacaactgcctattggtcccagatcccacttcctcatggtactcatacttttcatgcagcctgtcccttttgtgcacatcagttggctggtgaacaaggctacatcagacttatttttcaaggacctctagactaacagaccattgtcttgcaggactacattataaatttataagctaagtgagttgggttttcgaacctgttgtccacgtcacagtttttctgctctggtcatttgcattaagatgaagaattttttaaaacatttataataaatagtagcaatttctgagcaaaaatctgggaaactcaagcaaaggaatttctgaaagtatcagtcttctgaattctgagttttgaaaatatattttgaggagaaaaagacatagtctaatttgatgccttccttttagtgtttttgaatcacctatcctcagtgctgaaattgttttgtataactgagggtactgttggttcaaactatgttagtttacagtttgttgcaaacattgtaaaatacagcgacatgtatattaacttttttctatttatctttattatagaaaataccttagaatgttcttgatagagtagcatggtaacgatggtgtcacacccttggtgtgaatggtagcttagtgagcaacctagctcaaggatttgcaaagttaggaagaaggacgagagagcctctctccccaccccaatctaaatatggaatttggtaaattagaatactttgtaatttgtaagaccaaattcatactaattacccgcgtgaaaggtgtttgtttttaacaacattgaagataatcaggaaagattttttcttaatgtttctctcgagcgtagtactataacaaaaacttaatgctaagaaacattttatatgctcctttggatatgcaatttaatctagattatctatttttctcccatgataactaatctgtttttagtatcagcagcatttggcaagtttattttttggatataaactgtggttcatctgttcactgtttctagaaaaaaatcattgccataagaaaaagtataaattagcaagaaaggagagtgacttgatttgcttttggaaaaagaaatgcttaattaattattctgtatttggccttattcgggcattaggaaatctagagatctaaagggttgaatgacaatagtgcccccgtttttagcagaccagccttaactctgggtttgaatcctaaggagattgccacagtgagacttaaggaaatgtttggttggcagatgagcaccaatgactgcagcgtggagtgacgcactgcatggtctgtttattctctaattccaatatgtcttttgcttccagaagcaagaaaagtttcttctctcccctccttcccacccttttttcaaaggcaccacaagtatagacagttgcactacatcaaatctttttttgacacttgtagaaaccagtacacttttagattagacagtatcttcttttaatattttgatttgttttcctttagtttgaaaagttgtataatacttaactgactgtagcaaagttttatatgtggtagcatacctttaatttatcctattacaaaactgttctgaattttcttttggtttttaaaaaacaaaacttgttgcttagaagccatgaattattttattttacttcaactgtcgaaacttccttgttttaaaaaatgatcatttgggttcactcaggaaatgcatgtcaggaaacttgtattataagtttattagttgtgatgtatcagtaactgctgttacccctttttcaaagaaatgtaattgattttgaagttttctagattgtcacatgctttgtgactaatgcaagaaagcaagtcctgtgttgtatttgttctagtcatttttattcaggctatatattgtagcttaatttttatttgcaattaatttatttaaactaagtaaatacttttcaaaatacataattgaattcgtctctgtgagttcatttttgcataatcgagaatgagaaaccagaagtgaaaactgtgaacaactctattccacactccaaaaatactcatttgaaatagatgaagagtttgcatttaatgtaacactttaaagtatctggttcttttttaaaagcatctcttactaataaaggaactttgttagtggttgaataattgaggccttttctaagttaagccttgctagggagttggcacctgtaagttgcatgttagactatttaaatagtggcttcgtaaccataaaagttgcacgtccttcccaaagttgcctgcattttcttctaacaggtaaaaacaatctcttctaacagggaaaaacctggctcattttctatcaaattcaagttttaaaaattcaggcaatttaaatgatcagttgggtgtttgctgttcaagcagaactgttattttgtcatggcctaatagaacacttttacttagttgtattaagggaatgtcagtattctggccaaggaggagaaaaagttgtatttaggtcttctaaatgcattctcaagaaagataatctttatggcttaactcttttatcaaagtaatctttatatttaaatgctacttaatttgttcaaggaattaaatttccctttatctaaaatgttagggtaatgaagcaagacatgaagggaagccattcagacatcagagttcttttactaggttatcctcttgcaaccttctttgcttacttccctcatgtaaaagtcttctagtacatgtaaagcagggtaggaataaataataatgtaagtatgtaattacttcttctttttttttttttttttgagacggagtctcactctgtcgccaggctggagtgcagtggcgtgatctcggctcactgcaagctccaccttccgggttcacgccattctcctgcctcagcctcccaagtagctgggataacaagcgcccgccaccatgcccagctagtttttgtatttttagtagagacagggtttcaccatgttggtcaggatgctctcgatctcctgaccttgtgatccgcccactttggcctcccaaagtgctaggattaattacttctaacatttgagtgtcccacttcactcttcccgtctgacccagactgagggcactggtgaaagtccacttattatgtctctaaggttataagctcaacataactctaacactttggcccttcgttgcaatggatcatcttgtgctaccacttctttttttgtttaagacagggtcttgctctgttgccgaggctggactgcagtggtgcaatcacagctcaccacagcctcaacctcccaggctcaagcaattcttccacctctacctcctgagtagctgggactacagatacacaccaccattcctggctaatttttttcattttcagtagagacgccgtctgactagatttcccaggctggtctcaaactcctgctcttaagcaatcctcctgcctcagcctcccaaagtgcttggattacaggtgttgagccaccacaccctgctgtgctaccacactttagagaccactggttaataaacctatgttccattcccttctctgttttctctaagcactgccctatagcaaatcagaacagcaaaactctgcatcactgaactctgttattctgtctgtcacccccactttcagaattactcttatataagtattctttaatgttttatcctcaaattttatctacttttttttttttttttttttttgagacggagtttcattctgtcgcccaggctggagggtagtggtgtgatctcggctcactgcaacctctgcctcccggcttcaagcaattctccctgcctcagcctccccaagtagctaggattacaggtgccggccaccacacctggctaatttttgtatttttagtagagacggggttttgccatgttggctaggctggtctcgaactcctggacccaagtgatccacccacctcggcctcctaaagtgctggatttacaagcgtgagccaccacgcccggcctctgctttcttaaaacagatttttgtatacccactgtgtgccaagccctgtcctaaaccgggtgatatagcaggaaaaaaaaaatccctgccttcatcgtgtttgtattctagtgtacaagatagaaataagcaagaaaaagtaaatatatgtatatatacaatatgatagtgaactgtgctgagggggcaaataaagtagaaagaggagatgcagatgcaaaatgtcatatgctggggcaggaggagaagtgtttgcaatatcaaacaggaaggctagggaaagccccactgggaaggtggtatttgaataaagctctaaaagagctgaagagagaagggagtggccacttagaggggcatttaggcagagagctctacaaggcccttgcaagggccctgaaatagaagcatgtctgggatatttctacaatagcaaagaggcgtgtgatgccaagtggtatgaatcaaggaagagtagcaggtaaggtcaaagaagtaaaacgacagaatttaagtgacagatggggatgacaatagattatggagagccccctgggatttatggctttaattctgaatgagattgggacattggagggttttgagcaggtgagtgacttgatgtgacatatttaataggatctgaatacactgaaggtgggatcagggagaacattgcagtaatcctggagataaatcatggtttggataaggtggtggcagtggaggtggtttgaaaagtgatcagattctgaatgtgttttaaaggcagacctgacagcatttgctagcagatcagctacagggtttgaaagaagagggatcaaggatgactccactcaatcagcctcagcaactggaaggatggaactgccatttgttgaagtagagattataggaagaactgtttaggggatgaggctcactggtggaggaatcaggaactccgtcctgagtgttagactgaggcacctgtcagacgacatttgccaaaggaaggacaactccacttataactactatcaaagttctcaaccattatgatcagtgttctctgtataccccacgctagcttagaaacaaacaaaaaagtatccctcctgatgaatggtgaatttcctttcattgaaatagagagttgggacacgtctcatggttctctctttgctttggcttccctctaaggaaatgaagttttgttttcaactataatcgcttcatttagcgaaagcattctgataaagtttttcttcctcctcgccatatacacctttttccttggctcttgcctttaaaaaaaaaaacaaaaaagagtcttcagttttcctgaatcttaatattttgctgcttcaaatcctttttggcagtggcagagcacaagttgtgctttgcttttaaagtttttgaaaaaatatttgagtgcttatggaaaacagaattcttaaacctataagttcagattttaatgtccagtttccctgaaggaaataggcctgtatttgataattatcaacaaaaaaaagtaataagatcgagttttccaggccgggcgcggtggctcacgcctgtaatcccagcactttgggaggccgaggcaggcggatcacgaggtcaggagatcaagaccacggtgaaaccccgtctctacgaaaaatacacaaagttagccgggcgtagtggcgggcgcctgtagtcccagctacttgggaggctgaggcaggagaatggcgtgaacccgggaggcggagcttgcagtgagccgagatcacgccactgcactccagcctgggcgacagagcaagactccgtctcaaaaaaaaaaaaaaaaaaaaaaaaaaaaggatcgagtttt

SEQ ID NO: 11558 - DNA, 16092 bp, Homo sapiens
gaaaaagaatctcattttgtttcacacactggcacctggtatggagatcaacagttgctcaaaggaattttaaataattataatgtgttaatagataattaattgggaattgattctgcaaggcaaagtcaaacatttgttttataattgtgcagttcttgcaagagatcacctatactttttttcccccatcaggtataatgggtctctcccaaatggcgatagaggaaggaggaaaagtaggtttgctttgtttaaaagacctaaggcaaatggggtgaagcccagcactgtgcatattgcttgtactcctcaggctgcaaaggtaaaaaaaaaaaaaaaaagctacataaattaacttggagaatttgaaagacttttatgtgttgtttgtattctctagcattccccttacatttctatttcagaaattgccttttgtttggattggagaagagactttggagacatggtatttgaagagctgccatatggaaggggaattggacttttaaaaaaaaaatgacaaaccaggatcagtgggtggaaattagaaggaaacactctgtttccttattaaaagaggtgggatgggggacagggctttatctagtacttagaattatgcagctgtctgccctgagaagtgggaagttcccactctgttactagaggggtctccctggactggatgaagaatgtgatgtataatatgtgtattcaggtattagaagcacatttggatgaggtaatttttaaactaagggtctttacttaagattctttgtattggttgtattcatttttggtttataacttcatatatttgagcatagtaccttgcacaaagtagacctcaataattattaagttgaatcaaagctatgaaggcaatatccaactgcatctacaatataacttctcaaccccctagcctatttcatgcttctagcccccttgtattcttctaacaaaatttccagaagctggaccaccatttcaggatacttgggcttttcctagagtgacagacaaggagggggaatttcacatctttatattttctgtgaattcatctgcctccaattttataacactgactttgtgttacaaagaatttaatattgtaatgagcaaataagaaaaattagaaagagttctttgactcctggaagtacctgtatctttagctaagtagccctaggatgtacattaatattataccatctgaagcatatctttgtaaattaaataaacaagagacagaaaaattggcatatgatgtggttttaggttgcagcttcagtgtctgaaggtaattggcttttcagctttgttttatatccagtttgatttgtgaaagaatccttaggccttgactaggactcctctgttactatttgggagccagttggtgcagaaaagggacagtttctttttgctcctttggcgagaaggaatatactaagcaggtggtggaagtaaacctcagattgattgaatctgaggagcttcttacagtagctccccccggagtgctcttgacattttgggtatgccactttttcattgttcagtactttcccacatactacaggacatttataggtccttcacccacaaaatgccatttgagcctgcaaatcctcgtaacagccaaaaaatgcacagcatattttcagatgccccttagactgctaatactacctctggttgaaaaccactatcagggaaaatatttctaatccctgcctctgtaataccatattctgtacttttcttcctattttactctgccatgccctcatgttttcattgttatctctttttcatctttcatctttactaggcaataagaatcttagggatcacagattgactcttggctgggtgcggtagctcacacctataatcccagcacttgagaggccaaggtgggcggatcacttgagctcgggagttcgagaccagcctgggcaacatggtgaaactccatctccaccaaaaatacaaaaaattagccaagcgtggtggcatgccccgaagtcccagctacttggcaggctgaagtgggaggatcacttgagcccgggaggcagaggctgcagtgagctgagatcatgccactgtactgcagcctgagtgacagagtgagaccctgtctcagttaaaaaaaaaaaaaaaaaaaagattgactcctcctctttaaattttggaggaatgtatttgtgaggtcatgatgaaaattaagcatttagtctggcagtcatctgggatgagtagttaaaaccctgcgttctaggccagtgagactcaaacgtaacttgacatagtttttattctcagtcttagagtaggtttaataactaacaaacaaagattacaatttcaaagcacataaaaaccaatgttttaaaatctctttagccactaagaattaattttcaaaatactgagtaattgtttcattgaaaagtgagctgtttaacggggcacagtggcacatgcctgttagtcccagctccttgggaggcagaggcaggaagatcacttgagcacaggagtttaaagctgtagtgtgccattttcctgcctgtaaatagccactgcacttcagcctctgccacatagcgaaacctggtctcttaaacatatatatatgtatatgtgtgtgtgcgtgtgtatatatatatgtatatatatgtttaaaacttgtaaaacaattatatagtatatatgaatacctaaatgtgtagaaagaaatatgtaaaacatgcatgtaaatgatctacactgcattcttgaggttggatacctctgtagagaaaagggaactgggagagacatgtaggcagcctcaattgtatctgtagtttaattccttaaaaaaatcagacgcaggccaggcacaatggctcacgcctgtaatcccagcactttgggaggccgaggtgggtggatcacgaggtcaggagttcgagaccagcctggccaacatggcaaaaccccgtctctactaaaaataaaaaattagccgggcgtggtggcatgcacctgtaatcccagctactcaggaggctgaagcaggagaatcacttgaacctgggaggcggaggttacagtgagccgagatagcaccactgcactgcaacctaggcgacagagcgagactctgtctccaaaaaaaaaaaaaaaaaaatcagaagcaaaagtggcagtattaagctttgataaagctgagtcgttagtataatctcttctatatttggaaatagggtatttctgtattctctttgtatatttggaaatttgacagtcttaaagctgttgttttaaggctttatctattacagattagttgcaaattgaaaccaagtaaaagcttatgatgccaaacttctaattaagaaggattttttcatttagcttctttgctgtatataattattctcttctttgtgtctgttttatgcagcccatttctacttcctttgtgtgatgactagatttttcccctcctttgatattatcttcaactcatatacatagaaaacacttgaaaacaaaactgaaaagttctttttagcaatgtttttagtttgagataaatcagaagtacagtcataagcattacatccctttcctttggtaatgtttaatcattctatgaatgtttcttttgttttttttttttaaatttttttcttttatctcctgggaccaaatcccaaatgcatttttctgtatctcacccagcatatggccaacatttgtcatctgtagagtcacaaaatggttagaaaaccagttaacttggcttatgagtgaactttatagctctctgaatgacttcaaaaataagattcctcttattttgcaagattttcttatcagagcagtactattgttttctgtttttatgtgggatttggttttgattataatttaaaatacttaataagggagtctagtggtttgataaaagaaaattatgggccgggcgcagtggctcacgcctataatcctagcactttgggaggctgaggcaggcggattgccttagctcaggagttcaagaccagcctgggcaacatggtgaaatgccgtctctactaaaaatacaaaaaaaattagccaggcgtggcagcgtgcacctgtagtcccagctgcttgggaggctgaggtaggagaaccacttgaacctgggaggcggcggttgcagtgaaccgagattgcaccactgcactccagcctaggcaacagagcaagactctgtctttaaaaaaaaagaaagaaagttatgtttttattctgtaactgcttctaaatattcttcagtaccccattcaacccgagaaactactgtcacagctgacaggagttattaacctctctaaatttcagggggaaaatgtataaatatgtcatgtatttgataaatagttttccctttttttaatgaaaagattatctgattggattgacctgcctactaatttttgctattaactttttcattcttaggcaataagcaacaaagaccagcatagcatatcatatactttgtctcgggcccagactgtggtggttgaatatactcatgacagcaacacagatatgtttcaggtattacaacatcttaaattttttttcttaagaaacgaaaaagttaaaaatctattgttggtgacttttgctgaggtcagaggattatcagatttttatattgtattttattaaaatatagattgattgctaacccttataaatagaagtcaatctagcatggttgagatgggctccagaataagaattactggtaaatattacataaccattatatgcctcagtttcctcctctgtaaagtgcagataatagactctcccctatgactgttaagaggcttaaatgatctagtacatgtagagtactcagcactgtgccaggcacttagtaaaaacacttagtgaatagtagctattatccaaaaaagaaaacagtaaatactctgcatacatttatgactttttctaccactacctcccaccttcctctctagacaataaacaatccaggcacttgctaactatttgtattatctatgtgaaatcaaacctttttctcagcatgtatttggtcaatgctactcatgcaataaaagtatttttctcttactttttgtaccaatccagtgctgatattttataaactgatagattttaggacagtcagttccaaagatgtaaatagaatccttgatcttctcccttaatattgagctctctgaagcttaggctttttaaaaacaaacttaagtacaacataaattgcctgataatgttgcttttataattattgtcacattgacttccatttttctttattttacaaggcaaataaaagtgaaaagacctggaaatatatttaatttcagtcaatagtgaaatatttctttgaagccactccctctgcccaacccttttaatgagatgagatactgaatttcttttctctagttaatattagaatgtgggcatttattatgttttcctcacttttaccaaaaataaataagatctttaaggaagattaatgtttagatccaagaaaaaccgaacacaaagctttaggatgatttttcacattttgtttcactgacaagcagtgaaaatgaatgagcttagcttttttttaaaatcaagatgctactaggcctgtagtctcagttactcagggggctgaggtgggaggatagcttgaggccagcctgggcaacatagtgagacttcgtctctttaataaaatatagataaatatatatgtgtgtgtgtgtgtgtgtgtgtgtgtgtgtgtgtgtgtgtatctccaagatatttggtcacaggctagaattttagcttcagaaagtacgttatatttatttgtttaccgcttatcttttgtagatgaggttaactgaaatcttgtgagttaaagatgatagagttacttgggggcaaaactgaaattaaaccaggcatcctgaattctgaaacaatgtcttcaccatctaatgaaggcccttgaataagttttaacagtttgggttttgtctttttcataaagtagagaattttccccagtatcataaactgattatgccctttctacaggtattatacctttggaaaatccaaacatttctgcatcaaaaagactgtgatgtatcagaaactaccttgataaactagccagtctttgaggaattgtactggaaacattctaggattgtctaccctgtaaactgaacaagaacatttattgttcaagtcatcagatattccaactccaactctatgccttgtttgtcactatgaagtacataagggagacattacaagctgattacatgcctaggtgctgtactgaccctgtaaatcttaagcacattgattgtgttgaagaaggatggagaaaagactttacactggtgccttttcatgtagatctttttatcaggttaagtaggatttttgccagcaaccggtagaaaagcattctagcaaaagagatggcaaagaagcaaagaagtagtacacagtgtggtgaaagattgacgaataagctgttgtagcttgtatacacaaatagcaggaaattcggctggattggtagatgggaggcaaatcttgagtcagtttctaactattatcagaaataataaactacaaattttggataagctataaggaaccattgagttttctcatgagggtaagggagagtaacaaaagagctgtatttttaatgctaataatagcaggggaagaattattaacaatcatattttggcatctgatcacattcatggtggtttttttctctttatagatacttaagtttcttccttctcattgtcattacaaatattgcttcagtgtcttaaatattctcttccaagacccagttgaaatgtcagctctctggaacagtctctttccaaataagtgctacttctgttgattctgaatattagttcaatccttggcctatatcttttagcttttaaagagcctttttatttgggggaatattttttgtttcaaagatctgaggccatttaaggtatctttatttttaagaataaagaaaaggaatatccaatcttatatttgttaactagtttccctctaaaactatccaatctaaataaaaagactttatacttgacagttggacaaaaacactaaagaggtttatctgaaagtgtgccgatatgaggaacttgaggctaaaatatgtaaagaatgacttttaagagtctttatctttgtagagggtcagtattttttctcagtacccacattcttcaattttatggtactactttataacaaatacattcatgaactgataatttccaaatgtttgctttaaagccccgtgacacttgtcacttttgtcatctccccattgatttccttttttctttcaactttcaaaatgaaattaacttatttactagctagtacctctgaagatatttttaaatctctgacacctcactcatccagaactcttatctgggaaccttgtctctctgaaatatccctaagaaccaggaagagtatatatataaaataaatgccacaaagttgatgtagtgaaattccttttctattctccctagaggatcccttaggctctcaccagaaccttttgaaatacttttctctgaaataggttatttgatttctcaacccataacagagtaagagtagccagttaaaagaggggcttgttgctggaaacaagcatgaccaaaaacaaggagtgatagctgacaacctgacagaaaagaaacaagaaaatatatgaagtatacataagacctcaaagcaaggctgtgtaagcccttgacataaggaccagcagccttgtatacctcttgtagcacctgaagacatcactgcatttcagcttaacgtaagtggtatttatagtgtaatgttctgcagtcatcctaaaagatttacttatatatgttcactatattctgttaaataaggtagaatatctctttaaatatctctaaagagaaaaaacctacatgatacacatatttccatccaaaagggttaaaattaaaatctgcagccatctagaaatctcagccgttcctgaattcttcattccctaagggtttcgtatattattgtaagttctcatttaattccatgctctaagtgattacttcatcagagacagtctgactgattagttttcaagagtatagatgcccccagcgttaagtatggtaaacttcaactttagaaatttcagagacctaatgttctctccttattgtgcccttcttgaatggattttccactgtgctctttgaatgggtttataggtatttttttttttccctcagattggccggtcgactgaaagccccattgattttgtagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggtaaaaagctttttttctaaatgatgctttcttttatactagctttcattccaagttacaagttacaagttggaagctcactgctattatttctactaggagaaggctgccaaatggaagacatcagatggacagatggatggcttgaccactaatggtgttcttgtgatgcatccacgcaatgggttcacagaagactccaagcctggaatatggagagaaatatcggtgtgtggaaatgtatttagcctacgtgaaaccagatcggctcagcagagaggaaaaatggtaaatactgaatggtattttcttaattagctacaataaacacataggatgagtagaactgaatgcattacatacattccagaaaactcttaaatctattgccaacacagaatactaagtctatcaaacactgactaccaaattctatactagaggacagtctctttaatatttcgtttagtagccgggcgcggtggctcacacctgtaatcccagcactttggaaggccgaggcagatggatcacctgagatcaggagttcgagaccagcctgagccacatggagaaaccctgtctctactaaaaatacaaaataagccaggcatggtggcgcatgcctgtaatcccagctactcgggaggctgaggcaggagaatagcttgaacctggcaggcagaggttgcggtgagccaagattgcgccattgcactccagcctgggcaacaagagcattttagtaaactctggaagttcattcttctgtcatatcatgttaatatattttaaaacctaagctttcttaaactaaacagcactccctctgatcttttctgttgccatctgtatatcttaaaccatatttacctcattaaaaatattagacttattgattagccagatgttttaatcataagttgtctttaccataaggctaaaaagaaatatgttaatgtttgatattttatccttgattttcaaacttaacatttttcataactactgtcagtttcttgaatatttagtgaaaatcctaggaaacctcatttcttgagtaaggagtacttaaaaccaaaacacttatgtaaaaatccaaaacagagtggtgaatatgtttttcaactcttgtctcctctaggtggaaattgaaaccaatcagttacaagatggctcgttaattgacctctgtggtgcaacattgttatggcgtactgcagaaggcctttcccacactcctaccgtgaagcatttagaagctttaagacaggaaatcaatgcagcacgacctcagtgccctgtagggttcaacacactagcatttcctagtatgaagaggaaagacgttgtagatgaaaaacaaccatgggtatatctaaactgcggccatgtacatggctatcataactggggaaacaaagaagaacgtgatggaaaagatcgtgaatgtcctatgtgtaggtctgttggtccctatgttcctctgtggcttggatgtgaagctggattttatgtggacgccggccctccaacccatgcgtttagcccgtgtgggcatgtgtgttcagaaaagacaactgcctattggtcccagatcccacttcctcatggtactcatacttttcatgcagcctgtcccttttgtgcacatcagttggctggtgaacaaggctacatcagacttatttttcaaggacctctagactaacagaccattgtcttgcaggactacattataaatttataagctaagtgagttgggttttcgaacctgttgtccacgtcacagtttttctgctctggtcatttgcattaagatgaagaattttttaaaacatttataataaatagtagcaatttctgagcaaaaatctgggaaactcaagcaaaggaatttctgaaagtatcagtcttctgaattctgagttttgaaaatatattttgaggagaaaaagacatagtctaatttgatgccttccttttagtgtttttgaatcacctatcctcagtgctgaaattgttttgtataactgagggtactgttggttcaaactatgttagtttacagtttgttgcaaacattgtaaaatacagcgacatgtatattaacttttttctatttatctttattatagaaaataccttagaatgttcttgatagagtagcatggtaacgatggtgtcacacccttggtgtgaatggtagcttagtgagcaacctagctcaaggatttgcaaagttaggaagaaggacgagagagcctctctccccaccccaatctaaatatggaatttggtaaattagaatactttgtaatttgtaagaccaaattcatactaattacccgcgtgaaaggtgtttgtttttaacaacattgaagataatcaggaaagattttttcttaatgtttctctcgagcgtagtactataacaaaaacttaatgctaagaaacattttatatgctcctttggatatgcaatttaatctagattatctatttttctcccatgataactaatctgtttttagtatcagcagcatttggcaagtttattttttggatataaactgtggttcatctgttcactgtttctagaaaaaaatcattgccataagaaaaagtataaattagcaagaaaggagagtgacttgatttgcttttggaaaaagaaatgcttaattaattattctgtatttggccttattcgggcattaggaaatctagagatctaaagggttgaatgacaatagtgcccccgtttttagcagaccagccttaactctgggtttgaatcctaaggagattgccacagtgagacttaaggaaatgtttggttggcagatgagcaccaatgactgcagcgtggagtgacgcactgcatggtctgtttattctctaattccaatatgtcttttgcttccagaagcaagaaaagtttcttctctcccctccttcccacccttttttcaaaggcaccacaagtatagacagttgcactacatcaaatctttttttgacacttgtagaaaccagtacacttttagattagacagtatcttcttttaatattttgatttgttttcctttagtttgaaaagttgtataatacttaactgactgtagcaaagttttatatgtggtagcatacctttaatttatcctattacaaaactgttctgaattttcttttggtttttaaaaaacaaaacttgttgcttagaagccatgaattattttattttacttcaactgtcgaaacttccttgttttaaaaaatgatcatttgggttcactcaggaaatgcatgtcaggaaacttgtattataagtttattagttgtgatgtatcagtaactgctgttacccctttttcaaagaaatgtaattgattttgaagttttctagattgtcacatgctttgtgactaatgcaagaaagcaagtcctgtgttgtatttgttctagtcatttttattcaggctatatattgtagcttaatttttatttgcaattaatttatttaaactaagtaaatacttttcaaaatacataattgaattcgtctctgtgagttcatttttgcataatcgagaatgagaaaccagaagtgaaaactgtgaacaactctattccacactccaaaaatactcatttgaaatagatgaagagtttgcatttaatgtaacactttaaagtatctggttcttttttaaaagcatctcttactaataaaggaactttgttagtggttgaataattgaggccttttctaagttaagccttgctagggagttggcacctgtaagttgcatgttagactatttaaatagtggcttcgtaaccataaaagttgcacgtccttcccaaagttgcctgcattttcttctaacaggtaaaaacaatctcttctaacagggaaaaacctggctcattttctatcaaattcaagttttaaaaattcaggcaatttaaatgatcagttgggtgtttgctgttcaagcagaactgttattttgtcatggcctaatagaacacttttacttagttgtattaagggaatgtcagtattctggccaaggaggagaaaaagttgtatttaggtcttctaaatgcattctcaagaaagataatctttatggcttaactcttttatcaaagtaatctttatatttaaatgctacttaatttgttcaaggaattaaatttccctttatctaaaatgttagggtaatgaagcaagacatgaagggaagccattcagacatcagagttcttttactaggttatcctcttgcaaccttctttgcttacttccctcatgtaaaagtcttctagtacatgtaaagcagggtaggaataaataataatgtaagtatgtaattacttcttctttttttttttttttgagacggagtctcactctgtcgccaggctggagtgcagtggcgtgatctcggctcactgcaagctccaccttccgggttcacgccattctcctgcctcagcctcccaagtagctgggattacaagcgcccgccaccatgcccagctagtttttgtatttttagtagagacagggtttcaccatgttggtcaggatgctctcgatctcctgaccttgtgatccacccactttggcctcccaaagtgctaggattaattacttctaacatttgagtgtcccacttcactcttcccgtctgacccagactgagggcactggtgaaagtccacttattatgtctctaaggttataagctcaacataactctaacactttggcccttcgttgcaatggatcatcttgtgctaccacttctttttttgtttaagacagggtcttgctctgttgccgaggctggactgcagtggtgcaatcacagctcaccacagcctcaacctcccaggctcaagcaattcttccacctctacctcctgagtagctgggactacagatacacaccaccattcctggctaatttttttcattttcagtagagacgccgtctgactagatttcccaggctggtctcaaactcctgctcttaagcaatcctcctgcctcagcctcccaaagtgcttggattacaggtgttgagccaccacaccctgctgtgctaccacactttagagaccactggttaataaacctatgttccattcccttctctgttttctctaagcactgccctatagcaaatcagaacagcaaaactctgcatcactgaactctgttattctgtctgtcacccccactttcagaattactcttatataagtattctttaatgttttatcctcaaattttatctactttttttttttttttttttttttgagacggagtttcattctgtcgcccaggctggagggtagtggtgtgatctcggctcactgcaacctctgcctcccggcttcaagcaattctccctgcctcagcctccccaagtagctaggattacaggtgccggccaccacacctggctaatttttgtatttttagtagagacggggttttgccatgttggctaggctggtctcgaactcctggacccaagtgatccacccacctcggcctcctaaagtgctggatttacaagcgtgagcaccacgcccggcctctgctttcttaaaacagatttttgtatacccactgtgtgccaagccctgtcctaaaccgggtgatatagcaggaaaaaaaaaatccctgccttcatcgtgtttgtattctagtgtacaagatagaaataagcaagaaaaagtaaatatatgtatatatacaatatgatagtgaactgtgctgagggggcaaataaagtagaaagaggagatgcagatgcaaaatgtcatatgctggggcaggaggagaagtgtttgcaatatcaaacaggaaggctagggaaagccccactgggaaggtggtatttgaataaagctctaaaagagctgaagagagaagggagtggccacttagaggggcatttaggcagagagctctacaaggcccttgcaagggcctgaaatagaagcatgtctgggatatttctacaatagcaaagaggcgtgtgatgccaagtggtatgaatcaaggaagagtagcaggtaaggtcaaagaagtaaaacgacagaatttaagtgacagatggggatgacaatagattatggagagccccctgggatttatggctttaattctgaatgagattgggacattggagggttttgagcaggtgagtgacttgatgtgacatatttaataggatctgaatacactgaaggtgggatcagggagaacattgcagtaatcctggagataaatcatggtttggataaggtggtggcagtggaggtggtttgaaaagtgatcagattctgaatgtgttttaaaggcagacctgacagcatttgctagcagatcagctacagggtttgaaagaagagggatcaaggatgactccactcaatcagcctcagcaactggaaggatggaactgccatttgttgaagtagagattataggaagaactgtttaggggatgaggctcactggtggaggaatcaggaactccgtcctgagtgttagactgaggcacctgtcagacgacatttgccaaaggaaggacaactccacttataactactatcaaagttctcaaccattatgatcagtgttctctgtataccccacgctagcttagaaacaaacaaaaaagtatccctcctgatgaatggtgaatttcctttcattgaaatagagagttgggacacgtctcatggttctctctttgctttggcttccctctaaggaaatgaagttttgttttcaactataatcgcttcatttagcgaaagtattctgataaagtttttcttcctcctcgccatatacacctttttccttggctcttgcctttaaaaaaaaaaaacaaaaaagagtcttcagttttcctgaatcttaatattttgctgcttcaaatcctttttggcagtggcagagcacaagttgtgctttgcttttaaagtttttgaaaaaatatttgagtgcttatggaaaacagaattcttaaacctataagttcagattttaatgtccagtttccctgaaggaaataggcctgtatttgataattatcaacaaaaaaaagtaataagatcgagttttccaggccgggcgcggtggctcacgcctgtaatcccagcactttgggaggccgaggcaggcggatcacgaggtcaggagatcaagaccacggtgaaaccccgtctctacgaaaaatacacaaagttagccgggcgtagtggcgggcgcctgtagtcccagctacttgggaggctgaggcaggagaatggcgtgaacccgggaggcggagcttgcagtgagccgagatcacgccactgcactccagcctgggcgacagagcaagactccgtctcaaaaaaaaaaaaaaaaaaaaaaaaaaaagatcgagtttt

SEQ ID NO: 11559 - DNA, 265 bp, Homo sapiens
gttttatgcagcccatttctacttcctttgtgtgatgactagatttttcccctcctttgatattatcttcaactcatatacatagaaaacacttgaaaacaaaactgaaaagttctttttagcaatgtttttagtttgagataaatcagaagtacagtcataagcattacatccctttcctttggtaatgtttaatcattctatgaatgtttcttttgttttttttttttaaatttttttcttttatctcctgggaccaaatccc

SEQ ID NO: 11560 - DNA, 1477 bp, Homo sapiens
tagtgctgatgaggtgtgacaggggctagcaagaaagaaagaaaaagagttccctaagtaagctcctactgggtgtcctccactcacatggagacagggccctgccttttaggcacttactcttccagtgtctattgcataatatgttcaggaaggatcccagattcaaagatttatagaattagagttaaaagggatagatatcttgtttgaccctgaaaaaattaaggaatatgcttgagatattcaatggcagaggctggaatagattttcccaaatctcctgatgtgaagttctgtgtttgtcaaacatgactgtgtaaaaagattaatttaaacttaatgacatgttgtattcatagaagttctttgggtttctgtggaaacctcctcttgctagcttaagcagaaatgggggatttattggaaggaagctgagatattgcaccaaactgcacaaaattgaatgaagagctgactaagcaaggctgcactgagaaggaaccagggtggtctgggctgtggtagcggcagcagcagcttgcagatctcccagcgctgatgctggctcgactcagacaggtctccactctctgctgtctgtctctggctcagacaggacactttgtgtggctgtttccttccacaaggcctcagtgggagcaagccagcctcccacaggcctctgagacagaccaccccattcctccctctcctgttaacctgcctttatttccttaattgcacttatcaccatgcagaagcctatgtgtttgttcccctgtggagatgtaaaaacactgatgcccaggcctaactcccagagactctgattgaactggtctgggctatggagccgggacatttgcatttttcttacaagctctaatgtgcagccaggattaagaatcattgccttctgcatcaacaggacaaatacaaaatgtgcagcaaaatatatgtttaagtgaatcaagaagacagatctagaaacgattgttaaggaataataatgcattttgtccatcaccacacataagtgatgttgaccagagccctcccagattgagtggtgccaggtgttcggggttgtctcggttaatccttactatggccttgcggggtagggggcagtgtcctcattgtccaaatgagtcactgaggctgagggattcaggctcagtgtatgcccacagttctttggcaaaccccaccactgggccagccaactacacggggattctgatcgggtcctgatgggtgcccatgatgggctgtgcaaaagtggtggtgagatttctccaccttcacggaggtggtacccaggggaggtggacttcagcagcgagaatgggctgggtgcagtggctcacagctgtaatcccagtgctttgggagttcgaggcaggagaattgcatgagctcagttgttcgagaccatgggagaccctgtctctacaaaaaaaaaaaaaaaaaa

SEQ ID NO: 11561 - DNA, 1474 bp, Homo sapiens
aaactgcagtttaaaagtgtttatatcctggatacactaacagcattttgtccaacttgtggagtggagggagtagggaaggggaggatagtgctaatgaactgtgacaggggctagcaagaaagaaagaaaaagagttccctaagtaagctcctactgggtgtcctccactcacatggagacagggccctgccttttaggcacttactcttccagtgtctattgcataatatgttcaggaaggatcccagattcaaagatttatagaattagagttaaaagggatagatatcttgtttgaccctgaaaaaattaaggaatatgcttgagatattcaatggcagaggctggaatagattttcccaaatctcctgatgtgaagttctgtgtttgtcaaacatgactgtgtaaaaagattaatttaaacttaatgacatgttgtattcatagaagttctttgggtttctgtggaaacctcctcttgctagcttaagcagaaatgggggatttattggaaggaagctgagatattgcaccaaactgcacaaaattgaatgaagagctgactaagcaaggctgcactgagaaggaaccagggtggtctgggctgtggtagcggcagcagcagcttgcagatctcccagcgctgatgctggctcgactcagacaggtctccactctctgctgtctgtctctggctcagacaggacactttgtgtggctgtttccttccacaaggcctcagtgggagcaagccagcctcccacaggcctctgagacagaccaccccattcctccctctcctgttaacctgcctttatttccttaattgcacttatcaccatgcagaagcctatgtgtttgttcccctgtggagatgtaaaaacactgatgcccaggcctaactcccagagactctgattgaactggtctgggctatggagccgggacatttgcatttttcttacaagctctaatgtgcagccaggattaagaatcattgccttctgcatcaacaggacaaatacaaaatgtgcagcaaaatatatgtttaagtgaatcaagaagacagatctagaaacgattgttaaggaataataatgcattttgtccatcaccacacataagtgatgttgaccagagccctcccagattgagtggtgccaggtgttcggggttgtctcggttaatccttactatggccttgcggggtagggggcagtgtcctcattgtccaaatgagtcactgaggctgagggattcaggctcagtgtatgcccacagttctttggcaaaccccaccactgggccagccaactacacggggattctgatcgggtcctgatgggtgcccatgatgggctgtgcaaaagtggtggtgagatttctccaccttcacggaggtggtacccaggggaggtggacttcagcagcgagaatgggctgggtgcagtggctcacagctgtaatccca

SEQ ID NO: 11562 - DNA, 5584 bp, Homo sapiens
atcgttatgattggtttgccagcccggggtaaaacctacgtgtccaagaaactaacacgctacctcaactggattggagtccccaccaaaggtaagtgtggctcattccctaggaaagacaattattagttcctgggcctcacaggtctctgggagacttattcttcctggcatcaatgctatagggtgcttttggcagaaatagcagttgctttctggtttactggagttattctctattcccagacttgtctcctcctggcgtgggtggattggcctagttttgagggaatgcctttgataggactgttaagatttagatgagcatagggctgtaccttttcagaagccttacatggacatcatcttatataaccctagcagtgtctctgtgaaatagacagagtggctgaggaaattgaaacctcagacagcttaagacttgtccaaggtctagaaagtcagggcttgaacccaactcttttgactcttaatctgatattgttcccaacctaccatgctgccgcttttttcatccccttggtcactccgacattaggccaagaaacaagtcccatttggtggggccatcatattattttgctgctgaaggatttgggtgtcttctacagtgtttaatcttggggtgtatcggcgtgaagcagtcaagtcctataagtcctacgacttctttcggcatgacaatgaggaggccatgaagatccgcaagtgagtcttgtttaaggcctgatctccaggtcagctctttcttggccgtcatgagacttggtgtgacagggcttggtttcatctcagtaaatatcttaaggggaagttaaatggaagttatctgatgggcaagtgaccttgggcttgggtggtcagaagaacagggctcagggtgattgatacctgtgtgcttgtaggagaagtctaaagagggctaagatctgtgcattggggcaggggcaggaaggggttataggatggtgtgaaaaccctcagtgagaaagttgaaagatctagttagagaaaggttttgaacagtgggaaactaagtgggcagggatgtgacttctgtagccacccgaatgtttgtgtctctgactgtttgagcttagctctccttgctggtttcatttgctcttatggcagacagtgtgctctggtggcgctggaagatgttaaggcgtatctcactgaggagaatggtcagattgcggtaagctttatctgctgcttcttctttctggtccccacccttgcagcagcctggctacccagccccaccttgagtctgccctggtggggttctgtttctctgttcctgctcatttaccttgtgtactttcttcacaggtgtttgatgccaccaatacaacccgggagaggagggacatgattttgaactttgctgaacagaattccttcaaggtaggatctgactccatgttggaggaaaagggatgagtagaggtggggagtcaggctacaggcatggatctctcactctagtgggtgaggacaggatgggatatctgaatctcttctctcagagcattcccccagtccttgagtgttttcattcaggtcctttctcagactgttagcctgtatgtttgaggcccaggggctgtggtaagagctatgaggaggacttgagggccactttcatgaagaaaatcctgggagatgtggtggctgggtggggtagatgagcatgtgctcttaattaacagcctggcatttttgacttgcttatcactgccttctctccatggccaggtattctttgtggaatccgtctgtgatgatcctgatgtcattgctgccaatattctggttggtgacacccctacatatcatctcctcttcaccttttgtgctgtgtgtgttgtggggtgtgtgtgtgtgtgtgtgtgtgtgtgttgttgggaaaggggtcctctttcctaattgaaaagaagaatagacatgtttaacatcacaaagagatcttttctatctgccagagccccatctggtacttctacactcttctcttgggagaggaaactgaggctttaaggaatcaagtaagaattagctgttgaattgaaaccagggtttaggttgtaggattcttggccctgtgctctacgtattatctggatgttgagacctagatgttggaatagatcagccgggcacggtggctcatgcttgtaggctcagcactttgggaggccgaggcaagtggattgcttgaacccagaaggatcaccttagcctgggaggttgaggccacagtgagccgtgattgtgccactgcagtccagtcttggtgacagagtgagaacatgtccagggaggttgaggctgcagtgagccatgattgtgccactgcagtccagtcttggtaacagagtgagaacatgtctcaaaaaagaaaaaaaaaaaagaatagatcagactcttcgtttcaggacttacctacaggaaggttatctccccagcaattgtccaaagttctcgtcagtgttctatacattgagctccttattccctgtggggtcacaatgtaagccagtccccattggatgggttgtgctctgctggaccgagtagatatctgaacatggtcttatgcaggtgctctcccagccgtaggaacttgggatcatctgaggaagagccatctggtcccaagtcaggcactggggtcatgcaccctattctgagtggtaatagggaaacattggagcctgttctgttttctcaggaaagtacataaagggattggggcccaggagcagctttggctgcgtgactgcctctgtccttcagccaagtgcaggcacatgactccccagttgtcttaacttttttggttgccagggtcacaggacggggcggggcggggcggggggtactcaatgagtggagtgccaatgttccagtgaaaggcgacatttatggacttctttttcttttttttagcagtggctatttgtaggaggactgttacgggcagacctctgatgaggcctttactggttcctatgatttcaggaggttaaggtatcaagccctgactatcctgaaaggaacagagagaacgtgatggaggacttcctgaagagaattgaatgctacaaagttacctaccgacctcttgacccagacaactatgacaagtaaggtttaaggccatggtttgaagggcccaaggcaaaggtctcatctgggaaaataacctttctccctgagttctctaacttccttctgataatctagatctacagtgttaacatcatcccagagaaataaggtatggatttgtggcttttatgtggattgcatcttgtacatgaaaaattgaagtggttggttttgttttgttttgagacagggtctcactctgtcacccaggctggagtgcagtggcaaaatcagggcccactgcaactgctgcccccggggctcaggtgatcctcccacctcagcctcctgagtagctgggaccacaggtgtgcgccaccatgcccggctatttttttttttttttagtaaagatagagtttccccatgttggccaggctggtcttgaactcctgagctcaagtaatccacccgcctcggcctcccaaagtgctgggattacaggtatgagtcactgcgcctggctggaagtgttttttatcatcaattttttctctccagtctctagagcatgatttcctcaatctcagtattattggcactttgaactgggtaattctttgttgtaggacctgtcctgtgcattgtaggatgttcagcagcttccctgggctttgcccactagatgccagtaacacctccaacctgtgacaaccaaaatgtctccagacatgtcagaggttccccggggggcacagttatccctggttgagaatcactgctccatatctgaatgggggtgttgtaggataccctttggagatgtgtcatcagtttttaaagtttatatatattatatgatattttacatatattaatgcttgtgtgtatatcatgcatattatagcataacatatatattacatattgcatatttttatatctatctctctctatatataacatgcaaagccctcaagaacatgcctgactcagagaaatgtctgatcaatgccagctgttgttactatggaagcatttgttggcagtatggtgtagactatagattaacttgtcatgtgtgaggtatatgagccataacaaaaccaagtctatgttgaagaaagatggtgtacacatggaaatctgcaagaatgtggcctcatgaaagagcatgcattcagggcagttaacagctctattcacataatacagacctgcagccaagcaaatggcacatttaatgtgcatggcacacttaatacagtggtctgtttaatgttttgagcctttcagttccttcaagtgggtttcccagaatccccttaattcagaggctgaaaaccacctctagatatggcataaaagtattcttcagttggaacaaagtcccacctagaaaaacatacagaagatctacatatatatacatgtgtatgtttgtatatgttatctctggtagtagggtgatgcgtgatttgcatccttccatcattttttctgattttttgatttaaaataagcacttatgactttttttttgagatggagtctctcgctcttgttgcccaggctggagtgcagtggcacgatctcggctcactgcaacctcccccttcctgggttcaagcaattctcctgcctcagcctcctgagtagctgggattacaggcacccgccaccacgcccggctaatttttttatttttagtagagatggggattcaccatgttggccaggctgttctcaaactcctgatctcctgatctacccaccttggcctcccaaagtgctaggattacaggcatgagctaccgcatccagccacacttatgacttttataaagagaacaatctcatgttggcctcaaagcaagcaatgtctgaaagtgtctttgagagaagcatgattaggtagatgcagggagtatatagacatttctgtctgtgcttctgctgcctcttcccttcccctcgttgctcgtcgtgccatattctggccaggtcttaactgcctcaaaaggggcctattcttctcaccaaattttgggcttagcaaaatcttcaggtcacctagtctagcccctgatgggaaggctgaattctgtttatcctatttatctacattacttgtcacactacaggcactgaggaaatggtacaaacttactagaagttcaggaaattgtacttcatcttggttttaaggagtaattaatctcctaccatttggttccataaacgtgggtgtgacagaggaggggaggaagagcagctgtgagcctgcaagtccctgtagaaatccttttccctctgattcttattctcagatcttcttacctagggaattttttttttcctttcctgtcccagggatctttctttcatcaaggtgataaacgtgggccagcgatttttagtcaacagagtccaggactacatc

SEQ ID NO: 11563 - DNA, 4151 bp, Homo sapiens; identical to SEQ ID NO: 8727

SEQ ID NO: 11564 - DNA, 691 bp, Homo sapiens; identical to SEQ ID NO: 8728

SEQ ID NO: 11565 - DNA, 4151 bp, Homo sapiens; identical to SEQ ID NO: 8727

SEQ ID NO: 11566 - DNA, 691 bp, Homo sapiens; identical to SEQ ID NO: 8728

SEQ ID NO: 11567 - DNA, 6135 bp, Homo sapiens
cagttgaaaaacccttagtcactttgacacatctgctctttacactggtattttcttggtttaagtgacgacatactgaaatgactgggtcaaatcaacaaatcagatattgcaaaaccagtatttttccaaaaattgactgtatatataaagtcagccagtgctgacttcgtatttttagatagtaagtgcagaaatataacttcctcttctttctgtctctagtttttactgttgacctatccctatgctcctcaactggacgctagtctcttgtaggaaataaatctctttaagaaagatgaaagaggttggtatgtatgccaggcacttgctagccttatactccctacgtccctaattttgaccttcatataaccacagatttacacagttaaaagctgggaataaggcagcatagcagtcctttttttttttttttttttttttttttgtggcagggtcttaccctattgcccatgctggagtgcagtagcatgatcatagctcactgtaacctcaacctcccaggcttaagtgatccttctacatcagcctcttttttaaaaaaattatttatttatttttgagacaaagttttgctcttgttgcctggggtggagtacaattgtgccatctcagctcaccacaacctctgcctcccaggttcaagtgattatcctgcctcagcctcccgagtacctgagattacagatgcctgccatcacacccagctaatttttgtatttttagtagagatggggtttcgccatgttggccagtctggtcttgaactcctgacctcaggcgatccacctgcttcagcctcccaaagtattgggattacaggcgtgagccactgtgcccagcctcctcggcctcttaagaactggtgtgcaccaccatacccagctaattagaaaaaaaaatttgtagagataaggtctcactatgttgcccaggcttgtttcaaactcctggtctcaagcaatcctcccacttcaacctcctaaagtgctgagattacaggcgtaagccactgccctcagccctcaaagcagtattaaagctagtctagactatattatggtacagaaagaacaagaagttgattgagtcaagcatttgattgatttattgctcgattttatattggcaaccataagggttgctgttaattgttactagtatcaaagtttggaaaattctgcccagttattgttcaatctttgaagactgaggaacaagccatgttcctcttaagcatttaatgacgttcttgcaattttattattttctttcctttaatccttctccaaatatacattttttgcctcttcctttttagccttcatctactccttgcagattgctttgtggcaaggattgcttgtttcaactaggctgtctttcctttggcctaagagtccacaggcaaacctgagctgtgcccacttgctaggcttgctatagggacctgaatttgcaaaggaaggggaacagtagagaataaataatgggagacagtgagcctatggctatgtcttttcagatgccttctgcctggtttgttttagattgccattgcctcagtcccctctgtgggataggccaagacttgtgtgctgtcttgacccatgtggcagctacttaattcccactgtgggtctcagctctcgtgtgctggggcagccaagaagggaggcagttaagaagttagggtgcttagcagtgttctaagtttagcccgctaaggaagcatttcagatagttctgttctccttttttgtgtggaaaataaatagctgtccaagccaggcacggtgcctcacgcctgtaatccctttgggaagctgaggtaggcagatcacgaggtcaggagttcgagatcagcctggccagcgtggtgaaaccccgtcgctactaaaaagacagaaatttggccgggcatggtggggcgtgcctgtaatcccagctacttgggaggctgaggcagaagaattgcttgaacccgggaggtggaggtctttgggcttgtatgttgatggtgatatttgtagagcattaactaagttctagtcactgttctaaaaattttacatctatgcactcatctaatcctcataacatttctggggtttaggctctattattgtcttcatcctacagatgtgggaatcctagagtataaatccttgcctaaacagcaagtacgttttcacaaacccaaataatcttattaaaataattgtttaaataaaagtatattttattgtttttcttgttttttaaaagaaagcttgttggtactactagattattttttgagggcatagtattctcaatatcctccttttatacagcaaaaatattttaaatggatgagatggaatggtagtactagaaagaaaggtaaaaaatttaatgacaaatctcaacacctagaattaaattgctagcttcactggggtttcctaataataaaaactttttttttttttttttaatctcacagcaaactttgaaacaaaaatgggtggagtacagatctctgcagttacaggaacatcgtctgcttcatggtaaatgcaatttcctgttcagaaaccacactaacattacttctttcagtatttctgcctcaaagttggtttaagattatcatcattataagaaaaatttgtctagtgctggtcaaggaaatgggtctgtgtttctttggcatgagctttggaatggctgtatttggaggaggggtaaggcaagtcagatccactactgcgtatcatgacgcagatgcacatgcacacagatgcacatgctcgaaaacaggcacctggagattttagaaaatcattggggaagattgcctaactttccttctacttcagtgaatgaattacatttctgaaaacaatcacggctaaggggctgtatagtttttagaagctattaaagctggaatggttgcacacttattgggtagagctcctgtcttttgtttaaattgcataagttgcatttatgcagagaaattctttttcatggcccccaagacaaagacataaatgcgtaagatgaatacaacagtaaatgcatagctcttgccattgagtgcatttttaagggaagggttgagtttaaaatgtgttaattcgctatttgttgtatgatagatgtaaccaaaggaatgaacttttgtgtacaaataattcactgaaaccactacgtgggtgtgaaatatagcttatctcttctttaaatagcaccaagcttaagtctgtaacctagaatatctgttaaaagtgataatcaatttgtttaccaaaaaagataacaatttaatccttaactagtcactaatttatggcttagagttctggtatgaacttctgtttttttttttttaaattgaagtgtttgaaacttatgtacaagttacttctcttttttatgtcttcatttaatatttttaaaaaattcataatagttcttttgggtagtgaagtttgttagagaggcagaaatatttaatacaaaaacttctttatggccttgtaaattcagccacctccttgctttctttagacatgagggctttttagcctcatttccacttctggagcatcctgaatggcccagtgaatataaattcttgctgttctatagaaacagccttgtatagacaacattgttaggtcaggatcctcataaagtcattgttgtacatattttttgagcaattgaaggagttctgctttttctagatgtatagtaaacatccagggcatgtgattctataaggcaattgctctccaatcaaaagaaattcatcacttattgcaagatgaaatgaagtaggttgtattagcaaaaaggaaagcattatgactagtcaccatggggctggctgtactcaaccttgcaaatcatctgaaagaacagtttctttttatattgtcaaccgaggacaaaagacagcagcagtggagataatcagtacaaaataaaaccattttagagtgtacagtattctattattttttctgaagcatagtcacttactgattacgtttttccaaggctggtattacaagttctctctctctctctctctctctctcacacacacacacacacaagataccaaccaactcagttagtgtggaagcagggagggtcatattggtatgtgattaacattagagtttgaagagccagatgtacgttgttaaggatcaatgaaaaaaatttagccaagcagataaaattcaatttcttcaaataaattattacttacttgaggacaaggatgatttctgggtacagtatcattccagagaatttaagtattccaaaacgaaactgggaatattgaggttggaagatacatttgatctcacaaatcctttctctaagaaacacttttgaattacctgttccataactgttttctatttacttcaaatggttttataataattttagaattatttttaaaagacagtacctaagaatcagagaaactaagtggagaaaatcatgatagtatttccccaagtgtattctatggaaccccatttctgtgagaattttaataaaaggtttcagggttatttaaatttaagaaatgatcattttggaggttcagatgccacactggtagactgtcaattgggctgaactgttctcatatgaaacatcttgtttaaatttattctaatattataatttttgtgaccatggaaccttggtctatgaacaatagttcaggaaaccctactataaggtttatcaaatggtctcataaacagttacttattcaagcacgccaaagctcagtgaaaagtatttttcacccttactctttctcgtgtcattcaaagagaagttttgatgtagtgtatttatttgtagggagtaatgaacagatccatttcacagtagactttgtgctctaggtgatgcagctaattgccccagtttggaaaacatggacttggatgaattgtctttgtttggacccctgcctgggccaggcccagcccttgtggaccggaatcgattatccagtgagagcagctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttatttaaattgttgtgttatagtttatgcttcttaaatcatttttcaacctaaacagccaatttctaagcagacaggaaaactaaataataagttaattaatataacaaagatgcaggttcctgctcattccagtaatgtctttgaaagcaaaactaatatttattttctagattatccctgtgaataattgagaactttttggagtcaagtatgaataaaggtgtggcagaatataataatctggactattttctataggataattgctgggttataaaatcttaggtttgcttatgcccagtagctcctgcggaggcttaataataggcaattttgaatttgttcaaacctgtaatggcttgtaaacaaagatgaccatcagctgtttctcacatctatagtgacaataaagcgggaagtataagatttaataggaggggttaaggttcatgagaaccatggaaagatgtggtctgagatgggtgctgcaaagatcataataaagtcatttttatagacagtctaaacaaaatgggtggggatgtcgtgttttttgcccaattcagcttttgttctgc

SEQ ID NO: 11568 - DNA, 6487 bp, Homo sapiens
cagttgaaaaacccttagtcactttgacacatctgctctttacactggtattttcttggtttaagtgacgacatactgaaatgactgggtcaaatcaacaaatcagatattgcaaaaccagtatttttccaaaaattgactgtatatataaagtcagccagtgctgacttcgtatttttagatagtaagtgcagaaatataacttcctcttctttctgtctctagtttttactgttgacctatccctatgctcctcaactggacgctagtctcttgtaggaaataaatctctttaagaaagatgaaagaggttggtatgtatgccaggcacttgctagccttatactccctacgtccctaattttgaccttcatataaccacagatttacacagttaaaagctgggaataaggcagcatagcagtcctttttttttttttttttttttttttgtggcagggtcttaccctattgcccatgctggagtgcagtagcatgatcatagctcactgtaacctcaacctcccaggcttaagtgatccttctacatcagcctcttttttaaaaaaattatttatttatttttgagacaaagttttgctcttgttgcctggggtggagtacaattgtgccatctcagctcaccacaacctctgcctcccaggttcaagtgattatcctgcctcagcctcccgagtacctgagattacagatgcctgccatcacacccagctaatttttgtatttttagtagagatggggtttcgccatgttggccagtctggtcttgaactcctgacctcaggcgatccacctgcttcagcctcccaaagtattgggattacaggcgtgagccactgtgcccagcctcctcggcctcttaagaactggtgtgcaccaccatacccagctaattagaaaaaaaaatttgtagagataaggtctcactatgttgcccaggcttgtttcaaactcctggtctcaagcaatcctcccacttcaacctcctaaagtgctgagattacaggcgtaagccactgccctcagccctcaaagcagtattaaagctagtctagactatattatggtacagaaagaacaagaagttgattgagtcaagcatttgattgatttattgctcgattttatattggcaaccataagggttgctgttaattgttactagtatcaaagtttggaaaattctgcccagttattgttcaatctttgaagactgaggaacaagccatgttcctcttaagcatttaatgacgttcttgcaattttattattttctttcctttaatccttctccaaatatacattttttgcctcttcctttttagccttcatctactccttgcagattgctttgtggcaaggattgcttgtttcaactaggctgtctttcctttggcctaagagtccacaggcaaacctgagctgtgcccacttgctaggcttgctatagggacctgaatttgcaaaggaaggggaacagtagagaataaataatgggagacagtgagcctatggctatgtcttttcagatgccttctgcctggtttgttttagattgccattgcctcagtcccctctgtgggataggccaagacttgtgtgctgtcttgacccatgtggcagctacttaattcccactgtgggtctcagctctcgtgtgctggggcagccaagaagggaggcagttaagaagttagggtgcttagcagtgttctaagtttagcccgctaaggaagcatttcagatagttctgttctccttttttgtgtggaaaataaatagctgtccaagccaggcacggtgcctcacgcctgtaatccctttgggaagctgaggtaggcagatcacgaggtcaggagttcgagatcagcctggccagcgtggtgaaaccccgtcgctactaaaaagacagaaatttggccgggcatggtggggcgtgcctgtaatcccagctacttgggaggctgaggcagaagaattgcttgaacccgggaggtggaggtctttgggcttgtatgttgatggtgatatttgtagagcattaactaagttctagtcactgttctaaaaattttacatctatgcactcatctaatcctcataacatttctggggtttaggctctattattgtcttcatcctacagatgtgggaatcctagagtataaatccttgcctaaacagcaagtacgttttcacaaacccaaataatcttattaaaataattgtttaaataaaagtatattttattgtttttcttgttttttaaaagaaagcttgttggtactactagattattttttgagggcatagtattctcaatatcctccttttatacagcaaaaatattttaaatggatgagatggaatggtagtactagaaagaaaggtaaaaaatttaatgacaaatctcaacacctagaattaaattgctagcttcactggggtttcctaataataaaaacttttttttttttttttttaatctcacagcaaactttgaaacaaaaatgggtggagtacagatctctgcagttacaggaacatcgtctgcttcatggtaaatgcaatttcctgttcagaaaccacactaacattacttctttcagtatttctgcctcaaagttggtttaagattatcatcattataagaaaaatttgtctagtgctggtcaaggaaatgggtctgtgtttctttggcatgagctttggaatggctgtatttggaggaggggtaaggcaagtcagatccactactgcgtatcatgacgcagatgcacatgcacacagatgcacatgctcgaaaacaggcacctggagattttagaaaatcattggggaagattgcctaactttccttctacttcagtgaatgaattacatttctgaaaacaatcacggctaaggggctgtatagtttttagaagctattaaagctggaatggttgcacacttattgggtagagctcctgtcttttgtttaaattgcataagttgcatttatgcagagaaattctttttcatggcccccaagacaaagacataaatgcgtaagatgaatacaacagtaaatgcatagctcttgccattgagtgcatttttaagggaagggttgagtttaaaatgtgttaattcgctatttgttgtatgatagatgtaaccaaaggaatgaacttttgtgtacaaataattcactgaaaccactacgtgggtgtgaaatatagcttatctcttctttaaatagcaccaagcttaagtctgtaacctagaatatctgttaaaagtgataatcaatttgtttaccaaaaaagataacaatttaatccttaactagtcactaatttatggcttagagttctggtatgaacttctgtttttttttttttaaattgaagtgtttgaaacttatgtacaagttacttctcttttttatgtcttcatttaatatttttaaaaaattcataatagttcttttgggtagtgaagtttgttagagaggcagaaatatttaatacaaaaacttctttatggccttgtaaattcagccacctccttgctttctttagacatgagggctttttagcctcatttccacttctggagcatcctgaatggcccagtgaatataaattcttgctgttctatagaaacagccttgtatagacaacattgttaggtcaggatcctcataaagtcattgttgtacatattttttgagcaattgaaggagttctgctttttctagatgtatagtaaacatccagggcatgtgattctataaggcaattgctctccaatcaaaagaaattcatcacttattgcaagatgaaatgaagtaggttgtattagcaaaaaggaaagcattatgactagtcaccatggggctggctgtactcaaccttgcaaatcatctgaaagaacagtttctttttatattgtcaaccgaggacaaaagacagcagcagtggagataatcagtacaaaataaaaccattttagagtgtacagtattctattattttttctgaagcatagtcacttactgattacgtttttccaaggctggtattacaagttctctctctctctctctctctctctcacacacacacacacacaagataccaaccaactcagttagtgtggaagcagggagggtcatattggtatgtgattaacattagagtttgaagagccagatgtacgttgttaaggatcaatgaaaaaaatttagccaagcagataaaattcaatttcttcaaataaattattacttacttgaggacaaggatgatttctgggtacagtatcattccagagaatttaagtattccaaaacgaaactgggaatattgaggttggaagatacatttgatttcacaaatcctttctctaagaaacacttttgaattacctgttccataactgttttctatttacttcaaatggttttataataattttagaattatttttaaaagacagtacctaagaatcagagaaactaagtggagaaaatcatgatagtatttccccaagtgtattctatggaaccccatttctgtgagaattttaataaaaggtttcagggttatttaaatttaagaaatgatcattttggaggttcagatgccacactggtagactgtcaattgggctgaactgttctcatatgaaacatcttgtttaaatttattctaatattataatttttgtgaccatggaaccttggtctatgaacaatagttcaggaaaccctactataaggtttatcaaatggtctcataaacagttacttattcaagcacgccaaagctcagtgaaaagtatttttcacccttactctttctcgtgtcattcaaagagaagttttgatgtagtgtatttatttgtagggagtaatgaacagatccatttcacagtagactttgtgctctaggtgatgcagctaattgccccagtttggaaaacatggacttggatgaattgtctttgtttggacccctgcctgggccaggcccagcccttgtggaccggaatcgattatccagtgagagcagctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttatttaaattgttgtgttatagtttatgcttcttaaatcatttttcaacctaaacagccaatttctaagcagacaggaaaactaaataataagttaattaatataacaaagatgcaggttcctgctcattccagtaatgtctttgaaagcaaaactaatatttattttctagattatccctgtgaataattgagaactttttggagtcaagtatgaataaaggtgtggcagaatataataatctggactattttctataggataattgctgggttataaaatcttaggtttgcttatgcccagtagctcctgcggaggcttaataataggcaattttgaatttgttcaaacctgtaatggcttgtaaacaaagatgaccatcagctgtttctcacatctatagtgacaataaagcgggaagtataagatttaataggaggggttaaggttcatgagaaccatggaaagatgtggtctgagatgggtgctgcaaagatcataataaagtcatttttatagacagtctaaacaaaatgggtggggatgtcatgttttttgcccaattcagcttttgttctgcctgaacattaatggcaagtctagaactctccgaatcctacagctttgtaattttttttctacaaatgtctaacatccaaaactgagggttgggaaaaggacttccctcctgtagtttttttcatattacttctcactttatatcttatattctaaatagctatcacctcagcagtcttttgcctattggttatgttagtatcacattacttctagcctttcaattactccatgttttatttaatatccattgaagtctatgaattctctgttctggtggcacagctattcataacctatattctagagtagacaatctggactatgtaataaatagtctgctgattttaagt

SEQ ID NO: 11569 - DNA, 139 bp, Homo sapiens
tttttttttttttgagacagagtttcgcccttgtcacccaggctggagtgcagtggcatgatctcggctcactgcaacctccacctcccgggttcaagggattctcctgcctcagcctcctgagtagctgggattacag

SEQ ID NO: 11570 - DNA, 139 bp, Homo sapiens; identical to SEQ ID NO: 11569

SEQ ID NO: 11571 - DNA, 2399 bp, Homo sapiens
ccctgctgagaatggatttgtttgtgttctataccttggtgtcatgaagtccgataattaatgtaaaattctcaatttcccgcctagcccaaaataagtactcagcaatgttggttgactgtgtcctatttaataatatttttatggcaccatgctccattaaactcagaacaatttgtagaagtcttctaatttatcttcgactatagattccagaactctttgacttacatttgactaagtaaaaagatgtctttctgcctctagaagacagtttttcctagaaacattgattctgatgcctaattttctttacccattaattcatggacttatttttattgtttttcacacatcctcacaatctttgccaggaacatggtgagcaggaatacttacctttcagggcagggagaaaggtcagagcctcaggtggcctctgagtgacctcagtgctagagctgtccacctgtttatactcctggctatcacacctttatcccatcacagaagcttacaaaaggagtaattattagagtttgctttgtaaagcctaattttggatttccatttaataattaaagctggttttagggaagcccctaaaccaacctgagttttcttgaaatactaacttgtgtcttgctgttatctgagtcacacttttatcctaatttttagatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtaggtagcctgggccctccaagctgcttttccagtttgactgatcagtagaacttttaggcctctagagatgaatctggaagagtaaaggtaagttatccttgctaatatgttctccgtgtagattagctacagacatctttgtgtaattgaagagctttgttccttatttattgtatctcacttaaattaccttcaaactttagctttcactttctgtaaaaaaagataagggaggtttacaaagaacacttaagacttctggtcccttttaggacttcagtggggatgtttctcttggaaagtggtaggttttttctaaatgcagtagatcagaagttctaaactgagttcgtggcccccgtggggtcctggtagtttattcatggcacatcctaggccaaaggaaacacctaatggtatttccgtttacaaagtaagtcagtctaaacaacaagtacatatgtcctaacaacttagtaggtgtttgaaaaaataataacacataaatggaaagaataatattttatttaattcttaagtaaccacaatgactggtaggaggtatgtgcctgttaggtattgcataacttctcaaacttggaatcaggttggacattacaaccctcacttcctgtccacatttatcttcttatggtacttgctttttctcacagcaaccgctgaagacccagcttcgcaaagataataccttactgaaaggagtatagaatgatctattattgaatgccaactaccacaagctactagttagtgcagtgtctggcagatgttgtttttccttcaaaaatttaaaatgtcctggcagccgggtgtggtggctcacgcctgtaaatcctagcactttgggaggccgaggcgggcagatcacgaggtccagagatcgagaccatcctggccaacatgacgaaaccccgtctttactaaaatacaaaaattagctgggcatggtggcacgtgcctgtagtcccagctattcgggaggctaaggcaggagaatcgcttgaacctgggaggcggaggttggagtgagccgaggtggcgccactgcactccagtctggcgacagagcgagactccgtctcaaaaaaaaaagtcctgacagctgcaagcctttgccaccctgtggtgtctcagtgcagtttgggaaccatagaaaataacaatgtacttttgtaacaacgtgttatttttccttttttaaaaaaactttatggccaggcgtggtggctcacacctgtaatcccagcactttggggggcgaggcgggcaaatcacttgagctcaggaattcgtgaccagcctgggcaacatggtggaattctgtctctacaagaaatacagaaattagccgggtgtggtgaggcatgtgtctgtagtcccaggtacttgggaggctgaggtgggaggatggcttgagcccaggaggtggaggttgcagtgagctgagatcatgccacctgcacttcagccttggtgacagagccaccatgactcaaaaaaaaaaaaaaaaaac

SEQ ID NO: 11572 - DNA, 7134 bp, Homo sapiens
gaacaagctgttactaatgtactggagtttctgtgcaaactgtctaccataaaccatgaaaggattcaaagttcatagttccttctttgttcctttgttaatcactgacttctgactagtgggaggtgcctcccaagtttgctaatgcattctttttggataaggatgacgcacagattgtcctaataaggacttagattgagaaagaccgccccctctgagaagaggggacaagtcagagagagggcgggcagtttcttttttaactagggatgacacaagcataagtcatttccttattaattggttcaaaccagttcttacaggaactagtggtgataaatgtgggacttctgagaagtcattcattttattctttgtgccataccagagtacagtatcagctgagctgaccttactctgaggactaactcttttgctggaagcggtttctgatttacagctcttggtttctcccagacatgttggtgggagagattttggtttttaaggggttgttagatggagtaaattttctttttttttttttttttttttaactaaaaaggggtcacagaatttcagcagttctctgatttttatattttattcctcttcctatccaatccctgccttttgagtccaggtggtaagtacattttctttaacgtttttcctgcttttcttcccaaatgtgtctttttctttgggctactgtaccctgcttccagtgctgtccccggcataggtccatctctgcagaagccatttcaggagtacctggaggctcaacggcagaagcttcaccacaaaagcgaaatgggcacaccacaggtaagactttaatccggtttcttctcccctctgggaagtttcgggctgaaattacattcacagctctcactcacatttttaggcaaataagtgaagttggtttgccagtgttccttgacagaagttgagcgtctgtgtatgctctactgggaaatttgtctttgtcttagactagaaagtgtaacttctgtacatcttctcctaaaaacaagggtagagccaatggaaagtaatggttctgttacatagaatgagttgttgccttgatcttaaatgatgtattggtagatatacttcccaagtggattaaaaagttaaaacttacagcataacaaagtattagacttactgaggtgacttgaatatctccttttgattttcactctatttttcttttcacccatgggaaaatgataattttttaataaaccaaggctcttaccatagctgaactttaaaacttagactgtcttttctgtaaacgattctgaggcaaagggaaatgactagaagaggatgagtaaacaataacctgaaatgggaaactcgagggaagcacaggttttttttgttttgttttgtttggttcgttttttgttctttggggtttttttgagacagaatttcgctctcgttgcccaagttggagtgcaatggcgcgatcttggctcactgcaacctccgcctcccgggttcaagcgattctcctgcctcagcctcccaagtagctgtgattccaggcacgtgccaccacaccagctaattttttgtattttaatagaaacagggtttcaccgtgttagccaggctggtctcaaactgacctcagatgatccgcccgccttggcctcccaaagtgctgggattacagatgtgagccaccgcgcccggccagagcactgttttttttaatggccttgcactcttcttatggacctttgctgccctcagttgaccaaacatgacatcagaaacagatacatttgtgtgttttaaaaacagctcctaatactggaacaaaaatatttaactgtcttgacaatactcatgagtatctgcatggcgacttcagagttgagtttaatcaaagagtttattcttaggtcctagtagaagagctaacctcacactcatcccattctaaactatgtgattcaacactgattttacatccaacaaagtgaaatcttgatagttgggtgtaaaaaggagagtaatggagatttcagagtagttggggttgcttacttttcatttttaattctttaggttttgtaagttacacacttcaagcattatagatgatcctctttttactactgaactaatgaagcctttttcattgcattgttctgcatttatttctacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaattgtgtccgttttcttgagcgttttgattttttacttttagcttataccagctgaatggcagccttgcctaatccacctacaacaagaatttcttaagctttcttttatttgcatgagagagccactaccaaggcatgttttgttatgctgaaactgggctgctgcatactgctaaatggcacctctgggattggcctacctggggatttcttggtttgtgaaaacaggagaggagaaatatctcatacaagtgaaaggatactggagagagaaattacccatttctaaaaaaaaaccacactctgtcgtatctgtgttaatgttttctagcatgtactctggtttcaacagacacaaatttatatgttaacccagttttcttgccgttctgtaagtgttttattcttagtgtgatttttttccattgggatgtttttgattgaacttgttcattttgttttgcttgggaggaaaataaacaattttacttttttcctttaggagcattatgagcattatgtcagaatagaatagaattggggttcgatcttaacaggccagaaatgcctgggtttttttggtttgtttttgtttttgtttttttatcaaatcctgcctgactgtctgcttgttttgcctaccatcgtgacatctccatggctgtaccaccttgtcgggtagcttatcagactgatgttgactgttgaatctcatggcaacaccagtcgatgggctgtctgacattttggtatctttcatctgaccatccatatccaatgttctcatttaaacattacccagcatcattgtttataatcagaaactctggtccttctgtctggtggcacttagagtcttttgtgccataatgcagcagtatggagggaggattttatggagaaatggggatagtcttcatgaccacaaataaataaaggaaaactaagctgcattgtgggttttgaaaaggttattatacttcttaacaattctttttttcagggacttttctagctgtatgactgttacttgaccttctttgaaaagcattcccaaaatgctctattttagatagattaacattaaccaacataattttttttagatcgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaaaaaaattttgtttcctaggttgaaggtctaattgatacgtttgacttatgatgaccatttatgcactttcaaatgaatttgctttcaaaataaatgaagagcagctgtccttctttcctcttttaagtgttcagctgtggcatgctcagaggttcctgctggattccagctggagcggtgtgatacccttctttttcagctgttcgtgccttcctttcttgtatccaccaaagtggagacaaatacatgatctcaaagatacacagtacctacttaattccagctgatgggagaccaaagaatttgcaagtggatggtttggtatcactgtaaataaaaagagggcctgggaattcttgcgattccatctctactttgtataagtctcattttgtgccttacacatctgcagtatttatcatgttccaacttggtgactgtcaggcagtgcaatacatcagcagtttatcaccgaagagctgaggaatacctcccttaaaacagacaatgtcggccgggcgcggtggctcacacctgtaatcccagcactttgggaggccaaggcgggcagatcacctgaggtcaggagtttgagaccagcctggccaacatggcgaaaccccatctctactaaaaatataaaaaattagccgggcgtggtggtgcacgcctgtaatcccagctattcaggaggctgaggcaggagaatcccttgaacgcaggaagcagagtttgcagtgagccgagatggcgccactgcactccagcctgggtgacagagcaagacaaaaaaaataacagatgatgtcatatgaaaatgtgcaatgtccagttttcccatagttttctgtattctctgtgtgcataatctggagtatgagtctgggaagaaaaaggtttttagtttcatttggatagtggccacctctccattccctacgaatgctagaatgaagttactttttttttttttttttttttttttgagacagagtcttgctccgtcgcccaggctagagtgcaatggtacaatctcggctcactgccacttccgcctcccaggttcaagcgattgtcctgcctcagcctctggagtagttgggattccaggcgcccaccaccacaccaggctagtttttgtatttttagtagagacggggtttggccatgttggtcaggctggtctcgaactcctgacctgaggtgatccacctgcctcggtctcccaaagttctgggttcacagacgtgagccaccatgcccacgtagaatgaagtttcttaaatacactagttaattattgaaacatatgcagtattgagtgctcctacacaaacacgctcagcctctgcccccagtgtgctctgtgctatccacagccttagtagaacatgaggctttttgtcatttcaccagtcattcaataatgactcatttgagtatggatcatgcactagctaaataaccagttgcgctcatgtaccctgaagcaaattgtttagcctgacccatgtgtaagaagatcacagagattcccaacctttcagtgtcaaaaagcctttccatatatattactttaaaacccattttcccccatgtgtaatagtctatgttaatgacggttcgggtttcttctacattgtttgtgacctgagaaagtttaaaagagcctcagtttctttcatctataaaaataaaagagatagaaggacagtttacctaaggaataaatctggtaacatgtaaagtactgaaataggctgggtgcagtggctcatgcttataatcctaatactttgggaggccaaggcaggaggatcccttttaggccaagagttcaataaatagggccgggcatggtggctcacgcctgtaatcccagcactttgggaggccaaggtgggcagatcacctgagttcgagaccagcctaaccaacatggcgaaatcacatctctactaaaaatacaaaaatgtagcaggcacggtggcacatgcctgtaatcccagctactcgggaggctgaggcaggaatcgcttgaacccaggaggcagaggttgcagtgagccgagatcttgccattgcactccagcctgggcaacaagagtgaaactccgtctcaaaacaaacaaacaaaaaagagttcagtaaaagtacagcaataaaagttatccacctccaccaccccagcttttttttttttttttttttttttttgagagtgaggttttactgtgtcacccaggctggagtgtggtggcacagtcatggctctttacagccttgacctcccaggctcaagaaattctcctacctcagcctccctggcaaggaccagcatgaaccaccatacctgggtaattttttaattttttgtaaagacagggtctcaatattttgcccaggccagtcttgaattcccaggctcgagcgatcctgccgtggcctcccaaagtgctgggatgacaggtgtgagccaccatgctgggcattcccaatgaaagactgaggccaggcacagtggctcacgcctgtcatcccagccttttgggaggccaagacaggatcacttgaggtcaggagttcaagaccagcctggccagcatggtgaaaccctatctctactaaaaatacaaaaattagccaggcgtggtggcgtatgcctgtaatctcagctactcgggaaacaggcaggagagtcacttgaacccggaaggcagacgttgcagtgacctgagatcgtgccactgcactccagcctgggcaacagagcaagacaccatctcgcaaaaaaaaaaaaaaaaaaaaaaaaaaa

SEQ ID NO: 11573 - DNA, 4284 bp, Homo sapiens
ccttactttgaggactaactcttttgctggaagcggtttctgatttacagctcttggtttctcccagacatgttggtgggagagattttggtttttaaggggttgttagatggagtaaattttctttttttttttttttttttttaactaaaaaggggtcacagaatttcagcagttctctgatttttatattttattcctcttcctatccaatccctgccttttgagtccaggtggtaagtacattttctttaacgtttttcctgcttttcttcccaaatgtgtctttttctttgggctactgtaccctgcttccagtgctgtccccggcataggtccatctctgcagaagccatttcaggagtacctggaggctcaacggcagaagcttcaccacaaaagcgaaatgggcacaccacaggtaagactttaatccggtttcttctcccctctgggaagtttcgggctgaaattacattcacagctctcactcacatttttaggcaaataagtgaagttggtttgccagtgttccttgacagaagttgagcgtctgtgtatgctctactgggaaatttgtctttgtcttagactagaaagtgtaacttctgtacatcttctcctaaaaacaagggtagagccaatggaaagtaatggttctgttacatagaatgagttgttgccttgatcttaaatgatgtattggtagatatacttcccaagtggattaaaaagttaaaacttacagcataacaaagtattagacttactgaggtgacttgaatatctccttttgattttcactctatttttcttttcacccatgggaaaatgataattttttaataaaccaaggctcttaccatagctgaactttaaaacttagactgtcttttctgtaaacgattctgaggcaaagggaaatgactagaagaggatgagtaaacaataacctgaaatgggaaactcgagggaagcacaggttttttttgttttgttttgtttggttcgttttttgttctttggggtttttttgagacagaatttcgctctcgttgcccaagttggagtgcaatggcgcgatcttggctcactgcaacctccgcctcccgggttcaagcgattctcctgcctcagcctcccaagtagctgtgattccaggcacgtgccaccacaccagctaattttttgtattttaatagaaacagggtttcaccgtgttagccaggctggtctcaaactgacctcagatgatccgcccgccttggcctcccaaagtgctgggattacagatgtgagccaccgcgcccggccagagcactgttttttttaatggccttgcactcttcttatggacctttgctgccctcagttgaccaaacatgacatcagaaacagatacatttgtgtgttttaaaaacagctcctaatactggaacaaaaatatttaactgtcttgacaatactcatgagtatctgcatggcgacttcagagttgagtttaatcaaagagtttattcttaggtcctagtagaagagctaacctcacactcatcccattctaaactatgtgattcaacactgattttacatccaacaaagtgaaatcttgatagttgggtgtaaaaaggagagtaatggagatttcagagtagttggggttgcttacttttcatttttaattctttaggttttgtaagttacacacttcaagcattatagatgatcctctttttactactgaactaatgaagcctttttcattgcattgttctgcatttatttctacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataagtagagaaagttttaaactgcagaaattggagtggatgggttctgccttaaattgggaggactccaagccgggaaggaaaattcccttttccaacctgtatcaatttttacaacttttttcctgaaagcagtttagtccatactttgcactgacatactttttccttctgtgctaaggtaaggtatccaccctcgatgcaatccaccttgtgttttcttagggtggaatgtgatgttcagcagcaaacttgcaacagactggccttctgtttgttactttcaaaaggcccacatgatacaattagagaattcccaccgcacaaaaaaagttcctaagtatgttaaatatgtcaagctttttaggcttgtcacaaatgattgctttgttttcctaagtcatcaaaatgtatataaattatctagattggataacagtcttgcatgtttatcatgttacaatttaatattccatcctgcccaacccttcctctcccatcctcaaaaaagggccattttatgatgcattgcacaccctctggggaaattgatctttaaattttgagacagtataaggaaaatctggttggtgtcttacaagtgagctgacaccattttttattctgtgtatttagaatgaagtcttgaaaaaaactttataaagacatctttaatcattccaaaattgtgtccgttttcttgagcgttttgattttttacttttagcttataccagctgaatggcagccttgcctaatccacctacaacaagaatttcttaagctttcttttatttgcatgagagagccactaccaaggcatgttttgttatgctgaaactgggctgctgcatactgctaaatggcacctctgggattggcctacctggggatttcttggtttgtgaaaacaggagaggagaaatatctcatacaagtgaaaggatactggagagagaaattacccatttctaaaaaaaaaccacactctgtcgtatctgtgttaatgttttctagcatgtactctggtttcaacagacacaaatttatatgttaacccagttttcttgccgttctgtaagtgttttattcttagtgtgatttttttccattgggatgtttttgattgaacttgttcattttgttttgcttgggaggaaaataaacaattttacttttttcctttaggagcattatgagcattatgtcagaatagaatagaattggggttcgatcttaacaggccagaaatgcctgggtttttttggtttgtttttgtttttgtttttttatcaaatcctgcctgactgtctgcttgttttgcctaccatcgtgacatctccatggctgtaccaccttgtcgggtagcttatcagactgatgttgactgttgaatctcatggcaacaccagtcgatgggctgtctgacattttggtatctttcatctgaccatccatatccaatgttctcatttaaacattacccagcatcattgtttataatcagaaactctggtccttctgtctggtggcacttagagtcttttgtgccataatgcagcagtatggagggaggattttatggagaaatggggatagtcttcatgaccacaaataaataaaggaaaactaagctgcactgtgggttttgaaaaggttattatacttcttaacaattctttttttcagggacttttctagctgtatgactgttacttgaccttctttgaaaagcattcccaaaatgctctattttagatagtttaacattaaccaacataattttttttagatcgagtcagcataaatttctaagtcagcctctagtcgtggttcatctctttcacctgcattttatttggtgtttgtctgaagaaaggaaagaggaaagcaaatacgaattgtactatttgtaccaaatctttgggattcattggcaaataatttcagtgtggtgtattattaaatagaaaaaaaaaattttgtttcctaggttgaaggtctaattgatacgtttgacttatgatgaccatttatgcactttcaaatgaatttgctttcaaaataaatgaagagcagctgtccttctttcctcttttaagtgttcagctgtggcatgctcagaggttcctgctggattccagctggagcggtgtgatacccttctttttcagctgttcgtgccttcctttcttgtatccaccaaagtggagacaaatacatgatctcaaagatacacagtacctacttaattccagctgatgggagaccaaagaatttgcaagtggatggtttggtatcactgtaaataaaaagagggcctgggaattcttgcgattccatctctactttg

SEQ ID NO: 11574 - DNA, 392 bp, Homo sapiens
ccaaatgactcagaggacctagagggagggcttgaacacactccagcactgtttctacaatttagcctttatttgcattggaaaccacattcctgaattcttgagggggcaggctctggcttattctgggcaactgacttcaagtgggacccctgagctacctatgtaagcaaagagtcagccatctctggagagttaccagggaggaggatctttctgtgaacttgctttgatgacctccacccaaagccctttgaggaacagttttgtttattcaaggagcccttggcaggtcactcctcccctaccacaaatctaatccaaatgcgacattttcctttgaggccatctatcccttttgggggacaaaacacatcagcttttcccttcag

SEQ ID NO: 11575 - DNA, 300 bp, Homo sapiens
gcattaggcagtgttgcaagtacatatcggaatctctttggctggctctaagaaagagtttgaacttatttacctccttagccctatgtaacaggtaagaaactaaaaggtacagaaaatagagatgtttgatttttctaagttgccccaagctaccgtttttaaaaacgcctgcaagcatgtctaaaacaggagcctgttagctacagttgccaaaccggtttaacagcactgcctccatgtattctgggtaagaaggagctccgagtacataaatttatcaaagatcactatcccaat

SEQ ID NO: 11576 - DNA, 106 bp, Homo sapiens
ggccgggcgcggtggctcacacctgtaatcccagcactttgggaggccaaggcgggcagatcacctgaggtcaggagtttgagaccagcctggccaacatggcgaa

SEQ ID NO: 11577 - DNA, 10053 bp, Homo sapiens
gcccgcaggttgaaggttcctggggccacatctgggccgagaggcatggtccttggaggtaggtagctgtgccctgtatacctgccgtctgggccgtgcatggcctcagctgcccaggaggaggtttgctcgtttcctcatttccgctttcctggcagatcctgaggccggcagggtctgggccaagttctaaaaggcaaccctaacatggtctcagggccactcgtggccagtgctgagtccgcgggaagtgggtctgcctggcccagctgtggtgggaaccccgccttccagcacttcctgctgtcttgctggggtttcctgccaggaacacagacatggagctgggagaccctctcagggcctgcttcctgggctggccggtaggagacggtgcagggctccagtgccaggccctgcctgtctgtgtggcatctggggaatgggcacagcagctcatgcccacactggtgggtcagacaagggatgccggaagccccaggcaggtcctagcatatggtggggtagaagaggggtgcctgattttcaggtcgccccaccatctgccaatgcctgctgagtccaagggttagggccagtgagcaggacaggctgcgagcagccaaggtgtagactgggaccccccaggcacccagggcaggcacctcgtccctgttgtccccctgggtcctgctcagcacaggagaacctgtgccccaggctgtcctttctttgctgtgtgactgttttgtgagcctgttcagctgcttttgagtcagtggagttggtcggggaggcagagtctttcaaaacagtgagagccaggcatcaaggaaaacagccctgccacccactgccatgcgctccaccagccacggggcatctgagaccaccccattcagtcccctccacatccttgtctacccattttacaaatgaggaaactgaggcatagagtggtcagtgttgaggcaggactcggggggtaaaggaggtgctgtggcagcttccagccctactcctcacaggcccctggaaagggcgactgatatgcatcaccacatttgtgggcccacagccccgaccctgtctcctcccatccaagccctgggtgagccagaacacccattatgctatggccagagccaggccggtggatgcagcaagcctggttcatatcccacttctgtgccagcccctcctgcctgagctgaggatgctcactgaagtggccctaggaccgaccgtgtggcccagccccaacatgtgcagcctgcagtggggaggccgaccgtccacagaaggttgcatgaggagccagccacgcccctacacagagctgacctcctcaccaagcctccctcctagctttcagaggaaatatatctggcctggccccaggccccgagtgctgctgaggttctgggaatctattaaccagggtgtttattccctgccctgcccaagccatgggcactggtctcagcagggcttagctcctggcagctcctgctggctggtcaggaccacagggctccctcacctgtggtagctgggtcccccggccaccctcaggcccatcccaagatagaggcaagtgcccaggactgggggagagtgggatcgtcctccctgggaccctcctgtgtggtggtcagctcagggctccaaggcccagagtaccaaggttagggacagggaagcagactgtccctgctgccctcccctccacatgatgctcccaatgtggcctgctgcctggggtggttgccagctatgctgtatcctggggcagccctatgctttgggacacacagtcctgggagatggctctgggaaaacctcctctgagctgcaatctgctggtctgtagaatgggagaggaacacagcctctcccttggtaagcaggagtttcccaggtgcaaccctagatatacggagggggagactgaggccaacggagggggagcttgcgtcagggccacgggctgggctgtggtgagccagggcttgacctgcatgcagaagcttccctagctgcaggttggacaggaagcagatggccggatgggctggaagtgcccttcaccagcaggggtgcatggtcagggcatttgctggccactcggggctcagaggccatcctggggcatctgctccacagcctcgtggtacacatggaagactgaggcacaaagtggggctagttgtccggacacagctggagcctgaagcagggagccattgagagttcagcccctaagggacaatggcatcagctaccagagcttctgagccccggggcctgggttcaaatcctagccaagccctcacttgctatgtggctttgggtaaggaaccgcctttgctgggcttcagtttacccaccttaagtgggcatgaggacagcaggggcacaggctcctcgtggctgggggtgctgagagctgaggcttggggagctggaggctctgcgcggatggtgctttttaatggatctgagtgttcctcgtgactgcatggctgtgaaatatttaaatggttctgcagagctcagaaaaaaagggaattcttcctcctgcccagaggccaacacagttagcctgggcttgtgtgtctgtttatgtacgtgtgcatatgtatgtatgtgcatgtgtatttgtgtgtgcgtattgtgtgcacatgtgtgtctcacgtctatgtgtgtctttctgggggatgtgtgtttctgtgcttttgtgactaggaacacgcacatatatgtgtagatgcccccagaaggtggaaatcctcacggggtctgcacttggccttctcccagcaccaagtcctgggatggagacccgaatgagcataagggtggccttgaaggaaggcactttggcacttgaggtttgtgaaacttaggagcacatgcccactgtggccagcagcccctgggacactgcaccttgcggagcacacgtgtgatggggtgtggcccactgggcagcttcgcaagagcagaactggagacgacctcagtgccaggcacaggcccttgtgtccgggctgtcctcacccagaccctgggcagcctgggaggaagcccctaagtggacagtggtgggacagggacacacagtcctgggaggtggctctgggcaaacctcctccaagctgcaatctgctggtctgtagaatgggagaggaacacagcctctcacttggtgagtgccctggctgtgctggggcctgggggaatcccagggagtgcagcgtcaggcccagggtgggagaggcaaagtagacaccccatagaggcttcggggtatgcatggagtgacccgagagcacaccagggccccagggacagcgctgctgggtggcccaggtaaaggcggctgtccctgtgcgcacatgtgtccacgtgaacttgctacttagagagcagctgatgctgaaggcaggttgttggaattcccaggcccaggtgtaagcagcagagcccaccagtgtcccctgacgcccactctcttcctcctgggcacataattttagatgaaactgaaaaacacgcagcatgaaagcaaggcccctgccctctgctggttctgtattggctgcctcgtgtatttttccagcctgcagaaagtcgaggcctggatggataccatgtccgcccctccctgtggccctgcggcaccccggcctcccggcctgcatctttcatgagtctggaaacaggatctcccagagagggccccaggaggttggctgccagcagtgggttctcacagctgcctccaagcaggtgaccagtcctgggaggctgtggtctagggcctggcaactcaggggcgcctgtggacaaagggccgggccaaggggctggcaggtttgtcctgagtgactgaagagggccccaccagggcagcttgagaggggcagactcttgctccagagaaagaggaagtttggtacttagcttggaatgaagggccagccctagagaggaccttcctgtggcaggagagagggccatgtcctgccaggggaagtcctgggaggcttcctggaagcagtggcctctgtgtggggccttggagcttgagagtgtctggcaccagggaaaggcattgggggcttcgagagaactgcagggggccctgaccagataggcccctaaggcaaagaggattccatcagaactcgcattcccattttattactctgggaagtaatgtggaagctaagctccactgtatgtcgtatgctgaggcatctgttgagcctctgctgtgtcggggccgggctctgggtggcccacctcagtgaagtcttgctgctaatggccgaatagttctgcaaggcctgtgctgaggcctggaggcgagtggcctgttgggccccaaggctgggaggttgggaggtggcaggggcgatctctgcccttaggtccggcccaggaggacttgcttcttgcctgggccggtgtgcacagatctgtccgcccacacgtcacttcctttcctggcatcaggagctcagactctgaggggagggggagaggaggccgggggcacagaccggtaggggcaggcagggaggagcagccccgcctatggcaggagtgggaggatcgggcaatgctttccagtggaaaatcagagtgcgtgtgctaaggttgctatgtcgtttcctttctctccaggaccgtattcctaggggaggttttataaaggctgagcacatgctcgcagcctctccttagggtaataagcacttctgtctgagcacttaccaggggtgggggcaagggaagccctcacctgcagggcccggtgacccccagagcccgactcaggcacagcccttgcccccctcccccacccgccttgctgaccattcccctccctgcagccggcccgctggggctggaggcacgggcccatcaacgtgaaccattacgccagcaagaagagcgcagccgagagcatgctggacatcgcgctgctgatggccaacgcgtcccagctgaaggccgtcgtggaacagggccccagcttcgccttctatgtgcccctggtggtcctcatctccatctcccttgtgctgcagatcggcgtgggggtgctgctcatcttccttggtaggtccccaggtgggggcagccaggccacctgctcaccttgctggcatctgctcgcatcgcctgggacaggtgcccaccaccttgcacacttggctctcaaggagctgccgagttcctggccctcatcacccagacatgcagtccaggaagtggcaccccccctccccccaccctgcactttggtttttgttttgttttgttttgttttttgaaacaaggtccccctctgtcacccaggctggaatgcagtggcgcagtctcggctcactgcaagctgcatctcctgggctcaagcgatcctcccacctcagcccccaaagtaactgggattacaggcgctcatcaccatgcccggctaatttttgtattttttgtagagatgaggttacgccatgttgcccagtcgaatttttgagctcaagtgatccaacagcctcagtctcccaaaatactgggattacaggcatgagtcaccacgctcagccttgttttgttttgttttgttttgtttttgaaaccgggtcttgctgtgtcttgatcacagctcactgcagtctcaacctcccaggctcaagcgagccttctgcctcagcctcccaggtaggctggaccacagctatatgccatcatgccagctaatttttttatttttggtagacacggggtcttgctatgctgcccaggctggtctcaaactcctgggctcacgtgatcctcctgtctcggcctcccaaagtgctgggattacaggtatgaaccactgtgcctggccccaccctgcactttgaaagagcacagagtggggtcagggcctggcctgtgggcattagggcaggtgtttcaccgggttcttgttgacccatgccatgagatggcctcagtcatgccagtcctaccttctgggcccagggtccccttcatggctgcgtaaccttgggcaagtggctgaacctcccgggcctcacttataaaacaggcatcataatagaactgcagcttgtggcaggaatcactagattaaggcacgcaaagggctcagtgcatttgcccaaacctggcctttggttgacgtccatagcttcaattcgtataaggaaaatatgggggctacagaaggtggggtcatagaccgtggggttgcccaagccaggggcgctgttgtccatgtttcagcaaaacagatgtatttttctctgggcgacaaaactcatcctaaatgcgactgagagccctgtaatgtcccaggacagcttgaccgctggggtgggtccccttccactgtcccaggctggggcgctgcgtctgggctgcccttggcaccatccactcctctctcgcccacagtcaagtacgaccttaacaacccggccaagcacgccaagctggacttcctcaacaacctggccacgggcctggtgttcatcatcgtggtagtcaacatcttcatcacggccttcggggtccagaagcccttgatggacatggcaccccagcagtaggacacccaggtgagctgggagatggggcgcgaggcctgcagtcctggggttgctcgctgttggaggctcttgcagtgtggtgagtccctggccggccagccttggacaccttcctaggccatgggcatcctcgtccacacctacaaggccaatgcctggccactgccttgaggccagccctgccactggtgctggccacctggggtcctgtggtcacagtgtttagatggaatgtgtgtaggagccaccatttgaacatcctggagaactcacttaaacgtaagatttctatacattcagaatgtctgtccgataaaaaaaaaaagatttctgggtcaggcgcggtggctcatgccggtaatcccagcactttgggaggctgaggcgggcagatcacttgaggtcaggagttcgagaccagcctcgccaacagggtgaaaccccgtctctactaaaaatacaaaaagtggccaggcatggtggcacatccctgtagtcccagctactcaggaggctgaggcaggagaatcgcttgaacccaggaggcagaggttgcagtgagctaagatcgtactactgcactccagcctgagcgacagagtgagactctgtctcaaaaaacacccaaaacccaaagatttccggcttctcttgataagtcaggggctctgcaccccttatcagctccacttagcaggtgaagcttcctcccagccctcgtctgagaaaaagggaccttggtatgaccgcctgcctgacatgcccacctcactgtgccactctgaccaggacggtgggattcaggatcttgtcacgtggagcccttgtgactcttcaagtctgccccttgccgggcctcgcagaatctgttagctgcctgccttaggctggaccctggctgtgtgcaggatgcagactgaggctgtctctacaggacgaggcacccagtgtaggaagacttctcacaccacatacagcctctccctgtgtccttgctcagagagggtgagcgtctgcccagtgacacagcctgggagcaggatccacaggaaggcctgggatgcagccatggccagggccacatggtgcacacactacagtccatgcagccaggccagggccacacaccacagtccccgcgaccttaggcctaggggtcacccctccggtttgtagcagaggtggaggtgagttgctaagggaggggtgggcactcctggcaggtggccatctctccaccagtggtggcccatggcagagtagacaggagcagtgctcttggggcagagcgcctgtgtgtcaaggatatataaaaatttccccaggccaggcacggtggctcacacctgtaatcccagcactttgggtggctgaggcaagcggatcacctgaggtcgggagcttgagaccagcctgaccaacatggagataccgtgtctctgctaaaaatacaaaattagccaggcgtgatggcgcatgcctgtaatcccagctactcaggagggtgaggcaggagaatcgcttgaacctggaaggtggagattgcagtgaactgagatcacgccattgcactccagcctgggcaacagtatgagactccatctcgggaaaaaaaaaaaattccccaagagggcatagtgaggatgaggtggggcgctggggccagcagctgggttgggagcaccctgcatccacctggcctcacccctccccacacgggggccaacgagtgaccgctgctcgtagtggcccatggcctctcaagctcccctaccacacccaaggccattcccccagtgggatcacgccagcccccaatgtcccggccgtggagcctgaagtcaccctcctgaaaggacctggatctgggcggccccatgtggggtccgagtcactgtccagatgctgcctccagtttgtagttaagttgtcctcttccagaacacctagatgtcagctgctccctggcttgggcatgtggccaggccatttattaatcacctgctgtgtgtgctgaatgcagtccctaactctcccaagcatgagttatctgcctgccgggaagagggtgctgcgtctgtgggccacgtggggacccagcagtggaccttaaagctgtcctcagaggctcggaggccaaagctgctgtgtgtcctgcgtggagcagtcagagaggtctcaggcttcgtgggtggctatggtcacagctgcccaacccgagccccccatgctgggccaggcctctaagtcctggcagtaacccagccatgctatattcattccattttcagaggggaaactgaggcatggagtactttgacacctctcatgtcagaatcaggctcttctccttcctgagtccgggtgtgcaaatggccctgacactcggggcttgtcacagcctggctcagagcctctcctctccctccttccaggctcagagcctctcctctccctccttccaggctcagagcctctcctctccccccttcccaggctcagaccctctcctcttcctccttccaggctcagaccctctcctctccctccttccaggctcagaccctctcctctccctccttccaggctcagaccctctcctctccctccttccaggctcagagcctctcctctccctccttccaggctcagagcctctcctctgtctcctttccaggaccctggatgttgcctgccctgcaactcagctgcccgaccccaggagtcgccatacctgtgaggtgtccacctccctgcacatggcactacccagactgccagagcccaggctggcctcatctgcaccatgtccccggaccagcccttgctctgactgcggccaagcaccacgcaggaggccactcttgtctctcagcagctgttcccaggaggcagctccctcctggcacatgggggctggccacaatagcccagagggtcagaactggacagctgcagagacctgtgcccagagaagggtctcgacccactcaaggacacacagcaggtccgtggatgggctggatgagtgaccagggccagcctctgtctcaggacattccagaaggacaaggagatgtctctccctctcccaaagcaccagcgtccctgcctcccgtgggccctgtccgggttgccctggtgaccccagcctctgtccacttcctaacccagggaccctgcacagccagaactgcctttggccctacggatggccactggctctggtcttaagtgcctgggcttggtggccatcaagagggagccagtcaggcctgtgagggccgtagaccttgtatataccctgcaccagcagtgaccgggcagagcccaaccccctccacgggggtcccagcacccacttttctaatcatgaatgaacaataaagcccacgctctttgtcaggctccacatgcc

SEQ ID NO: 11578 - DNA, 141 bp, Homo sapiens
tagcattggccgcaggttgcgtggccagcgctgactcagatgcatgccgcccagcgcttggtccctgatttggccatggcctgcagtgtgggctggctggcagccaggcaggagggagggccccctgtgtgcctggcctca

SEQ ID NO: 11579 - DNA, 986 bp, Homo sapiens
tttctttctttttatttgagagaagggggggttgagagtagagtgggaatggcaagaagtagtatgacagagcttcttctctttttttcccctctttaccaggaagttaactagaagtcttcatgcatgtttttaaaacaaagttggtaattagcataacctagttagttacctttacacagagtgacagaattaaaaagttgacaagcccatcagacctcagccaggaggtactgaaaggagggagaccagtgagtctagaccaataggtgggttaggcctcctgaatgccagcctagaagtttagacttgattctataggctctagggtacctacaagtttgtagtcgcagccttgggaattgaatgttacataggaactttcactggttccagctagccttggctgttagcaattatttttatctactttaacaggggggacagagtaggggggcaggaaactaagctggcattatggtcacaggaaagaacagactgatttggagcctttcaaactgcagacctttgttactgaccgatgcttaatttggtttctgggttttgttagttttttcccctgcccttacctcatttaccttaacgacagctcccccctctagagctcagctagggcaggctgccactgtggattggggggccaagaggcccagtgcaagaagaaagtgggttgaaagcagagttctgtttaaagaattttctgctggaaactagcccagagggagtaaagaggagctttaatgaggagcagctgcagtgccgacgcaacccacatgagacttttttttccccttcgttccacattctgtatagtttttttaaaaatcatgactttgaaatagctgttttgtaaagcatgcctctctttttcttcttgtatgtggtgggattttgctttgttgttgttgttgttgtttcttgaatggccaaatcctcgttttaaaaaaaaaaaaaaaaaaaaaaaa

SEQ ID NO: 11580 - DNA, 986 bp, Homo sapiens
  misc_feature (488)..(488): n equals a,t,g, or c
  misc_feature (580)..(580): n equals a,t,g, or c
  misc_feature (656)..(656): n equals a,t,g, or c
  misc_feature (667)..(667): n equals a,t,g, or c
tttctttctttttatttgagagaagggggggttgagagtagagtgggaatggcaagaagtagtatgacagagcttcttctctttttttcccctctttaccaggaagttaactagaagtcctcatgcatgtttttaaaacaaagttggtaattagcataacctagttagttacctttacacagagtgacagaattaaaaagttgacaagcccatcagacctcagccaggaggtactgaaaggagggagaccagtgagtctagaccaataggtgggttaggcctcctgaatgccagcctagaagtttagacttgattctataggctctagggtacctacaagtttgtagtcgcagccttgggaattgaatgttacataggaactttcactggttccagctagccttggctgttagcaattatttttatctactttaacaggggggacagagtaggggggcaggaaactaagctggcattatggtcacagngaaagaacagactgatttggagcctttcaaactgcagacctttgttactgaccgatgcttaatttggtttctgggttttgttagttttttcnccctgcccttacctcatttaccttaacgacagctcccccctctagagctcagctagggcaggctgccactgcgganttggggggccnaagaggcccagtgcaagaagaaagtgggttgaaagcaaagttctgtttaaagaattttctgctggaaactagcccagagggagtaaagaggagctttaatgaggagcagctgcagtgccgacgcaacccacatgagacttttttttccccttcgttccacattctgtatagtttttttaaaaatcatgactttgaaatagctgttttgtaaagcatgcctctctttttcttcttgtatgtggtgggattttgctttgttgttattgttgttgtttcttgaatggccaaatcctcgttttaaaaaaaaaaaaaaaaaaaa

SEQ ID NO: 11581 - DNA, 980 bp, Homo sapiens
ttctttcttttttttttgagagaagggggggttgagagtagagtgggaatggcaagaagtagtatgacagagcttcttctctttttttcccctctttaccaggaagttaactagaagtcctcatgcatgtttttaaaacaaagttggtaattagcataacctagttagttacctttacacagagtgacagaattaaaaagttgacaagcccatcagacctcagccaggaggtactgaaaggagggagaccagtgagtttagaccaataggtgggttaggcctcctgaatgccagcctagaagtttagacttgattctataggctctggggtacctacaagtttgtagtcggagccttgggaattgaatgttacataggaactttcactggttccagctagccttggctgttagcaattatttttatctactttaacaggggggacagagtaggggggcaggaaactaagctggcattatggtcacaggaaagaacagactgatttggagcctttcaaactgcagacctttgttactgaccgatgcttaatttggtttctgggttttgttagttttttcccctgcccttacctcatttaccttaacgacagctcccccctctagagctcagctagggcaggctgccactgcggattggggggccaagaggcccagcgcaagaagaaagtgggttgaaagcagagttctgttcaaagaattttctgctggaaactagcccagagggagtaaagaggagctttaatgaggagcagctgcagtgccgacgcaacccacatgagactttttttccccttcgttccacattctgtatagtttttttaaaaatcatgattttgaaatagctgttttgtaaagcatgcctctctttttcttcttgtatgtggtgggattttgctttgttgttgttgttgtttttttttgaatggccaaatcctcgtttttaaaaaaaaaaaaaaaaaa

SEQ ID NO: 11582 - DNA, 468 bp, Homo sapiens
agactgtaaactggaagataaggatgtttgtaaagttcttgtataaataaagcatggtttctcattgcagtggttactgatttcatagtctgagtgaagatgaatgatgctgtgaatcaacagctttaaagtccgtaccacttcagcttctttttggtttaggtttcttaaaatcagtgtgtatttaatgctttattcagatgagggggtgaaaaacctaacacatgtaaactaagtgaggtggggtttcagagataattcccagcctcacaattcctcatgaagttcttttcctgtgggaaacttttaatttggaagcatgcaacctaatgtgggaaccaagattaacattttctgaaatacttctacaagaaaagcagaaatggtctgtccaggaagctgaatttacatagtagaaaaatgagctgccctgcagtatttggtagtctttgtgtattggttgtgata

SEQ ID NO: 11583 - DNA, 468 bp, Homo sapiens
agactgtaaactggaagataaggatgtttgtaaagttcttgtataaataaagcatggtttctcattgcagtggttactgatttcatagtctgagtgaagatgaatgatgctgtgaatcaacagctttaaagtccgtaccacttcagcttctttttggtttaggtttcttaaaatcagtgtgtatttaatgctttattcagatgagggggtgaaaaacctaacacatgtaaactaagtgaggtggggtttcagagataattcccagcctcacaattcctcatgaagttcttttcctgtgggaaacttttaatttggaagcatgcaacctaatgtgggaaccaagattaacattttctgaaatacttctacaagaaaagcagaaatggtctgtccaggaagctgaatttacatagtagaaaaatgagctgccctgcagtatttggtagtctttgtgtattagttgtgata

SEQ ID NO: 11584 - DNA, 468 bp, Homo sapiens
agactgtaaactggaagataaggatgtttgtaaagttcttgtataaataaagcatggtttctcattgcagtggttactgatttcatagtctgagtgaagatgaatgatgctgtgaatcaacagctttaaagtccgtatcacttcagcttctttttggtttaggtttcttaaaatcagtgtgtatttaatgctttattcagatgagggggtgaaaaacctaacacatgtaaactaagtgaggtggggtttcagagataattcccagcctcacaattcctcgtgaagttcttttcctgtgggaaacttttaatttggaagcatgcaacctaatgtgggaaccaagattaacattttctgaaatacttctacaagaaaagcagaaatggtctgtccaggaagctgaatttacatagtagaaaaatgagctgccctgcagtatttggtagtctttgtgtattagttgtgata

SEQ ID NO: 11585 - DNA, 22680 bp, Homo sapiens
agtgaacagcggagccggacggggatcgccggcgggcggcaagcggaggcggcccaggcccggcggtctccgagatgtcacgatggctgtggccatggtcaaactgtgtgaaagagcgggtctgccgctacttgctgcaccactacttaggtcacttcttccaagagcacctcagcctggaccagctcagcctcgatctgtacaagggcagcgttgccctgcgagacatccacctggaaatctgggtgaggagccaggcccgagtccaggaaggtgcggagggtgggagcgcagcgacctgaggctccctgcggcaggatcgggctgggggatcaggcaccgggcgtagagaggccaggggaatcttgccctctcccaggcgtcagaggcaccccggctagcctcttcagttccttaccagagccagaaactgagcgggaaggggtttctgtctccacgggaggagaaactgaggctggagagggcaagatcacctgtctggagaatgcaagacaaactcgtcgagtttgggggctgagttaaggaggttggctctcgggctgaggaggggctggggagggagcgtaggaactgagctgggccagggcagtgacagacttgggcctgcgcagctggtgggggaagctggtaggggtccggagccctggcgaggacacctgtggatcatgtgccctgacctcttgaccccacggtcctgagcccgtaggtgggatcaacaaaccaccggatgtgtatgtcaacaaccgcgtcagtacgtcagtaccagtgttgatcaacacctcgtgtgcctgggtcgctgcctacttcctgcttttgggagagtgggatgggccaagtgggtgtctagggagggactggatggcccccacccacatctcccaccgacccccccggctcagtgtccctgcctggagggaggccctggaggaaaggtggggagatctggcttcaagccgggaggaggccaagggagatgctagggaggccaagaggtgtaaggtcagaggcttgaggctgggaacggtgaggagccctgactcacagctcagctgacctggggagctttgaaggagccaccaattagaggcgcgtcctggtcgatccaccaggtccagagcagcaggggtgggcatggaggcagggacttctcagttttgtggctggactcagggggctgctaatctgggcagaagagctaggctttgggggtaggccaggccctggtgagcaaatgtggggtaggataatcgtgggccctgaactgggggcaccccccagtggcctgctgtctgtgaattctggtgtaggaagccctctctgacctctaaccttagcctcagcctctaaggccgtctctaggctgccccttttttatttttatagagacaggatttcgctatgttgcccaggctagccttgaacccctgaagggatcctcccacctcagcctcccaaagtgctgagattataggcatgaaccaccatacccagccctaggcttcccctttttactttcagctccagaaaacgcccctactcctgttccctgccctcttgttggggattgaattggcttctctagggccctggtggaatgcaggcgctttcttgataaccagcccctcctccctcccagctcagcctgcaggccccgccttgaaggcccccaaagaaactgagtatctggggcctctgaagtggcatgaaaagagagaggcccgcatcccagtctcagtccctgttgtatactgggtgactagattagtcctgtctctaggcctcagtttcccgagctgtgggtctctgggtgaggaatttggactcccatctgctctgccatgtgcttttttattcttggatccaaccagtttactgaggccctttctgggtggcacctggggtgacgggggaggcaggtggggtacagccctccaggagcttccaggttggcaggggtacaactccagcatggacattttagccaggggctcagccttgtgcctcacagagaggcacagctacactaggtgtttggggttggtggggggggggggtcccatctggcattaggtcagcccctctcttggacactgtccctttgaactctgctcatccagggtgaacatgggtattctggactctgccatacatgtgcccatgttgtcctgtgcctgcaacacaccaccttctaccagcgcctatcccccctccctttattcttcagcttgcccctcctctgacggcccaggctgggttaggcgtcttccccacggcccccccaccagccccctcaccacccccaagcacctgctcacctcttgagtttcatcctagttgctctgagtccctggctggagcctagcttggctggggaatgaagacattttatttacccatctagtctcagtgtcagcatgtagaaagtgctcggtaaatattatcttgaattaagtggtgagggaaacatctgctctggcttgaaggattaggcacctttgggtgacggggtaggggggctggcctgtagtaggggacagcatgagcataggtgggaccttgtagataacacgtggagggacagggcaagccaagggtgctctccaaggcactatggccagataaggctgtgccagcctgtgggatttggggtttccctgagctggttttgtctcttgcttgctcccagtctgtgaacgaggtgctggagtcaatggagtcaccgctggagctggtggaaggcttcgtgggctccatcgaggtggccgtgccctgggctgctctgctcaccgaccactgcacagtgcgcgtgtccggcctccagctcaccttgcagccccgccggggtccaggtgagggcagggcgaggctgggggcaggcaagtggggagagtgggctggggcgtccaggacctgactgggcctgcctgccttgagaccctgtttctccctacagcgccaggggctgccgactcacagagctgggcctcatgcatgaccacaagcctgcagctggcccaggagtgtctgcgggatgggctaccggagccctctgagccaccacagcccctggaggggctggagatgtttgcccagaccattgagactggtgagcaggcccctcctggccgccctgtctcctgcccttcagtggcacacagaacaggggctccagacaacggcacggccaccctggtgcccagatgggaaattctgcctcccctttgctgctctacctgacctgagacccctccccaactcctcagtgcttcggaggatcaaagtgaccttcctggacactgtcgtgagggtggagcactctccgggtgatggggaacgtggtgtggccgtcgaggtccgtgtgcagaggtaagggcaggccgatctggggtggactggtgtgaagatggggagtgggggctgctggatggtccccacccgcagcctaggttcctgggaagaggcagggtggatctggatgggcctcggtggtggtagggttggggaggtgggctgcatcgtgagcccggactggtgtccagaggccaggtgatacaggcccagagtggccgaggccccaagaaccaagttagatgctgagggtctgaggagcaagggctggcctgagcctccgggctggacatggtggttcaggacggcctaggtgtgatggggcagctctgcaggctaggctccctgaccccgtgcccctagagcagagcactgtgtggagagaggggctccaggcctggggtggccagggcacgggctgaccctacactctccagactggagtactgtgatgaggcagtgcgggacccaagccaggcgccgccggtggatgtgcatcagccgcctgccttcctgcacaagctgctgcagctggcaggggtccgcctgcactacgaggagctcccggcacaggtgagcgggctctgattcccacagcccctgtctcctctcccttgagcccattgagcccctcccatcctttctgaccatctctgactccattttctcaacctttccctcttgtatcctcccgtctcccaggaagagcctccagagccccccttgcagatcggcagctgctcagggtacatggagctgatggtgaagttgaagcaaaatgaggccttccctggccccaaggtgggtccccaggcccctggggagggggtgagtaccccatctcaagactcctcctcctcagcaaggctgattatctacagcccacagtggggatgtcaagtgggggatttacttccttcttggcagctaaagaaactgaggctgtaggccaggcacagggttcacacctgtaatcccagcactttgggaggccaaggtgggtggatcatctgaggtcaggagttcgagaccagcctggccaacatggtgaaaccccgtctctactaaaaatacaaaattagccaggcgtggtggcacatgcctgtaatcccagcttcttgggaggctgaggcgggagaatcgcttgaacccaggaggcagaggttgcagtgagccaagattgcaccactgcactgcagcctgggcaacaagagtgaaactccatctcaaaaagaagaaaaaaagaaactgaggctgagaggtcaagttgtggcctggttcatagagctagttggtaacagagtttagtttggtagccagcatcctgctttcccagggcgagggcaggcgggtggtagctcttagaggagctgggtggtgggcctaggctccatggctgcctccttggcccccagttggaggtggcgggacagctgggctccctgcacctgctcctgaccccgaggcagctccagcaacttcaggaactgctcagcgccgtgagccttacaggtgaggcccctgggtggcatgggggtggggtggctgggagggccagccagcccagactgaagtctcctcccctgcagaccacgagggcctggctgacaagctgaacaagagccgcccgctaggtgccgaagacctgtggctgattgagcaggacctgaaccagcagctgcaggcaggggcagtggctgagcccctcagcccagacccccttaccaacccccttctcaacctggataacactggtgggtgtggggtcagaccgtggttggaggggcagctagtgtgggtgcagcagcctaggggctggggtcggctgtccctgacactcctcacttcacccacagacctcttcttctccatggctggcctcacaagcagtgtggcctcagccctctctgagctctccctctccgatgtagacctggcctcctctgtgcgcagcgacatggcctcccgccggctctctgcccaggcccacccagctggtgagttggagcaccctgggggtactccagggacaggaaggactggaagaggccttagtgccgtgggctgtcagaggcacacaggaaatccccagcgatgcctggatatctaccatctgtgacttggttccctggggaccaaacaaggtgggagctggtgatagagtggacagagcctaggtttttcagtcattgatcttagtcaagcacttgaactctctgagactcagcttcctcttccataggaagagaagggtgagatcagcctttgccaggctgtatatctgggttcatgtttattgagagcttattgtgtgtgggtgctaggctgggtgctttatcacatcctgtccttccagcaccctgaggagggttcagttgagcctgggcagagggcctggtctactggaggcaccagtgtcacccctgcctgaccaagccttctgccagagccacatggtggggcagacctggcctcccaacccccagcctggtggcaaactattgctccacctggggtacccggaatctgttgggagcccctgctgaagcctctgtcccctcaggcaagatggcccccaaccccctcctggacaccatgcgccctgactcgctgctgaagatgaccttggggggtgtgaccctgaccttgcttcagacgtctgccccatcttccggaccacctgacctcgccacgcactttttcaccgagtttgatgccaccaaggatgggcccttcggttcccgagacttccatcaccttcgaccacgcttccagagggcctgtccctgtagccatgttcggtataagcccgaggccagggcctgaggagagaccatcagagccccctaagtgcaccttctgacgcctgtcctcttccccgcaggctaacgggcacagccgtgcagctgtcctgggagctgcggacgggcagtcggggccggcggacaaccagcatggaagtgcacttcgggcagctggaggtgctggagtgtctgtggccccggggcacctctgagcctgagtacacggaggtgagggcagaggcagaatgtgtacgaggcggggtctggaggtttgggtggctgtggggccaggcctgaccctgtgtgcctcccgggtcccatcccagatcctgacctttcctggtacgctgggctcccaggcctcagctcggccctgcgcccatctgcgccacacacagatcctgcgccgtgtgcctaaggtaacccacccgctccaggccaccaggctgtccccatggcgtgttgaccccaccctggcctctgccagggcctcctctgctgcccagccctgtccctcttcccctgtgctccacatctctccatgctggggccctcaaatacctgcctggcccttcctatgccagtctctgagcctggtcatgcccttgccctatctcaatatggccccctggctggcctctgttgctaagagtggcgcatgtcgggtggcttttataagtaaacaagcacattgtgcgcgtcgggcaaaggtggggcaggccttcttagtgctctcgtggcccctgccccagctcttctcccactaccagagagggccttcctgtcccacccgctgagtaccactcagccctcactgacctgaacgccctcgccctcagagccgaccccggcgctcagttgcctgccattgccactcagaactggccctggacctggccaacttccaggcggacgtggagctgggggccctggaccggctggccgccctactgcgcctggccaccgtacctgctgagcctccagccggcctgctggtgagaggcccctgccagggccaggccgggggtgggtgcagggcctgggtccttcggctcttggtcacagtgggaggggctccgacggctgctctgacccccaatcctcctgcagacagagcccctgccggcgatggagcagcagacggtatttcggctctctgcaccccgggccacgctgcggctgcgcttccccattgccgacctgcggcctgagcgggacccctgggcgggccaggccgtgcgggctgagcagcttcggctggagctgagtgagccccagttccggtcagagcttagcagtgggcctggtcccccagtccccacccacctggaactcacctgctccgacctacatggtgagagcccccgagtgacagaacttggggcaagaggcctggcttctgggagagatgggcttggggctatggaaggggcccagtcacaacccgagcagtccctggcccaggcctttaccagctcttggggtcccagcactgcctgtccccggcctcctcaccgacaagtagggtggaccctttgtctctggctttctctgcccaccaaggtgtgtgtggagtcgggggcacagctctgagccgacctgggcattggggaagaaataggaaaaggcagcagtgatgacccccctaattccccatccccctccaggtatctatgaagatggagggaagccacctgtcccttgcctgcgtgtctccaaagccctggaccccaagagcactgggcgcaagtacttcctgccccagtaagtaggggctctggactgggcccaggagaggagggttctgctgggggtggcagggggccagtttggaactgggtgccgggggccctgcaggccagtaacaggcctgtgccccggcagggtagtggtgactgtgaacccccagtccagcagcacacagtgggaggtggccccggagaagggagaggaactggagctgtcagtggagagtccctgtgagctgcgggaacctgagccctcgcccttctcctctaagaggaccatgtatgagacagaggaggtgagacttggccccacctcttcccaggaccccctcccgcccaccgcccgggttcctgccgtaggagccacctgtgtggctgtgggccagggcagcacgaccacctggggtgggcatgagctgacccaacaccagtgaggatttcggctcttccattctttccagccagtcagagagtctttctgaaacggcactggtgagggcaggcccctggggagcatgggtcctcgattggaaagatcaggtcctgccccacctgacccgtggatcagcactgtacacttagaaaggcagttaagggccaggctctgccacttggtgactgtgtcatcaccctggggagttatctgaccttgaagagttacctatagatgagtttcttcccctggaaaatgggcaccatgacctgtctttctctctttttttttcttttttttttgagatagagttttgctgtgtcgccgaggctggagtgcagtggcatgatctcggctcaccgcaacctccgcctcccaggctcaagcgattctcctgcctcagcctcctgagtagccgggattacaggcgcgtgccaccacgcccggctaatttttatatttttagtagagacggggtttcatcatgttggccagactggcctctaactcctgacctcaaatgatcacccacctcagcctcccaaagtgctgggattataggcatgagccaccgcacctggcctaattttgtatttttagtagagacagggtttcaccgtgttggccaggctggtctcgaactcctgacctcaagtgatctgccctcctcactctcccaaagtgctaggattacaggcgtgagccaccgcgcccagcctaaccataacctgtgtcacaggcctgttgtgaggatgaaagaagttaacatacctgaagcccttagaacagcacaggtgtgccatcagcactgtatctgtacggctatcatgcatccccagtagagaagggctcctatgaatgaatgaatgatgaacgacaggagggcaggactgagaccagagacaggccccagccagcgtctctaagatgactctcctgctctttccacctcaccctgtccagatggtgatccctggagaccctgaggagatgaggacgttccagagccggaccctggcactgtcccgctgcagcctggaagtgatcctgcccagtgtccacatctttctgcccagcaaggaggtctacgagagcatctacaacaggtggagacccggggccagcagggcgggactggacactgggtgggcctggcctcccttacctgctgtccacccgcctatctcaggatcaacaacgacctgctcatgtgggagcctgcagatctgcttcccacccccgaccccgccgcccagccctcgggcttccccggcccctcaggcttctggcacgacagctttaagatgtgcaagtcagccttcaagctgggtatgagaggtgctaacgctgggctagagggaggacccccaggtctgggaagggccaggctagcccttcgcggtctccttcccagccaactgctttgatctcaccccagactcggactcggatgacgaggatgcccacttcttctcagtgggggcatcaggtggcccacaggccgctgcccctgaggccccaagtcttcacttgcagagcaccttctctacactggtgacagtgctgaaggggcggatcacagccctctgtgagaccaaggtgagtgcagccccgggcaggcgggccccaaacttcagagctcccattggcggcagagcaagaccagcgcgagcagctccaggtcaagaatgtggagagcaggaggcctgagtgggcagcgccagcccacccacgccagcctgcccaccctgtcacagcccatcagctccttctgaccccctgctgtatgtaaagcaccatgctaggggtcgggatgggcatggagcacccactgttcccactccgagcgggcagacccggcagagattatttttctcctggcaaaagaggcaagtgccatccagggcctccagcagcgtccatggtggaaactggagctgacccccttaggccagggctccaggagccgccaacccccagagggcttgagggttgctgagtgcagctggggaagccaggctgtgtgctccttctgcaggatgagggtgggaagcggctggaggctgtgcacggggagctggtgctggacatggagcacggtaccctcttcagcgtctcccagtactgtggccagccaggacttggctacttctgtctggaagctgaaaaggcaacactctaccaccgaggtgtgaggcctgggggcaggtcaccactggggtccagggttgggggtggagggctttcaggacggatgtgggccctgggtggagtgggtagccagttggcttggcagggggctcatgagacccctccccagcggccgtggatgactacccgctgcccagtcacctggaccttcccagtttcgctcccccggctcagctggccccaaccatctacccatcggaggaaggggtgaccgagcggggagcctcgggccgcaagggccagggccggggaccccacatgttgtccactgctgtgcgcatccacctggacccccacaagaatgtgaaggtatgggcttgcctaccatccacccctcctgctagcctgggctgcagccccggtgtgcggtgggaccccagtgcgcggtgaggccccagtgcacggtggggctggcctccccactgccctgactgcgcccccaccctcaggagttcctggtgacactgcggttgcacaaagccaccttgcgccactacatggccctgcccgagcagagctggcattcccaggtgagcgtgggtggtgggaagccacatggcccagtgactctggacttctgttttgggcaagcaggtctctaggtgggaggaggccggtgggaggaacatggactgggccacagctgaccttgtccggagctcctgggcaaggggtgtggcagacagctagtgggcagaaggtgaggtgccaggcaggggccaggacagggaggggttagaggagggaggacaccacctgatcctcactgcttcctcctgccctggcctctgaagttgttggagttcctagacgtgctggatgaccctgtgctgggctacctgcccccgacggtcatcaccatcctgcacacacacctgttctcctgctctgtggactataggtaccaggctgggtgggccaggggctggggacggggatgggctctcaggtgtaaggagccggccccagcccgagtatcacccccaggccactctacctcccagtgcgtgtcctcatcaccgcggagaccttcactctctccagcaacatcatcatggacacctccaccttcctgctcaggtatgcaggccgccccacactgggccatcccaccctcgccgggccgaagctgcctgccagctgtgtgtcctctggtgctctcggtcttaatgtacacccgggtgatagtctcattctcaggaatgtggattgtttccgcctttctagagggcagttggagcctcctgatgagacccttataagcatttgtgctctctgacctgtaatctcatgtctgagggttgtcctaggatatgcgaataagagaggtgggatttaatgcttatggagtataagttaaaacagccaaaacgtatcagttaaatcacaagcctcacaacctgagcaaataagcatggcccacctagtaggtagaaaaccatgcagggattaaggtgaagctgaagaatcccttcaaaatataagaagatggagggtgcggtggctcacacctgtaatcccagcactttgggaggctgaggcaggcagatcacaaggtcaggagttcgagaccagcctggccaatatggtgaaaccccgtctctactaaaaatacaaaaatgagccgggggtggtggcaggcgcctgtagtcccagctacttgggaggctgaggcaggagaatcacttgaatctgggaggcggaggttacggtgagcgaagattgcgccactgcactccagcctgggtgacagagcgagactccgtctcaaataaatacatagatagatagatagatagatagatagatagatagatagatagataaaataaaaaatatagaaagatgccacagtacagtgtttactcaaataacattggatacaggactgcgtacgttttaaaatcagtttatgaaggggtgtttatatgtctcggcgtgcagctgcagagaaagtttggaaggagatgtgtatggtggttttctcagaattagggattaggaatgatgaatgatttttattttctttattctaaaatatcttaaaggagttttcattatgttacccttaaaataaagacttttttatttattttttttttttgagacagagtctcgctctgtcagcaggctggagtgcagtggcgcaatctcagccgactgcaacctctgcctcctgggttcaagcgattctcctgcctcagcctcccaagtagctgggacaacaggcacccaccaccacacccagctaagttttgtatttttagtagagacagggtttcaccttgttggtcaggctggtctcgaactcctgacctcgtgatccgcctgccttggcctccaaaagtgctgggattataggcatgagccaccatgcccagcccttattattatttctttttgagatggagtctcactctgtcgcccaggctagagtgcagtggtgtgatctaggctcgctgcaacccctgcctccctagttcaagagattctcctgcctcagccttccaagtagctgggattacaggcacccgccaccatgctcggctaatatttgtatttttagtagacatggggtttcaccacgttggccaggctggtctcaaactcctgatatcaggtgatccgcctgcctcagcctctccaagtgctgggattacaggcgtgagccaccgcgccagccaaaaataaggacttattttagaagaaccacaaatgcagcagggagaaaaatggacaccccttcccaggactgtcatgaggccccattgaggtgtcggaactgcaggcactttgagagctgcaagtgctgcccgcttcccactgcctgctgtctgggccttctccccattgtgcaggcaggaacgctgaggctggaggggcctgtccataccacctcctgtgggcttgggacccctctgctcggctcccgtggagctgccccctgcagcggtgcccgggcccttctcagccctgttcccccccaggttcatcctcgatgactccgccttgtacctgtccgacaagtgtgaggtggagaccctggacctgcggcgaggtgggcagggccgggactgggctccctcccctctgagggaccaccgccccggccacacccagagcagccaggtgtctccccgcagctgctggccgggtccttagctcccacacgtagcccgcacagcagggactacacctggatcaaccggatccttcccccaggtgctggggccggggccgggtggaagggggccacaggacctttctctcgcctctgctgcagattatgtctgtgttttggatgttgacctcttggaacttgtgattaaaacctggaaagggagcaccgagggcaaactggtgagtgaggctgtcactctggctcctggagccacagcaggtgcaggggccaagggagtcttcaggggctgctgctccctcacgtgcctgggctccggacacagttcatgcctgcccttcctgggctgcagttagcgcccctcctgcaaagggccatagtacagccctggtgggggtgtcccttgatgctggctgaatgaatgaatgggtttcagccctgccaccagaggacgcggcagccagggcaccagcgaggccctgggaatcagccacctttgtaggtccccggattcatctcctgtaagatggagataacctgccctgcctcgctaggcatgcagagcccttcacggggagtggggtagggtgggtgggcacactcctgcttccttggatggccctgggccaagcccctttcaccctctgggtgaacagtttgttcatctgttcagtggagttactgggcaggtcatccactccaggagagaccatccctgttctgcctgtggcaggatcagaactgcggtgccctcccagcgagcgggtggggccagcaggcagtggcccctgtgttcacatagctgctccccccaccccgcccctgcagagccagccactattcgagctgcgctgctccaacaatgtggtacacgtgcacagctgtgccgactcctgtgccctgctggtcaacctgctccagtacgtaatgagcacaggcgatctgcaccccccaccccggccccccagccccacggagatcgccggccagaaggtacaggtgaggcctggccacacaggctaccagagctcggccaggcccctcccctgccatggccctcgggcctggggttgggggagctctgtcctgtctcactcattgctcctcccctgcctggcccagctctcggagagtcctgcctctctgccctcgtgccccccagtggagacggccctcatcaaccagcgtgacctggccgacgccctcctggacaccgagcgcagcctacgggagctggcccagccttcaggtgaagtgggggtgctgtggggacagcagacacagtcaggcacccactgtgggcgcctctccaaactggcctctctcctataggtggccacctccctcaggcgtcgcccatctccgtctacctattcccaggtgaacggagtggggccccacccccttcaccacctgtcgggggccctgctggcagcttagggtcatgctcagaggagaaggaagatgaaagggaagaggagggcgatggagacaccctggacagtgatgagttctgcatccttgatgctcccggcctgggcatcccggtgcgtggtgggaggggtggaccagtttgccgtccaggcaggtgtgtttggagcggggacggaacactcaggggtggttgcctggccatctggagctcccgtggtgagagaagcaggcaggaggtggttgccatcacctcgggggtggtgctaggtctgtgccaccctagggaggcagccctgatgctgggctttgatggagtagggggatttccagaggaagaggaggcctggtgttttgggcagagggactgggaaattcaagggatggaggaagaggagagggcagttagcaagagggatggagaaccatgtggctgcaagggccagtgggaatgtctgaactcacccaggtcttaggaggcagggctggcaggagcctggcattctcaggctcctcttggacagaccactcaggcatagactcgggtgatagcaacccaggagtgtcatctttcatcaaaaacagggaggaggccaagcatggtaggttacgcctgtaatcccagcaatttgggaggtcaaggtgggagaattgcttgagtccagcaatgagagattagcctgagcaacatagtgagaccccgtctctacaaaaaataaaaataaaattagccagatatggtggcacatgtctgcagtccctgctactcaggaggctgagaatggaggatcgcttgagcctaggaggcagaggttgcagtgaactgtgattgtgccactgcactccagcctgggtgaccgaacatgacccgaccctgtctataaaaaaaaaaaaatgaaaaagaagtgaggccaggttgctggggctgggggcagctgggctggatcgaacatctgtgtcacacgtctacctggcctccctgcagccccgagatggggagcctgtggtgacacagctgcatcccggccccatcgttgtgagggacggttacttctcacggccgatcggcagcacggacttgctgcgggcacctgcccatttcccagtgcccagcactcgggtggtgctacgtgaggtctccctcgtctggcacctctatgggggccgagactttggcccccaccccggccacaggtgaggaggagcgggtgcaggtggcagctggtgaaggttggggctcaggctggtccaggtctgactttcagcagctggagaccttgagccccatccaccccaggtgggcctcagtttcctcatccttccttatcccgcctgccttccaggactggggctagcgggggtctcttgtcccaggctaaaaggcccgctgaggacggggagggaatggggttcctctgagtcagcttggcccctgtccctcttcccagggcaagaactggcctctcaggtcccaggagctccccttcccgctgctctggccccaaccggccccagaactcatggcgcacgcaggggggcagcgggcggcagcaccatgtcctcatggagatccagctgagcaaggtgagtggggtggcgagtgcctactacacgtgtgtgtcatagaacaacgggccttgttctcgatgtcacgtgtagcaatgactaatgcagaggaaaacccctgcctttgtagtggaggaagccaggcagggaccaagatgtatcgagtgtgtccgatggtgaagagcgctcaggggagagtctgcaggggtggaggagacaggtgtgctggggagggtctggaaagtcctcttctgaaggcaccatttgaacaaagacctgaacaagtggggatgtgagccaggaagagttttcaggcagagaggacagcgtgaaagccgcaaattggggccaggcatggtggcttatgcctgtaatcccagcactttggaaggccgaagagagcagatcacctgagctcaggagtttgagaccagcctgggcaacatggcgaaaccccatttctaccaaaaaaaaaaaaaaaaaaattaaccatttgcagtggtgtgtgcctatagtcccagctactcaggaggctgaggcaggagagttgtttgagcccaagaggcagaggttgcagtgagttgagatcgccctattgcattccagcctgggcaacagagtaagactctgtttcaaaaaaaaaaaaaaatgctggaagctggaagcatcctgacatttccaggagcagcagagcctgtgcataaccagcgacccagaatgtttcttttgagtcttacaagagacgaacccctcagggcttttgaggagaggcctctgtggggtggggctctgcagcaatcagggagggctagtgagcaggttcaggagagcctagatgggggctggccacaggttcagctgcggatggggtgtgtgagatacagagagtggtacagagggttcaaggtttgggcctgggaaattgcctggggcaggggggtcccacttgctcagagtgagccaggccagtgctgggcttcccaaggagccgctagaggcaaagggcagaggggcctcaggctgctcgggttggtgggctgtgctgcaagaacctgcgggagatgagtgtcagagcagggggccaggggcctctctgagacctgatggccagccagcgggtgtgcaggaagagggggaaggaaggctctccacggagaggggctacgagagcaaagtcctgaaggcaaaacaggcctggactccttgaggggcagagaccagtgcagctggcatgggaagcaagagcagggtcaggtctggagggagaggcaggtccctgctgggcatagaatagagaaggggtaggggccgggcatggtggctcatgcctgtagtcccagcactttgggaggacgaggcaggcagatcacttgaggccaggagttcgagaccagcctggccaacgttgtgaaaccctgtctctactaaaattagctgggtgtggtggcacatgcctgcaatcccagctactggggaagctgaggcaggagaatcgcttgaacccgagaggcagaggttgcagtgagccgagatcacgccactgcactccaacctgggcgacagagtgagactctgtctcaaaaaaagaatagagaaggggtctggggccagcccttccctccctcttggggccctgcttacctggccaggcctctgtccaccccacaggtaagcttccagcacgaggtgtacccagcggagccagccacaggccctgcggcccccagccaggagctggaggagcgaccgctgtcccgtcaggtgttcatcgtgcaggagctggaggtccgagaccggctcgcctcctcccagatcaacaagttcctgtacctacacacgagtgagcggatgccgcgacgtgcccactctaacatggtatgagcgacctgcaccatccaccctggggcagggcaccagaccgttggggatacatcttcacgcatgcatggattcacacacatacacgcattcccacacaaacacccaggttgtttgtgagcctgggagaagggcagagctaggggctgtgttagcgaagggaacagcgtgttcagaggcagggtggctgggtgagctgtcagggaacagctgggtgagctgctgccccagaggcccagcaggtgtccagaactcaccctctgctcccagctcaccatcaaagcgctgcatgtggcccccactaccaacctgggtgggcctgagtgctgtctccgcgtctcgctgatgcccctgcggctcaatgtggaccaggtgagtggtctacgtgagggcagagcctagggtgaccccactgtctccaggcctctgagtctgatccacatctggacctctcccttgcaggatgccctcttcttcctcaaggacttcttcactagtctggtggccggcatcaaccccgtggtcccaggggagacctccgctgagggtgagaggctgggccagggaggggagcgtctgggccttctgcctcccaggacagcacaggttcccagtcattcctggccccatccccagtctgtgacctcccctcccctagctcgccccgagactcgagcccagcccagcagccccctggaagggcaggccgaaggcgtagagaccactggttcgcaggaggccccaggaggtggacacagcccctcccctcctgaccagcagcccatctacttcaggtaggctgctggactgcgggtggggggccctgggccagattgctgggggccaggccagtgagcaaagaaccccctcttcctgctcccctacccagagagttccgcttcacgtctgaggtccccatctggctggattaccatggcaagcacgtcacgatggaccaggtggtaagtggggcggtcggatggggtggccatgtggggtcagctgtggctgagtccctctgggggccaggtcttgcatccaggcactgttagcagccagggcgctctccagtggctcccatgggctagctagctccctgagtcccattgggtaaacctggaccccctccctctcccagggcacttttgctggcctcctcatcggcctggcccaactcaactgctccgagctgaagctaaagcggctctgttgcaggcacgggtgagtccccagcaccccagcctctctccagggtccctgatcttccttctgttctggtcctgactggttgtgtggccttggccaagtcatcacccttctcagggcctcaatttctcctctgtaaaaaggacgcagttggctgggcatgatggctcacacattcaggcattcgagaccagcctgaccaacatggtgaaacccccccgtctctactaaaaatacaaaaattagccaggcgtggtggcatacacatgtaatcccagctactcaggaggctgaggcaggagaactgcttgaacctgggaggcggttgcagtgagccaagatcgcaccacttcactccagcctgggcaacggagcaagactccatctaaaaaaaaaaaaaaaggacacagtccctctgcacatgactgggtgggaccacagggagggtagagtgcccacagtacttgccacaggggtactgagtcctcctgaccccacaatccctccatgtgtggctctgcctcaccttctgcctcctcacctccctgccctgccaggctcctgggtgtggacaaggtgctgggctatgccctcaacgagtggctgcaggacatccgcaagaaccagctgcccggcctgctgggaggcgtgggccccatgcactcggttgtccagctctgtgagtgtctaggtttggaagccctcgaaactgcttttacccttgggcaacctagaagctgccattgggaataagaggaggaggtgggggcagggcagcctcgggtgtctctgagcgctccttccccctagtccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggtgagtgggtgccctgtatctgggctgtgcaggacagagcagctggagccctctgcaccacagctccctggttctgtcctcaaagctcctcagagtgggcagtctgggtatgacagccctactttatagagaaacagccacggagaggctaagtgacttgcctgggacctccaagccaggtctcccgaggcccacaggggctcccatgcaggagcgggagtgccccccaggccttcagagcccactgtgtctcctgctcatggcatgtcttgtaaaggggggtggaggacggctgtgtttgcagactaagaatctgaggcgcagaggctgccctggttcattcaggccatacgcttcgctaggccagaaggaccccagggaagctggggagccagtctcgtgggcagttgtcagatgaattctgtaggggatcgatggtcctaggcggctaaggggtgagtgcaggtgcatggtgcattctggaacctgcaagctcagaccccaacaggacagagggcagggctccaggggaggtgggagggatgcatgggcaccagggagcccccgggagtgttcagtcaggtgggaaagagtgatgccaggtgagatgctgggcagaggatctggcagacagaaggaaggatgggcctctgaccatctggcaggggcgtctggggggccaggcaaggagcggtcagtctcaggcgtgcagctgcggcagccatgtggaacctgctgaatgtggtggtcagcaggaagagaggtttgggttgagaagactttaggaaagtcccctgaggagtcccacgttcctaggttccctcagcagagtggcaggtgcctaggaaggggaggaagagtgggaggaagtggggagtgaggctgagcaggaccccctaggccagcacagtgacaggcagggaggctgagggctggtggggtctcagactgtcctgggggcctggggctgacgtgtgccccagccagctgtcctcatccagtgctcccatgtcccccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagaggtgaccaggcccccgccctgccccagtcccccatgcccatctcctcacacagaccccgccctgacctctggcttccacagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgccagcccccctctcaga

SEQ ID NO: 11586 - DNA, 4372 bp, Homo sapiens
agcccttccctccctcttggggccctgcttacctggccaggcctctgtccaccccacaggtaagcttccagcacgaggtgtacccagcggagccagccacaggccctgcggcccccagccaggagctggaggagcgaccgctgtcccgtcaggtgttcatcgtgcaggagctggaggtccgagaccggctcgcctcctcccagatcaacaagttcctgtacctacacacgagtgagcggatgccgcgacgtgcccactctaacatggtatgagcgacctgcaccatccaccctggggcagggcaccagaccgttggggatacatcttcacgcatgcatggattcacacacatacacgcattcccacacaaacacccaggttgtttgtgagcctgggagaagggcagagctaggggctgtgttagcgaagggaacagcgtgttcagaggcagggtggctgggtgagctgtcagggaacagctgggtgagctgctgccccagaggcccagcaggtgtccagaactcaccctctgctcccagctcaccatcaaagcgctgcatgtggcccccactaccaacctgggtgggcctgagtgctgtctccgcgtctcgctgatgcccctgcggctcaatgtggaccaggtgagtggtctacgtgagggcagagcctagggtgaccccactgtctccaggcctctgagtctgatccacatctggacctctcccttgcaggatgcccctcttcttcctcaaggacttcttcactagtctggtggccggcatcaaccccgtggtcccaggggagacctccgctgagggtgagaggctgggccagggaggggagcgtctgggccttctgcctcccaggacagcacaggttcccagtcattcctggccccatccccagtctgtgacctcccctcccctagctcgccccgagactcgagcccagcccagcagccccctggaagggcaggccgaaggcgtagagaccactggttcgcaggaggccccaggaggtggacacagcccctcccctcctgaccagcagcccatctacttcaggtaggctgctggactgcgggtggggggccctgggccagattgctgggggccaggccagtgagcaaagaaccccctcttcctgctcccctacccagagagttccgcttcacgtctgaggtccccatctggctggattaccatggcaagcacgtcacgatggaccaggtggtaagtggggcggtcggatggggtggccatgtggggtcagctgtggctgagtccctctgggggccaggtcttgcatccaggcactgttagcagccagggcgctctccagtggctcccatgggctagctagctccctgagtcccattgggtaaacctggaccccctccctctcccagggcacttttgctggcctcctcatcggcctggcccaactcaactgctccgagctgaagctaaagcggctctgttgcaggcacgggtgagtccccagcaccccagcctctctccagggtccctgatcttccttctgttctggtcctgactggttgtgtggccttggccaagtcatcacccttctcagggcctcaatttctcctctgtaaaaaggacgcagttggctgggcatgatggctcacacattcaggcattcgagaccagcctgaccaacatggtgaaacccccccgtctctactaaaaatacaaaaattagccaggcgtggtggcatacacatgtaatcccagctactcaggaggctgaggcaggagaactgcttgaacctgggaggcggttgcagtgagccaagatcgcaccacttcactccagcctgggcaacggagcaagactccatctaaaaaaaaaaaaaaaggacacagtccctctgcacatgactgggtgggaccacagggagggtagagtgcccacagtacttgccacaggggtactgagtcctcctgaccccacaatccctccatgtgtggctctgcctcaccttctgcctcctcacctccctgccctgccaggctcctgggtgtggacaaggtgctgggctatgccctcaacgagtggctgcaggacatccgcaagaaccagctgcccggcctgctgggaggcgtgggccccatgcactcggttgtccagctctgtgagtgtctaggtttggaagccctcgaaactgcttttacccttgggcaacctagaagctgccattgggaataagaggaggaggtgggggcagggcagcctcgggtgtctctgagcgctccttccccctagtccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggtgagtgggtgccctgtatctgggctgtgcaggacagagcagctggagccctctgcaccacagctccctggttctgtcctcaaagctcctcagagtgggcagtctgggtatgacagccctactttatagagaaacagccacggagaggctaagtgacttgcctgggacctccaagccaggtctcccgaggcccacaggggctcccatgcaggagcgggagtgccccccaggccttcagagcccactgtgtctcctgctcatggcatgtcttgtaaaggggggtggaggacggctgtgtttgcagactaagaatctgaggcgcagaggctgccctggttcattcaggccatacgcttcgctaggccagaaggaccccagggaagctggggagccagtctcgtgggcagttgtcagatgaattctgtaggggatcgatggtcctaggcggctaaggggtgagtgcaggtgcatggtgcattctggaacctgcaagctcagaccccaacaggacagagggcagggctccaggggaggtgggagggatgcatgggcaccagggagcccccgggagtgttcagtcaggtgggaaagagtgatgccaggtgagatgctgggcagaggatctggcagacagaaggaaggatgggcctctgaccatctggcaggggcgtctggggggccaggcaaggagcggtcagtctcaggcgtgcagctgcggcagccatgtggaacctgctgaatgtggtggtcagcaggaagagaggtttgggttgagaagactttaggaaagtcccctgaggagtcccacgttcctaggttccctcagcagagtggcaggtgcctaggaaggggaggaagagtgggaggaagtggggagtgaggctgagcaggaccccctaggccagcacagtgacaggcagggaggctgagggctggtggggtctcagactgtcctgggggcctggggctgacgtgtgccccagccagctgtcctcatccagtgctcccatgtcccccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagaggtgaccaggcccccgccctgccccagtcccccatgcccatctcctcacacagaccccgccctgacctctggcttccacagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcaggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgccagcccccctctcaga

SEQ ID NO: 11587 - DNA, 4362 bp, Homo sapiens
ggggccagcccttccctccctcttggggccctgcttacctggccaggcctctgtccaccccacaggtaagcttccagcacgaggtgtacccagcggagccagccacaggccctgcggcccccagccaggagctggaggagcgaccgctgtcccgtcaggtgttcatcgtgcaggagctggaggtccgagaccggctcgcctcctcccagatcaacaagttcctgtacctacacacgagtgagcggatgccgcgacgtgcccactctaacatggtatgagcgacctgcaccatccaccctggggcagggcaccagaccgttggggatacatcttcacgcatgcatggattcacacacatacacgcattcccacacaaacacccaggttgtttgtgagcctgggagaagggcagagctaggggctgtgttagcgaagggaacagcgtgttcagaggcagggtggctgggtgagctgtcagggaacagctgggtgagctgctgccccagaggcccagcaggtgtccagaactcaccctctgctcccagctcaccatcaaagcgctgcatgtggcccccactaccaacctgggtgggcctgagtgctgtctccgcgtctcgctgatgcccctgcggctcaatgtggaccaggtgagtggtctacgtgagggcagagcctagggtgaccccactgtctccaggcctctgagtctgatccacatctggacctctcccttgcaggatgccctcttcttcctcaaggacttcttcactagtctggtggccggcatcaaccccgtggtcccaggggagacctccgctgagggtgagaggctgggccagggaggggagcgtctgggccttctgcctcccaggacagcacaggttcccagtcattcctggccccatccccagtctgtgacctcccctcccctagctcgccccgagactcgagcccagcccagcagccccctggaagggcaggccgaaggcgtagagaccactggttcgcaggaggccccaggaggtggacacagcccctcccctcctgaccagcagcccatctacttcaggtaggctgctggactgcgggtggggggccctgggccagattgctgggggccaggccagtgagcaaagaaccccctcttcctgctcccctacccagagagttccgcttcacgtctgaggtccccatctggctggattaccatggcaagcacgtcacgatggaccaggtggtaagtggggcggtcggatggggtggccatgtggggtcagctgtggctgagtccctctgggggccaggtcttgcatccaggcactgttagcagccagggcgctctccagtggctcccatgggctagctagctccctgagtcccattgggtaaacctggaccccctccctctcccagggcacttttgctggcctcctcatcggcctggcccaactcaactgctccgagctgaagctaaagcggctctgttgcaggcacgggtgagtccccagcaccccagcctctctccagggtccctgatcttccttctgttctggtcctgactggttgtgtggccttggccaagtcatcacccttctcagggcctcagtttctcctctgtaaaaaggacgcagttggctgggcatgatggctcacacattcaggcattcgagaccagcctgaccaacatggtgaaacccccccgtctctactaaaaatacaaaaattagccaggcgtggtggcatacacatgtaatcccagctactcaggaggctgaggcaggagaactgcttgaacctgggaggcggttgcagtgagccaagatcgcaccacttcactccagcctgggcaacggagcaagactccatctaaaaaaaaaaaaaaaggacacagtccctctgcacatgactgggtgggaccacagggagggtagagtgcccacagtacttgccacaggggtactgagtcctcctgaccccacaatccctccatgtgtggctctgcctcaccttctgcctcctcacctccctgccctgccaggctcctgggtgtggacaaggtgctgggctatgccctcaacgagtggctgcaggacatccgcaagaaccagctgcccggcctgctgggaggcgtgggccccatgcactcggttgtccagctctgtgagtgtctaggtttggaagccctcgaaactgcttttacccttgggcaacctagaagctgccattgggaataagaggaggaggtgggggcagggcagcctcgggtgtctctgagcgctccttccccctagtccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggtgagtgggtgccctgtatctgggctgtgcaggacagagcagctggagccctctgcaccacagctccctggttctgtcctcaaagctcctcagagtgggcagtctgggtatgacagccctactttatagagaaacagccacggagaggctaagtgacttgcctgggacctccaagccaggtctcccgaggcccacaggggctcccatgcaggagcgggagtgccccccaggccttcagagcccactgtgtctcctgctcatggcatgtcttgtaaaggggggtggaggacggctgtgtttgcagactaagaatctgaggcgcagaggctgccctggttcattcaggccatacgcttcgctaggccagaaggaccccagggaagctggggagccagtctcgtgggcagttgtcagatgaattctgtaggggatcgatggtcctaggcggctaaggggtgagtgcaggtgcatggtgcattctggaacctgcaagctcagaccccaacaggacagagggcagggctccaggggaggtgggagggatgcatgggcaccaggtagcccccgggagtgttcagtcaggtgggaaagagtgatgccaggtgagatgctgggcagaggatctggcagacagaaggaaggatgggcctctgaccatctggcaggggcgtctggggggccaggcaaggagcggtcagtctcaggcgtgcagctgcggcagccatgtggaacctgctgaatgtggtggtcagcaggaagagaggtttgggttgagaagactttaggaaagtcccctgaggagtcccacgttcctaggttccctcagcagagtggcaggtgcctaggaaggggaggaagagtgggaggaagtggggagtgaggctgagcaggaccccctaggccagcacagtgacaggcagggaggctgagggctggtggggtctcagactgtcctgggggcctggggctgacgtgtgccccagccagctgtcctcatccagtgctcccatgtcccccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagaggtgaccaggcccccgccctgccccagtcccccatgcccatctcctcacacagaccccgccctgacctctggcttccacagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgcca

SEQ ID NO: 11588 - DNA, 4365 bp, Homo sapiens
agcccttccctccctcttggggccctgcttacctggccaggcctctgtccaccccacaggtaagcttccagcacgaggtgtacccagcggagccagccacaggccctgcggcccccagccaggagctggaggagcgaccgctgtcccgtcaggtgttcatcgtgcaggagctggaggtccgagaccggctcgcctcctcccagatcaacaagttcctgtacctacacacgagtgagcggatgccgcgacgtgcccactctaacatggtatgagcgacctgcaccatccaccctggggcagggcaccagaccgttggggatacatcttcacgcatgcatggattcacacacatacacgcattcccacacaaacacccaggttgtttgtgagcctgggagaagggcagagctaggggctgtgttagcgaagggaacagcgtgttcagaggcagggtggctgggtgagctgtcagggaacagctgggtgagctgctgccccagaggcccagcaggtgtccagaactcaccctctgctcccagctcaccatcaaagcgctgcatgtggcccccactaccaacctgggtgggcctgagtgctgtctccgcgtctcgctgatgcccctgcggctcaatgtggaccaggtgagtggtctacgtgagggcagagcctagggtgaccccactgtctccaggcctctgagtctgatccacatctggacctctcccttgcaggatgccctcttcttcctcaaggacttcttcactagtctggtggccggcatcaaccccgtggtcccaggggagacctccgctgagggtgagaggctgggccagggaggggagcgtctgggccttctgcctcccaggacagcacaggttcccagtcattcctggccccatccccagtctgtgacctcccctcccctagctcgccccgagactcgagcccagcccagcagccccctggaagggcaggccgaaggcgtagagaccactggttcgcaggaggccccaggaggtggacacagcccctcccctcctgaccagcagcccatctacttcaggtaggctgctggactgcgggtggggggccctgggccagattgctgggggccaggccagtgagcaaagaaccccctcttcctgctcccctacccagagagttccgcttcacgtctgaggtccccatctggctggattaccatggcaagcacgtcacgatggaccaggtggtaagtggggcggtcggatggggtggccatgtggggtcagctgtggctgagtccctctgggggccaggtcttgcatccaggcactgttagcagccagggcgctctccagtggctcccatgggctagctagctccctgagtcccattgggtaaacctggaccccctccctctcccagggcacttttgctggcctcctcatcggcctggcccaactcaactgctccgagctgaagctaaagcggctctgttgcaggcacgggtgagtccccagcaccccagcctctctccagggtcctgatcttccttctgttctggtcctgactggttgtgtggccttggccaagtcatcacccttctcagggcctcagtttctcctctgtaaaaaggacgcagttggctgggcatgatggctcacacattcaggcattcgagaccagcctgaccaacatggtgaaacccccccgtctctactaaaaatacaaaaattagccaggcgtggtggcatacacatgtaatcccagctactcaggaggctgaggcaggagaactgcttgaaacctgggaggccgttgcagtgagccaagatcgcaccacttcactccagcctgggcacggagcaatcatctaaaaaaaaaaaaaaaggacacagtccctctgcacatgactgggtgggaccacagggagggtagagtgcccacagtacttgccacaggggtactgagtcctcctgaccccacaatccctccatgtgtggctctgcctcaccttctgcctcctcacctccctgccctgccaggctcctgggtgtggacaaggtgctgggctatgccctcaacgagtggctgcaggacatccgcaagaaccagctgcccggcctgctgggaggcgtgggccccatgcactcggttgtccagctctgtgagtgtctaggtttggaagccctcgaaactgcttttacccttgggcaacctagaagctgccattgggaataagaggaggaggtgggggcagggcagcctcgggtgtctctgagcgctccttccccctagtccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggtgagtgggtgccctgtatctgggctgtgcaggacagagcagctggagccctctgcaccacagctccctggttctgtcctcaaagctcctcagagtgggcagtctgggtatgacagccctactttatagagaaacagccacggagaggctaagtgacttgcctgggacctccaagccaggtctcccgaggcccacaggggctcccatgcaggagcgggagtgccccccaggccttcagagcccactgtgtctcctgctcatggcatgtcttgtaaaggggggtggaggacggctgtgtttgcagactaagaatctgaggcgcagaggctgccctggttcattcaggccatacgcttcgctaggccagaaggaccccagggaagctggggagccagtctcgtgggcagttgtcagatgaattctgtaggggatcgatggtcctaggcggctaaggggtgagtgcaggtgcatggtgcattctggaacctgcaagctcagaccccaacaggacagagggcagggctccaggggaggtgggagggatgcatgggcaccagggagcccccgggagtgttcagtcaggtgggaaagagtgatgccaggtgagatgctgggcagaggatctggcagacagaaggaaggatgggcctctgaccatctggcaggggcgtctggggggccaggcaaggagcggtcagtctcaggcgtgcagctgcggcagccatgtggaacctgctgaatgtggtggtcagcaggaagagaggtttgggttgagaagactttaggaaagtcccctgaggagtcccacgttcctaggttccctcagcagagtggcaggtgcctaggaaggggaggaagagtgggaggaagtggggagtgaggctgagcaggaccccctaggccagcacagtgacaggcagggaggctgagggctggtggggtctcagactgtcctgggggcctggggctgacgtgtgccccagccagctgtcctcatccagtgctcccatgtcccccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagaggtgaccaggcccccgccctgccccagtcccccatgcccatctcctcacacagaccccgccctgacctctggcttccacagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgccagcccccctctcaga

SEQ ID NO: 11589 - DNA, 373 bp, Homo sapiens
ggaggctggtctcgcccaggcctctgtgggaagggccgccaggctgagtggagggccagccaccagctacggtgtcttccttcgcaggtctgtccccccaggcagaaggattccagcccagggatcccccatcccaccctgactgcatcctgagaaggggggacgccacttcgggaaggttgttggggcagcacaggccctggggccctgctctgtgaccttgggcggccccctctgtctctctaggcctgtatgcaccactggcaaagggggcagggcccaagtctactctaaaagctcccctttctctccagaagctttggagtctcccaaaatgcctgctgggtctctgcaggactggcacctgtcaccg

SEQ ID NO: 11590 - DNA, 385 bp, Homo sapiens
ctgagacctgatggccagccagcgggtgtgcaggaagagggggaaggaaggctctccacggagaggggctacgagagcaaagtcctgaaggcaaaacaggcctggactccttgaggggcagagaccagtgcagctggcatgggaagcaagagcagggtcaggtctggagggagaggcaggtccctgctgggcatagaatagagaaggggtaggggccgggcatggtggctcatgcctgtagtcccagcactttgggaggacgaggcaggcagatcacttgaggccaggagttcgagaccagcctggccaacgttgtgaaaccctgtctctactaaaattagctgggtgtggtggcacatgcctgcaatcccagctactggggaag

SEQ ID NO: 11591 - DNA, 373 bp, Homo sapiens; identical to SEQ ID NO: 11589

SEQ ID NO: 11592 - DNA, 373 bp, Homo sapiens; identical to SEQ ID NO: 11589

SEQ ID NO: 11593 - DNA, 1861 bp, Homo sapiens
caatggcacaggccaatgtaggctggggcttagagaactggagaaaaacgtgtttgtgtgtagtacctcaggtactccttgccttgcagtccaaagcaaatgtaccgcttctcctggttttctttctagaaactgcattatatataccctatttttatatataatgcttctgtattactcctctggagactagccttttttatagactttctggtagaatgttaattagaaaggaaaataactatcttcaaccaatttattcattaaaagttcagttttttccaaagagtcataatacataaactttttttttttttttgagacagggtctcattctgtcacccatactggggtgcagtgacaccatctcggctcactgcaacctccacctcccaggctcaagtgaatctcctgcctcagcctcccgaatagctgggattacatgcacacaccaccacacctggctaatttttgtatttttagtagagacggggtttcactatgttggccaggctagtctcaaatgcctgacctgaaatgatccacctgcctcggcctcccatagtgctaggattacaggtgtgtgccactgtgcctggctgatacacaaactcttaagaaaacaaatattgatatccaaaacattttaataattacattgaaattttctattgcagaaactgtgtttccaatctaaattattaattaatcctaaccctttcctgctctgggtttgtgtttttgaattcagtacatcatcttacagtttttgcttttgttaaaatactggaaataattttgaggaagaaaagaaaataagaagtgatatgtcaccttctaaattgtctttcctaacttagaagcaaattcgaatgtctctagtatggcttttctctccttatttcccctatcatcccttttctcacacttctctttatttaaaacttgtcttcaaagcacacagaatagagtcgataagagtctatccagccctgatttctcttggccaaggaatgaaaggctgttctctaaaccttgataggtaaggaatagccccctgtccacctccatcttagtctgtattgctgtaaaggaatacctgaggctggggatttataaagaaaaaaggtttatttggctcatgattttgatatctgtaaaagttcaagattggacattgacatctggcaagggccacaggctgcttccactcatggccgaaggcaaagaggagccagcattgcaaagatcccatgatgagagaggaagcaagagagagaggggaggtggcagactctttttaacaaccagttttctcaggggctaaaagagtaagaactcactcacctgccatccttacccccacagcccccaggatttctctattcatgagggatctgcccccatgacccagacccctcccattaggccccacctccaacattggggatcaaattttaaaatcagagttggaggcgacaagtatccaaactatagcacccacaaaccatctagtttatcttattattataacctgtcatcctaaaagttctcaaaatctggctgggcgcagtggctcacgcctgtaatctcaacattttgggaggccaaggtgggtggatcacttgaggtcaggagtttgagaccaacctggccaacgtgatgaaaccctgtctctactaagaatacaaaaattagccaggcatgatggtgggtgcttgtaatcccagctactctggaggctgaggcaggagaatcgcttgaacctaggagatggaggttgcatgagccaagatcacaccactgcactccagcctgggcaagcgtgagactttgtctcaaaaaaaaaaaaaaaagaaaa

SEQ ID NO: 11594 - DNA, 1861 bp, Homo sapiens
caatggcacaggccaatgtaggctggggcttagagaactggagaaaaacgtgtttgtgtgtagtacctcaggtactccttgccttgcagtccaaagcaaatgtaccgcttctcctggttttctttctagaaactgcattatatataccctatttttatatataatgcttctgtattactcctctggagactagccttttttatagactttctggtagaatgttaattagaaaggaaaataactatcttcaaccaatttattcattaaaagttcagttttttccaaagagtcataatacataaactttttttttttttttgagacagggtctcattctgtcacccatactggggtgcagtgacaccatctcggctcactgcaacctccacctcccaggctcaagtgaatctcctgcctcagcctcccgaatagctgggattacatgcacacaccaccacacctggctaatttttgtatttttagtagagacggggtttcactatgttggccaggctagtctcaaatgcctgacctgaaatgatccacctgcctcggcctcccatagtgctaggattacaggtgtgtgccactgtgcctggctgatacacaaactcttaagaaaacaaatattgatatccaaaacattttaataattacattgaaattttctattgcagaaactgtgtttccaatctaaattattaattaatcctaaccctttcctgctctgggtttgtgtttttgaattcagtacatcatcttacagtttttgcttttgttaaaatactggaaataattttgaggaagaaaagaaaataagaagtgatatgtcaccttctaaattgtctttcctaacttagaagcaaattcgaatgtctctagtatggcttttctctccttatttcccctatcatcccttttctcacacttctctttatttaaaacttgtcttcaaagcacacaaaatagagtcgataagagtctatccagccctgatttctcttggccaaggaatgaaaggctgttctctaaaccttgataggtaaggaatagccccctgtccacctccatcttagtctgtattgctgtaaaggaatacctgaggctggggatttataaagaaaaaaggtttatttggctcatgattttgatatctgtaaaagttcaagattggacattgacatctggcaagggccacaggctgcttccactcatggccgaaggcaaagaggagccagcattgcaaagatcccatgatgagagaggaagcaagagagagaggggaggtggcagactctttttaacaaccagttttctcaggggctaaaagagtaagaactcactcacctgccatccttacccccacagcccccaggatttctctattcatgagggatctgcccccatgacccagacccctcccattaggccccacctccaacattggggatcaaattttaaaatcagagttggaggcgacaagtatccaaactatagcacccacaaaccatctagtttatcttattattataacctgtcatcctaaaagttctcaaaatctggctgggcgcagtggctcacgcctgtaatctcaacattttgggaggccaaggtgggtggatcacttgaggtcaggagtttgagaccaacctggccaacgtgatgaaaccctgtctctactaagaatacaaaaattagccaggcatgatggtgggtgcttgtaatcccagctactctggaggctgaggcaggagaatcgcttgaacctaggagatggaggttgcatgagccaagatcacaccactgcactccagcctgggcaagcgtgagactttgtctcaaaaaaaaaaaaaaaagaaaa

SEQ ID NO: 11595 - DNA, 649 bp, Homo sapiens
aaaaaaaaaaaaagaaattctaactataattttatggcacagataaaacatttaggaccttaatttaaaaattaaaattctcagtgagcttaagataggcttgatcaagggcccaaagtttaagttcaaatacagaaaagaagacaagttcttacttgcctttatcttggttatgtgtgcatagataagtaaagttaaattttctacaagactttgatggaaaaaggataatttctagacaagagccagaattattctaggtcacttgggagagaatattatgtatgtaaactgaaagctaaaactgagggttttgaatgagccatttcatttaccataaccatttttagttgacataatcatggcttcagaggagaaagtgctttctacctttttcttaactttattctatagacagtccttcagtgagcggcatttacgcatggtctgcttcttcaattatgtatagcagttttggcaggcagtacatgaacttgaactctgttttgctttctgatcttctgtagctaataaaatcctaatctcacaggtctaggtcttagatggcattcccatccttacactgttcatatcttatatacactggacttcaagtgcagtgcccacttagggatcttcgtctgagttt

SEQ ID NO: 11596 - DNA, 415 bp, Homo sapiens
gcagtaagcatgcctgctctttgtccaagagggagacattacctagtctttcaaatttgctctgcaaacacaagcctaagaaaaggctccggtaaagaacagtgagattcttgtattcctgacatgaacagcaaaaatgtgccaggatgctcaggggccatggcagattacctctcccaacagtggatcccttgaaaggctcttgggacctttaaggatcctggaccatattttgagaaccactggtttaaccagattataatttcctgttagaaaaaaatcatattgcctttttcttagtaagttacttttcatcctcctgaaaaaatgtcatgttctaagaatattccagcatctcctcaggaacctttatttgtacatggaggtcctaatgcttcctcatcagttcttttca

SEQ ID NO: 11597 - DNA, 415 bp, Homo sapiens; identical to SEQ ID NO: 11596

SEQ ID NO: 11598 - DNA, 642 bp, Homo sapiens
aaaaaaaaaaaaagaaattctaactataattttatggcacagataaaacatttaggaccttaatttaaaaattaaaattctcagtgagcttaagataggcttgatcaagggcccaaagtttaagttcaaatacagaaaagaagacaagttcttacttgcctttatcttggttatgtgtgcatagataagtaaagttaaattttctacaagactttgatggaaaaaggataatttctagacaagagccagaattattctaggtcacttgggagagaatattatgtatgtaaactgaaagctaaaactgagggttttgaatgagccatttcatttaccataaccatttttagttgacataatcatggcttcagaggagaaagtgctttctacctttttcttaactttattctatagacagtccttcagtgagcggcatttacgcatggtctgcttcttcaattatgtatagcagttttggcaggcagtacatgaacttgaactctgttttgctttctgatcttctgtagctaataaaatcctaatctcacaggtctaggtcttagatggcattcccatccttacactgttcatatcttatatacactggacttcaagtgcagtgcccacttagggatcttcgtc

SEQ ID NO: 11599 - DNA, 1519 bp, Homo sapiens
tctgcctcccaaagtgctgggattataggcgtgagccaccatatctgttctactgtgaacattttaatgtgtttttttggactttttctaaatacatgcaaatattatgtatgtaggtatgtctgagttttttgggttttgttttgtttttacaaaaatgagatttcaatgttctctttacttgtcaaaatgtgtgtgcagatgacagttggaagagatgccagatgtaaatttacctccctcccctccctctgaggcttgcttgccccatgctgtggttctgtgtgacctcatgacaggagagatttctgtggcattcaggcaatgcagcaggggtctggccactgacacaacaaacttgtggttttcaaatacaagtcatacagccaagacacaggtgcttgggtttcagggcctggcatagtccagtgtctgattgatttttaaccagctagtgaataaatttgtaataaatgatccagctgaagatctcaatgatttaactgcaatgaaattgcaatgaaacttcccagtggctaaaattttgtggttcacatttgcactgctgttagcacaaaaggtaattatgatgtgtgtgaaaaatggtagtctgattagttgttcacacacacaaaggagtgcttttcacacatcttaattgcttttctgctaaagaaagtgtaactgcaagtcataaaattataacagcctctaacacgttaattccatttcatcagcggatgatgtatcttgaattttggtgaaaagtgactttagaactcatattgatgaggaaagttgaggttaagatactgctctcatagaagacaattataaaaaattatagttcatactcataaatacacacgtctctgtacagaagtatcgtgaattactattttgggatagtgtcttaggttttactttcttgcatttcgttacccacatggaccagtagattaacagaaaatatggccccagaaagaaagaggatacaggctaaagaagtaaatcaaagaactcgatagcttttctgaaggctaaggtagagaaaatcatcttgaaattcaacacttagaagagaagaaagggttttaaagctgcataaaactaagaagaacctgaaacaggcagaacaccagagtttctatcagagagtaggtaaaatggctagttttttcaccactaagaaaggagataaaagtttctccagcttaaaggagggagggattaaaagagacctgattagtgtctacatgctgcttgcatcccagagatgggcagcaggaaccccaaaaagctttaagaagatggagaatatggggagttttgtttctattctcattgtatagccaggggaaactgcaagtctttcagagaaatgccttgtccagcacagtggatgaggaaagatctgagtgggtggaactgagaggagcctcacccctatgtcagaggcagaggcgtttaaaccatagcaactccatcttgaataggggctgggtaaaataaggctgag

SEQ ID NO: 11600 - DNA, 246 bp, Homo sapiens
ccaggctggagtgcagtggcgcgatctcagctcaccgcaaactctgcctctagggttcacgccattctcctgcctcagcctcccgagtagctgggactacaggggcccgccatcacgcccggctaattttttgtatttctagtagagacagggtttcaacgtgttagccaggatggtcttgatctcctgacctcgtgatccacctagctcggcctcccaaagtgctgggattacaggcgcgagtca

SEQ ID NO: 11601 - DNA, 18370 bp, Homo sapiens
tctggggagctatctgtgggaaaggtcagggcctgtttttctcctaagctgctggctgttcaagggacctacctccttgtcccttcccagtcacaggtccaaggggcaaatagcgaattcccatggaggagaatcactgcactccaagtggacgtggctggtaggtaagtgtaactttttctgctgctgttcagtggtactgagagacaggaaagccccactgctcccgccccaccctttgtgatgggttatcaatgacagctaataaagccacctcactgcttcctcatgccagcccttgacccacaaacactggaggagacctgcctcaggtcccatcccccaccacaactgggctttagctgaaagttgtgggtttctgaacttcaggaataagtctttggggacattcgtttggccaagaattcattccctcatctgcccaagagcagctgccctaggtgataggcaaaagccacatgaaagccacatcccacagctcttgggcgtcatttattttttgcataggcataaattaggatctggagataaaaaacttaagaaccaatagtgcagcatttgtgacaggagagcgcaaaacaaaccctggctgcctcgggatggagcggggcggcctcaccaccactgcatccagcctcatgctccagagcggatttgaggctcagtgctgcagtgaaggcctgcccgccttcttgccccttccccgcagccagaccaccagacacagccggaaccagtgccccaggcccctctccacggccaggaacaagaaactgagtatcacccagtgccccacagaacggggctaggaatcaagcccttagcttttcagttagaaaaacagaccttgaaaaatatatacataatacagtggggcctgctggctctaaaagtcccctcctcccccttccctatccagggtaacttctgccagcctcttcccccagcccccaccaactgccccacagagaacaaaccagaagggcgactacctgaacaagagctgcaagagcccaagggggcagcctgagcggacgacccctacatcagggcctggttagatgtgggggccggtgcagacagacctcgcaccccgataccctgaacgtccccacaagagcccaggagttccatgctccccactcttcttgctataaccccagatgctaatggccccaaagacaggtctaggtctccataccctgggagaatgtggaaagcaagctcaggggcactggcaggccctagcaggaacagggagcagggtgggccccaacctagcatcaggagagagaaaagcaactaccgtccccagcagaggggaagcctacagggttggccctgggccccttagaagatcacagcagccagtcccctttagggcacaagaagccccatggcccactgctaccctccccgggacaaatacacacttttgtcgaaggccctcagggaccctgtggttcatgcttccctaggtggagggcactaaccttgtaggagagctgggcagctctccatcaagtgcttcctgcctggggaagtcccatcctgctctggagctaagcaccctcctcccagagggcctcgcttccttgcccaggggcagaggcagctcacctagcccaggccgtagcttgcccctcccacagccctggcacctgcttcatcagctcccaggcaccagcccctgaccccagccaagaccagtcaggtcctacctctcccaacttcccagtcccccatgatatgctacatatatacacactcccaggatgggaagcagacgccacgggcacagagggaaggaagaagggagctgctggagcctgctaaccgcctcgagccacctgctgctcaggagaccctgcccgtccttttcatctgcatggggccacaggctcctctcttgtgctcctagaagtcagagcgccgagcaagcgtgtgggggaagcggcggggtgctgttcacccactcccagatggctggcagcaggcaccagtaagcagggctagtgggcgggctccccatgcactctgaagcggtagatgcaggtgtactcggggtggccccagttagtcaggatccgcagctccaccacctggtacgtggccatcgtaggggcctgggtagagaagaaagggattaagagcatcagagacctgtgaggcctcactgacagagaaggtgggaaggggagacagcctcgcctagggccagatggctcccctgctccttccctggggctctgaagagaaccaggcttcaaaagctcctatctttagcctcctgagcagtgtttccagccagtgggttaaggggccacctgtagcacacttcatctgaaaccggaatgaattcatccacaatcgtttttttattgtgatcaacagatagaaccaccttcatagagggcttcatagatgctgatgtggggcacacttgattctttttctccagtgcccatcgggcctctgtctagccacagtgttgggaatggtgttagcagcatatcttacctgggcagatgccacaggcctagcacactcctggcttgtcccttctctctggcacatcgttctgtcctctaccctctttttttgtttttggagacagggtcttgctctgtcacccaggctggagtacaatggtgtgatcacagttcactgcctcaaccttctgggctcaagggatcctcccaccttagcctccccagtagctgggaccacaggtgcatgtcaccacacccggctaaattttttaacattttttgtagagtcgggatctcgctgtgttcaccagcctggtcttgaactcctgggctcaagcaatcccctcgccttggccttgcaaagtgctggaattacagacatgagccacctcgtctggcctctatactttcctaaagagaaatcccaacctctcttgcagcctagttacctcctcagagctgatgacaactcagttctttctggctcccccgacagctccactggactgttccataggtgcctcagactcagccagacctgccccctgctccacatcagcccccatcgcagtggcttcttcctcccaccccatccaactggacattcacgaccctccctgctacgtctttgtcctcactcccaacgcccctctcccccacctatcctgttctggctgctttccctcaaccacttcctgacgggtctcccaggcccaggctcgccccttcgagtcatatagtgatgttagtcaaatggacatagctttgtcacctgaagcacagcactgcctcccccaggtccctgagggcttatttcctgcctctctgtggcctcctcttcctgccactgtccctcgtccacctcccactatcccgccaacccaattcctcactccaggactcccccggtgtggggcttaggccaatggtttgttcaaatgcaggctcctgggtcctgtcagccctaaggaaccagactctcctggggtggagactgggaatctgcatttctaactgacttaggagatcggatgcccactgaagtttaagccgcatgcactgcctgaggctccagctggccatggtagaatgcccgcgccctggcatgtgctggcggcggctcctcgaacgcctctcccggccttcctttcctggccacccaacccctcttgtgtaaagcccacctcctggtgtccttttccaggaagcttccctcatgctgcccttctggaaggtgccttcccctgtgctgacgtctgcaggatgcgtgttacaccccatttggatatcacatcttgagctgtgggaaaggagagcagggcttccctctctgaaccccatgcctggcagggtaagtgcccagggagcacctgctgcctggatggggagtctgcgccacttctgctagcacagcagcatcccgtacctgaaagtgaaacgtctgaataggctcgccgtcctgatcgtaagtgaacttgccaaggagtgtcccctcctgctgcaggtcttcgtcaaacccctgcaaagagagcggagggaagtggggaggggctggagcagggagaacacccctccccactccaatccctgctcctcccacccagcaggtcaggcaccagagtggcctatgacaagtcacttcactctcttgtgccacagtttctgcctccaaagcctaaggtaacagggactgaagtgctgtctcccaccctagctcctcctcttccaaatccactcccctcccttccagtccaagggtgaccctgacttgatcctcagtagagaggcccacaggatccccctgcagcccctctggccccaccacaggacagatactcacaaagatggcgaagtccttgggggcactggagatagtgctgttgggtgacaaggccttgggcacatgctctaaggtaacggctgtggggcggatgcgggcagagaggcggaccacggcgaagccttgtggcccctggaaggcccagcagttgcctgggtgcacatctggctggaggagcagaaagtcatgtcaggacagggccctgagtccagctcttgctgaccccagatgggaccagccctcagtgtgctcagagcccccgctgctgtgcttgccaggtgcccacctggaggatgactcggggtgactgggagtggtaccacagggggatgccgaagaggctgaggagggccgtcttggtctcgtaggtctcagaacatcgggtgctgatgacgctggcccctgagacaggagaggaaggcagggtgggctcccgcacgggaggagggccccgctcaggccattggctgtctcctcgctgaaggtggacggcagatgccccaggcctagcctttaaccctaaccgagatgctcagagcagctttaaaggtcagcctctccctggcccaggatggtactcggtacgtcctgacttccctgaattgccacttgcctttgtcatgggtactaggttgggtgatttctgctgatcctgagctttgcttgctctgccccaccaccaacctggtagatgccaggggaccggccattgcggggtccaggacaaggcagagcgaggaaagcagagcacgtacctcctgactccagggcgtagtctgccagcccgatgcggtcctcactgtagcgctgcagggcctgcttcacgatgtggtgcacctgctgcaatgcaggcaccaggagacggttgcagcagggagcagacgtgtccccctgtcacctcgtggccgtgggccaaggacccatgggctgaccccttctaggcttgcactgtgctggtgcccaggcagatgtgggcacactgccacccacccatgccagccccacagcatgcaaagcctcctgcttggcacttccatcctggaacctgccagggagctggcagtgtgggactgtccagggctcccagggaggagagctgtgggtgggtgtgtggagaggggcatgtgggcctcacctcctctgtcactccaatcacaccttctttctgcagcgtcaggctcagggaggccgcggcttccctggccgacttgccctgcatctctgccacatgggtgaggatcttgctctccagctctcgcagctgagcttgcatctcctctctctgaaggagccccacgcggccccctccacctcgggcaaggaactgactgatccaggccgggaactgagattccacctataggaacccaaaggggtgtcaccctggggggcttgcagggacagcaggagctgctatgacagggctagtgcttagctggatagcagggatagggtaggagggaggccactggaggaaagagttatgaacactccatgggcactaacaaaaacaggaagaacgcctgtcagtgagagcccacatgtgtcaaggccaacgccacagtctcttgggcataacagaggctgcaggggcaaggggtgctgctttgcaggccccaggacacgtcgtctcaaaggaggaggagagggaccagcagggccctggtggttcccactcacgtcgtcccgcacggcctggatctgctggggcagcaggcccacttcttccgccaccgagctctgcttcagtgccagagccgccagctcctgctgcaggccggccagctggtcctccagccgcctcagctccttcacagagctctcctggaaggactcctgggtcatgctggtcccagagagagaagagtaagcctcggatctctttggtgggaggtaaggccacaccaaagatgaaagaggaccccctagtgggctcccgtcaggagagcgggtgcccagcactcattgtgaacctgagaaggggcaaggcctctcctgggggttctggctgcagaacccctgcctgtcccaaggagctaattctgagcctgctccctttctaagcccagagtccagaatgtactctgcctcagcctctcacatcctccacaagcatggacatctggggcatgagaaggcagttatgtgaggctgtaagaaaggatgctgtgtctataaatgaatcccggtcctctcacacagcctgccccccgccctcaggacccccctgctaacctccatggcacctcaaagacaggccctgggcaggggtcctgagctgggtttcaacccctccccctaccatctgcttggcaagatgatcagaactctctgctctgcggctctgctccccagtcctgcctggagagtgggtggggctggggaggagcaggccgaggccagctggtggcgcccagtacctttgccactctgacttcagctgctggatgcgagcctcggactcctgtgtaggaagaagggacaaatacaagaaatactcatctcagaaattggtgttccagagtaggatctgctgtctgttagcgtctttgcttaaccacacccctgcccaaggtctcttgacccctgcagcaaaaatcaaactggcctccttgtcaaagccctcatgagtctcgtccatgtctgacacactgaggtatctgttcacccacactcagcacatgcacaccagcatgacaggccgctgtgccctggcacaccccagggagcccctgcacagctctccaactaaggggtcgggggtcaaacagagaagtcagaggagggcactcccctccccatgcaacacccaaacagtccctttggaagggccgaggggtccgaggtgaacatgttggatggggtcaggacccagtcacaggccctgagtgccgcaagcccgctgacctgggaggcccggacgatcttcttgaagaggtcttctgagtcttgctgatgctctgctctcagggcagacagttcttcctgtgagacgggagtgagaggacaggttggacagagccatgcttatagggaccctcatgactaggaagtggcggaactggaattcaaacaaggtctgtttgcttccagagccctggctctcagccttctctgaaccacgcaagactcccgcttcagctccactgcacacctctgcggtgtcaggtaccatgctggggctttctactcgcacagctcactatgggggtgggggagacacgatggcctccatcaaagagcaggaaactgaggcttagagaaggtgaggaggcctggcgtggtggctcacgcctgtaatcccaggactttgggaggccaaggcaggcagatcactagaggtcaggagttcgagaccagcctggccaacttggtaaaaccctgtctctactaaaaatacaaaattagctggatgtggtggtgcacgcctgtaatccagctactcgggaggctgagtgaggcaagagaatcgcttgaacctgggaggcacaggttgtagtgagtcgagatcacgccactgcactccaggctgggtgacagagtgagatattgtctcaaaaagaaaaaaaaaaaagaaaaaaagagaaagggagtaactgcaaaatggcagagctgtctgatcccaaatgacacttgttctctctgctgctgggcaccttcacgctttcctatgggtgtcacccacctcccaccctgaggtattccacctcctacctggatgcgagcagcagtttccctgcggaaatcctccttcagggcagcttcacggcggctcactagcccctccagcagcgccagggtgtcctcgtggctcaggccaccaccacctccctggccaggagccccttgccgcagctccagacgttccagccgcatggcctccttctgccagttggaggaaaattcagcagcaagagcttccagacgccgctccagagagtgtacccgggacataacacgctgctcagcctggaagggcagagagagagccacggagtgagggacccttggatgatagtgcttcccaaagaccaccccgacacagccaacacagaaagaaagggaaaagattccagagacgttccagcataaggccatgcagggccggctggagctcgtgggcaggggctgccgacctctgagctgggtgtgctgggagccagggatcactgggtgccggccacagaggaaggtccctgaggacacagtaccgaagtctgatcccagaggaggaaggaaggtgggccggggagaaggtctgagtgcagggatggtccaggaggaggactggaagctgcaggatggctgcagggggccgtggaccctcctggcctgaagctcactccttccccgcctcctacaggggcaggggagccagggctgcgagttctgtctgtggactctcaatggctttcactccttccctaggtaactatggctaagagacagaataatttgaaaatacgttctttttcctctttagctggatgtcccacagagaaaatggaataaatgtcatttggactgagggtggcatttgatagtgtgtcatgaatttgagaatgttgttggcttaacaacaaaatcattgccaagagaagtgataaaaactgtcaaataaaggccagggagctactgagcagcagaggttctgagttttagaaattctggtttttaaataggcgctacatttgcatgactcaaaaagcacacaaacaggcgggacgtggtggctcacgcctgtaatcccaacactttgggaggccgacgcaggtggattacctgaggtcagaagttcgagaccagcctggccagtatggcgaaaccctgtgtctactaaatatacaaaaattagctggagatggtggcaggctcctgtagtcccagctacacaggaggctgaggcaggagaatcgcttgaacctgggaggcagaggttgcagtgagctaagatcgtgccattgcactttagtctgggcaacaagagcaagactccgtctcaaaaaaaaaaaaaaaaaaaaagcccacaaaaaccagcaaaaaatcctctgccccatcaccccagttgcctcaccaacagcctctcccagaccaggaagctgtttttattttaacttcatgcaaatgttgctaatacaagatatattcatttttttaacttacccttttttacaaaaaagatggttctgaaattgaactgtatttaatgtctttaatggtgaaaaaaggaaaagtcatagatgacatgtcattattttgtaaaataataagatcatggtctggtactcactttggcagcacatataataaaattggaaagaccatggtctggaaagtaatatatacaaaaatagatggttaaacatgtgatgccggctgggcgtggtggctcacgcctgtaatcccagcactttgggaggccaaggcgggcggatcatgaggtcaggagacagagaccatcctggccaacatggtgaaaccctgtctctactaaaaataaaaaaattagctggcatggtggtgcgcgcctgtagtcccagctactcgggacgctgaggcgggagaatcgcttgaacccgggaggtgtaggctgcagtgagcccagatcgtgccactgcactccagcctgggtgacgcagcattccagcatgggtgacttagcaagactctgtctcaaaaaaaaaaaaaaaaaaaaaaaaagtgatactatgccaggtgcagtgactcatgcctgtaatcccagccctttggaaggctgaggcaggaggattgcttgaagccaggagttcaagaccagcctggcaacatagtgagaccctgtctctacaaaaattttttttaaaaatttgacagacatggtggtgtacacctgtagtcccagctacttcacaggctgatgcaggaggatcgcttgagcccaggagttcaaggttacaatgagttatgattatactactgcactgcagcctggacaacagaatgagaccctgtctcaaaaaatttttaaatgaataataaaaatgtaataccaagttaaattcagtgagatgcaagtgcaggtcaaataaccataattagaaaatgaagagttttattaaaaataaagacagggcctcactgtgttgcctaggctagtctcgaactcctggccttaagtgatcctcccaccttggcctcccaaagtgccgagattacagatgtgagccaccaggcttggcttagaggtttaaattgtcagtatcagtacctgtgctcacattgctttctggttatgctgactgcaggctccttgagggcacagcctgggcctgattcatctttagactctggcagattataaaaatggccaccatccctcactcctccctgcagccgcacctctgtcatgtgaccttgtgggctctcttgctgagaggtgaagtctatttccctctccttgaatctggatttggctctgagatttgcggtagccaacagaatgtggcgggagtgacggtgtgctggttctggatcaaggcctcaaaggtctggttgccttggttctctcttgaaaccctgcctgggtgcgatgagaaacagctggggctagcctgccgggtgagcaaagtgcacatggagtacagctgtcctaggcaagggccttgaccagctggcccccagctgacccccccagccaactgcagacagacagatccacacaggcaagtacgagcccagccaagattgcttctcttttctcagaccagaaagaccacccagacaacccacagactcatgaactaatcaaccattgtagttttgagccactgcttttaggggtggattatctttggtaagaggtaactgactgggatattatcctagtcatagaaggtgcccagtaaatatttgtgaaacagcattgaaaaggaacaaagcagacaagataatttgttggattccttttctttctgttttctgtgccttgtaagatggcaactaacagtacgcctcagctttgtgtgtacggtgtgaggcaggctgagggcgcacccaccactttcaccgtcacctaattattgctaagctcttgggagctaccaccctcagagactcacctggaaatgtggcgatgagtctctggcttcccagccctcatccggcctcctgctgtccttcgctgcccaccaggaaaccaaagcagggtggaatgtctgcagcccataggggtagaaataccaagcacctgtgcacaggggagagggtgttaccccagctgggcctccagcaagaggcgcgcgccagggaggatggctacctgatccctgccagtgcttgtggcctgtcccactcgtggagctgtgcccttccagaggcatcagagggatgcaggtgcccccattctctgaggtggcaacttccacccaacaacctcagagcatattcattctcacacccccacgggaatccttcatctttctgtaagtggcaaaacttggagaaaacattttgaatgagttagggatgatccagggtacagcccagaggacctgatggtggttctcagccctgtctggtcgtcagaatcacctggggagattttagtacaaccaggtctggccctgccctctggagagcaagctaattggcctggggtggggcccctgcgtaggtgagtttgtaaagcttcctggtgactgtcatgggccgccatggctgagagtcactgcaacagaaagcaccaccccctctaagagaggctgctcgaggcccagacacgagcaccaagctgcagccacacagagacatgttcattctgttttcagggccatctgtttgatacctgtttactcctgagctctggggcaggtggcaggggagcgggggagggagggctttctgtcctgataaagctccattcgctactcaagcaccagaggttggcaggtgcaaaaggaagctcatgcccatggggcttgaagtccagcatggacatggccttcatgcacacactccccgagcaggtcactgagccccctccacgtgcatctccatgtgatgggttcacagcactgactacagcaaccccacaaggccatggtgaagctcaaattgaactgagataatgcacgggaaagtgctctctgggtacattgctatgcaattataaagaatcactgactgggccgggcgcggtggctcacgcctgtaatcccagcactttgggaggccgaggcgggtggatcacgaggtcaggagatcgagaccatcctggctaatatggtgacaccccatctctactaaaaatacaaaaagaaattagccaggcgtggtggcggccgcctgtagtcccagctactcgggaggctgaggcaggagaatggcgtgaacctgggaggtggagcttgcagtgagtcaagatcgcacgactgcactccagcctgggcgacagactccatcacacacacacaaaaaagaatcactgactgggcgtggtggctcacacctgtaatgccagcacttcgggaggccgaggcaggtggatcacttgaggtcaggagtttgagaccagactggccaacatggcgaaaccccgtctctactaaaaatataaaaattagctgggcgtggtggcatgcacctgtaatcccagctactcgggaggctgaggcaggagaatcgcttgaacccgggaggtggaggttgcagtgagccaagattgtgccacagcactcgagcctgggcaacagagcaaaactccgtctcaaaaaaaaaaaaaaaaagaagaagaatcattattattttaagggtggtgctcagttgccactggatatgaaccagctgttcttgtagcagcaaacacaaaaacgaagctaacttttggaaaagtgttctaccctgttattaataaaagaaatacaagttgaatgatattaagcttataaaacaaactctcaaaaaataataaagcatggtctttaattacttggtgcagtcattaaaattgagctgagagtcacataggcaattcatatgaaactagccaagctgtcaagtaaaaagctgaacacaaaatgtctatataaacaaggaagggctgggtgcagtggctcacacctgtaatcccgacactttgggaggccgaggtgggtggatcacttgaggtcaggagtttgagaccagcctggccaacatggtgaaaccccgtctctactaaaaatacaaaaattagccatgtgtggtgctgcatgcctgtaatcccagctacttgggaggctgacgtgggaggatcacctgagctcagaaggtcaaggctgcagtgagctgtgttcgtgccactgcacttcagctggggtgacagaagaagactttgtctcaaaacaaacaaaaaaccaaggcaggcctgtgctagcgcctgggatgattcaggacagctggtaagtgactggtgtaaaaagaggcacttatggccgggcacggtggctcatgcctgtaatcccagcactttgggaggccgaggcagctggatcacctgaggtcaggagttcgagaccagcctgacaacatggagaaaccccatctctagtaaaaatacaaaattagctgggcatgttggcgcatgcctgtaatcccagctactcgggaggctgaggcaggagaatcacttgaacctgagaggtggaggttgtggtgagctgacatcgcgccattgcactccagcctgggcaacaagagcaaaaactctgtctcaaaaaacaaacaaaaaaggcacttatttccctttgctgcttcattgtttttactttaaagacagctcaagatttaacttcatcttgtaaaaataactccctcatagcagatgtccctgttggagtggaaggaggatgactgctaatgataatgggagggcatcccgcttttcacccaatgttgcggcactagggtgtgctcctgcccagggcggcacaaaagaggctcaggagaggtggggagggccatgcagagatgatccagggtccagggctcaggccctgcccagtcacaggcacaccccacccagtcttgccccttccctgcctgccaaaggtcaccaccctctggtgaacacatctctgtgcctccctctgctctccccatgcaggctcaccatacgtcaggcacgtcagcaagagcagcggcagcaggaaccagaggaacgtcttcagggacgagaagcgcctggaccacgcgggagggcaggacgggggaggcggaggtgtgaggggagctccaggcctccacgttccacccagggagtaccctgagatgttttcctgggtgctgaactagagctaaggaggatagcttgagcttctcactgtgccagggccagcctggacacgtcagagcctttcctgctgggcaggtcttagagtgatgggacaattttgactgaattttactgatgttattaaaaatagtgtggtctttgaaaaactcaaaaatttttatatggacaggtcctctaagtatgcaaatatagaaaaaaaaagtaactccttaaataacaacaaggaacctgtttttggtgacacaaacccatccttgccccttgtttcagtatggccagctgtcccctctgcccggacctggattacggccagagggatcctgacttctgggttccgtgttcttctgcctaaggggcacattctcaaatcctggttctgctggtttagggacttggggaatgaacccatagcatcctcaggcagagcctctttgtggctctgaccatgagtggggaactcggggggttagattgtcccaggcccaagaaggaagatggactttctgggaaaccccacttcttgcctggagtcagtgggcctaccctgcaggaggaaagccatcgtgtgtctgagagccaggcacggctagactagtgtggcgtttagtagaatgtgtccaagaagaaataatctgtgctctggaatcctgcctcgaagggctatcaattcggggagaagaacctgactctgagtccatcctctgtcaggcaggggtgggctttggggaagctactccgtgatcgctaataaaggctccagggaaactggggaaaaccctcagagaatcgaccattacaggttgacacactttacccgtcccttcaccccagggccttgcgatttattggcaagggtggagtctcgctcacctggttaaaacgaagacgtcaaggagggaggcagctgtggtcaggcggtaccaggtggtgccagcccaccagtagagaagtctgaagagccggcctggaagaatgaccatcaagccgaaggctccatatggtgtttgggggcaccgctcctttgtcccgtctgccgtcctccctgcccctaccccacccccacctgccagtatgcctctgtcctgccctaccgggacccaggtccttggatcccacctgcccacaccctctgtcctgctctgcagctactccttcccttccacgcaagggggtccccacagctctgggctcccagtgattattctagaatgacctttccccaatggtcctacagtctctctgcatgggcaggatgcccaactgcagagagatgggtaagaaagcactatcaccaagaatggaagtaactgggcacgggttgcagcccacctggcgaagtggccaccatccagagtaaggagcccgcccgtgagacggcgcttcggagccgcgagctggaactctgctggtccacatccgagtagcctgcggggaacgaggacactggctcagtctctgtcactttcgagcctcttccttcactgtcttctgtgagccaagaccacaagtcacccaccctccttcacatccccacagccccacacaggcccggtgtgcagtaaggaatgaaatgggagctctttgacattctgtttcttctgacagcttcctgtttgcatccctctcctcaccagccacccctcaagctgctgttcagaactaggtgctggggtctgacatgcacaccactcagaatgactgagcacccaccatgtgtgagccccacaggaaagtgctggaatgggcctgaatgcaaggatgttggccttaggttgccatagactcgtggggtggggaggacagacaagtgaagggcagtcacagcccagggcaccaggggccaccgcaggccaggctggggcgcacccagggccgggcatgggaggggcgctgtgcctgccacatgctgccctctctccagctccccggggctccctgcccagccttcctgaggcctcccagcagcctcggatctgctcaggagggaggaagcatcgcctacccacgtagtcgtcctcagaggagtagcccgaggaagagcccaggaagtcctcggtggccttgcgccccacaagcccgctggccctgctgctctctgagccacccgtgcctctcctcctccgcacccgcaggtcctcacctgtgcagggaagaaccaggggctcttctgggcctccaagagcttctgaaaagtggggtctgggcagagaggtgctctgaggagggaatcccggggactgcaggggacactgtgaggagtatctcgcgggaggccgaggaagcaaagccccgggacggagggctccacactcaccccagttggcgtcaccatgcagttcctccagggagctcctgggtgggaaccaggactcgtggaccagcgactcactgtagtaggaggtgtgtgcatcagaggacgggcccagctgtggcgctggggacaggcgcttcatgttgctggatttcctcttcaaggtcctgtgggacaaccatgagggcagaggtagggagcagggaggtgagcccagccaggagcatgaaggaaagccacagcctgcggccctgcctagtgcagggtgtgggttcccttgttgctaggcaactcgcagctgccattcccctgactctcccaatgctggcacgtcctctcctgttctctctgaatctcaccagcagatgggcaagacgggcagcggcagctagggatggagccacattcaaactttacaacccactgaaaccagacagacctgacctggcctcagagctagccaaagcctcagggcctgtcttctgggccccatgcctgtgagccgggcaggacgaccaggcagctgctgccacagcccatttcccagtggcctgaggactgcgcctgttctcagccatgtcgctggccagctgctgaggccggacaggtggtgagacatgcaggcgtggggccaggaaggatggtaaggctgacacgcccgtccagagcagggggggttcctgtgagcccagcctgcagttttggggtttccggcctggcttatggttgaagctgcctctctccacttcctgttttctttctttcctttttttctttttgagattgagatggagtttcactcttgtcaacccaggctggagtgcaatgccatgatctcgctcactgcaacctctgcctgccaggttcaagcgattctcctgcctcagcctcctgagtagctgggattacagctgcctgccaccatgccgggctaatttttgtatttttagtagagacggagtttcactatgttggtcagggtcaggtgatccacctcccttggcctcccaaagagctggcattacaggcgtgagccaccgcgcccgacctaccacttcctgttttctaagcatgagggcagcagccccggctcacagtcggtgggagaagaatgggtgctgtgtgctcatacacatggagcaaggaaggaccccctcgaccggacgggggcccacgtccttcgatttccacccaaggttgcaacaagaaggcagggggatggctggaccacagggcgtgcgggcagtgaccaaaagcttgtggggctgtcaggggccgtggcactcccttgggtccctacctgagaggactgtctttaaacagggtgctctgactcccagccaccgagctccctccgctgctgctgctgccgtcatcgtcaccctgggagtagcgcg

SEQ ID NO: 11602 - DNA, 16951 bp, Homo sapiens
agggtagcagtggtgggcaacgtggatgctggcaaaagcacgcttctgggggtcctgacacatggggagctggacaatggccgaggctttgcccgccagaaactcttccgccacaaacatgaaattgaatctggtcgcaccagcagtgtgggcaacgacattctgggctttgacagtgaaggcaatgtagtgaacaagcctgacagccacggcggcagcctggagtggaccaagatctgtgagaagtccacgaaagtcattaccttcatcgacttggctggtcatgagaagtacctgaaaaccactgtcttcggcatgacaggccatctgcctgacttctgcatgctcatggtgagtgggaggcgccccaaggaggggaggcgtcagcagggctgcttgggtctggttatgtgcaagtctgaaactgttctgagactgaggcctgttggtttggggctttgacatcgggtgaggctggcgagttttgcaggggtgcccagtcctctgagtaatggtcttctcaaggcttgaaccttgatctctcccttacattagactagggaaggtatcctcttggtaaaaaccaggtacccttgaagacctgtcttattttttgcagaggcatagaggagggtttctcctgggccttacttgttaccttcagaaatgttttctgcagaggattgggctactttgaggaggtgacaccaggtaggtagtaccttcagaggggcaggcctggggaagaaacggagaagacagccataggaggcacaggccacagtcgagaggccctgagaggtggcctcctggagcctgggaggaggatcggccagtgcacagcccttgttgagaggctcctgtgtgtctggtactatgtgaggtctgatgatacagcaatgaacagggctgtccagaggctcccaaaaagcttagggtcgagcgtgattaaatttttaagcagctattcctgctcggaacattaaaaacaaccaaaaagtgtttaagcagctcatctaatagattaactgagaaagaaagggagcagagggctctgtgttggatctcattgctaagcttgcctttgtgacccactgatcttcctccctggacagacagtgggagtgctgaggggagcggcaaggcctgtaaccttgtgcacatctccacagctttcacagcaggagtaaggaagagggagggcgggaagggacagagtcagagacacacatgcctcgagtgttccctcggcaaggccttcccaaaacccttccccatttctcgattccttcagctgcctgtattaataaatgtagtaaacataagcatctgttcatagcaaacttgatcaagttgctgcacaaacacaggttctcaagcaaattctccctaaactggagagcagtaaagagaggcagagccgtgtgaacactcgtaggctctctgcctgaggcttttgggacctcagcatgccttcatttcccatttccttcaatgttgcaaagggccatgaccagcttcttgactgggctgaggaaagctgcttgccaggaagggatcttagtggaagatccagagggcgtatttaggggagttgttgggttgatattaagaagggtatagaaactggttgagaataagcatttttccagctgagctacagtgagtaagaccaattaatggaaatatcttcaccctggacaaaatgttacatatatattatctgactttttggttgtgatccaaatgttaacctttctgtagaaaacaatgaaatatttcattatagtcccatggcatttgacttctaggaaaaaatatttaaaatatatagaaaacagccgtagagcactctcttctccaggttgggaagagcaaaagcaagtctgcattgggttggaaaggtggccgaagggcacaggaagacgtcgggaagactgtggaagtgtcctggtggagggagagggaagtgccagctggggtgactcatctaggagccatggaaactcagtgggcgtctccgtgacacactggaatggatagggcactgtgtaaacacatcatggcagcttttctttcaaattttcttctggtttagtatggtacaaaattgtgaaaagtttcctcccagaggcaaccagtgtttccagtttcctgtgtacctgccagagatattttgtactcagatcagcaaatgtgtatatgttctctccctccaattttaaacattcagaaaaggtgaaagaatagtataaccaataccataaatccaccacttagatttagcaatcattaacattttgccatatttatgtgtctatatggtgggtacatatgtgtatatatgttttttatttattttaattttttttttgagatggagtcttgctctttcgcccagactggagtgcagttgtgcaatctcagttcacttcagcctccgcctcttgggttcaaatgattctcctgtctcagcttcccgagtagctgggattacaggcacgtgccaccacacccagctaatttttagtatttttagtagagacgaggtttcactatgttggctaggctggtctggaactcctgacctccagcaatctgcccaccttggcctcccaaagtgctgagattataggcgtgagccaccgtacccagcctgatttaatattttttaaagagacaaagcctcactctgttacccaggctagagtgcggtggtgcgactgtagttcactataacctcaaactcctgggctcaagggatcctcccatctcagcctcccaagtacctaggaccacaggcgtgcacaaccatgcctggctaatactaatttttttagagacgagatcttgctatgttgccaaggctggtctcaaaactcttggcttgaagtaatcatcccaccttggtgcctcccaaggtgctgggattacaggtgtgagccaccgtgcccagccaagtatatatgtttagtttggttttttttttttgtggctgaatcacttaaaaatagtggacatgtcttcatcccagacaaagtcacaatgtagacattgtgacttttcactgctaaacacttcagcatacagctcctaaaagtgaggcctgtctcctactgtttttacaatcaagaaaatgaagaatagttacctaatatcctcaaatatttagtctgtatttatattatttcagatgtttcccaaatatctttcagctgctttttttaagccatgaatcagtcaccagttatcccccactgccttttattttctttctttctttttttttttttttttgagacggagtctcgctctgtcgcccaggctggagtgcagtggcgcgatctcagctcactgcaagctctgcctcccgggttcatgccattcttctgcctcagcctcccaagtagctgggactacaggcgcccgccacgatgcccagctaattttttgtatttttagtagagacagggtttcaccatgttagccaggatggtctcgagctcctgacctcatgatctgcccgcctcggcctcccaaagtgctgggattacaggtgtgagccaccgcgcctggcctttattttctttgagatggagtctcactcttgcccaggctggagtgcaatggcgcaatcttggctcactgcaacctccgcctccttggttcaagcgattctcctgcctcagcctcctgagtagctgggattacaggcaactgccaccacatgcagctaattttttttttttttgtatttttagtagagaaggggttttcaccatgttggccaagctggtctcgaattcctgacctcaggtgattcacccaccttggcctcccaaagtgctgggattatgggcatgagccaccatgcatagctgaacactcacctctttttatgatagcattctatatgcaacttactttttttttccccttaaaagcatattttggagattagtccatatcagtagataaaaatttcttcttttgtacagcacatttcatacacgtgccctgatttatgtaaccagtccttacggtgatatttggaaacatttattgttactggaaggatagtaatagtaataacaggtgcaattgcttaaacacctagttcctgctagttgtgtgctggacacttcatgtgtgttgtgacatttaaacatcaagtgaccctctgaagtggatattgttatctccccattttacagatggggaaactgagggccagtgatgttaagttgaatccactttttgttgttgttgtttatgagacacagtctcgctctgtcacccaggctagagtgcagtagctcgatcatggctcactgcagccacaacctcccaggctcaagtgatcctcccacctcagcctcccaagtagctgagactacagcgtatcctgccacacccagtcaatttttcttttttttgtagggtgggggaaacagagtttcgctcttgttgcccaggctggagtgcaatggcacgatctcggctcaccacaacctccacctcccagattcaagcgattttcctgcctcagcctcctgagtagctgggattacaggcatgtgccaccacgcctggctaattttgtattttagtagagacagggtttctccatgttgttcaggctggtcgcgaactcccgacctcaggtgatccgcctgccttgacctcgcaaagtgctggggttacaggagtgagccaccgtgcccagccttaatttttgtatttttttgtagagacggaggtcttaccaggttgtcctgcctggtctcaaactcctggcctcaagtgatctgccttccttggcctcccaaagtgctggggttacaggcatgagccactgctcctgacttggattcattttgatggctcaggacagttgtttccctgactgggtttatcttttttattgtttgcaagtctcctccgattttgacgccccacatcatcgagtcaggggttaacgtgatttttgcccagcccagctttcatccacatctgcttttgagcccctgtgtccacccagcagcaatctctttctctctcgtcctgacacttcctttctgtgttggggcaggtgggcagcaatgctggcatcgtggggatgaccaaagaacacctgggcttggcactggcactcaatgtacctgtctttgtggtagtcaccaagattgacatgtgtcctgccaacatcctgcaaggtaagtgaagcctccagctagcagcagcccctctgattggggctgtcacctgctgtgccttcaggtggtctgctaccacggctttagcccagaaacttcttttcttttttatttttatttttttattttacaatatgtttatttttattatgtgctctacattgaacacttcagcaaagaaaataattataataatttcaaaatgcaatccctggatccaataactatcctttataatccgttacactggtcagtatctagaaatatatgtagacaaagttagctaatgaataaaataagtaaaatgactaggtaaactataaatttcaagcatgagggatcatgcatgatcagttaagtcactctgccactttttaaaataatattcacatttgcttcaatcacataaacattcattgcaggagttaaatttgactgctgataacaattgaaagctgtgatctttgttagcttaaaagaaaattcagcttaatacaaagacattcaagatgaaaatttcaggacccttgatcagaagctttcaatgtgtgttgctccactttgttgtaggcaagcttcaagtaaggctaagacagaagagtgtttctactgaagatgtgatctaagaattgccttctacagaggcgaattatattctgtagaaactagctagccaccaagatgttaccaataaaggattccttatactagcaactaaccatgtttaaaaggccttagccatttagagtaatatttatgagtacaagcataattggttccttgccttctacagataatcatctataaaatgataaaagcaggcttcaactgtgtttcttctctggggtgagaaggtgcagatacacatgggtgatctactgatttaccttctgaaagtactctttggaagcagctggatttggcttgattgtaggagaatccagtgtccagtttgctgggcagacttctccatgggtttctacatactggaacgccttcaccaagtggagggtttcttccacgcttcggcccactgggaggtcattgacgctcaagtgcttgatgactccattggggtcagttatgaagagacctcttagtgcaagaccagaaccttctaacagcacaccgtagtctcaggaagtttgctcaaatctgacaagagtgggatgttcatgtggtccaaaccaccattatttcttggtgtatttatccaggcaagatgactaaagtgggaatccactgagaccacaacttcacagttcacatcatgaaattccttagctttgtcactaaaagcaacagtttctgtaggaccacgaaggtgaaatccaaaggatagaagaaaagcaccaaattatttccccttaaagtcatcaaggcttaggtctttgaactctccattgacaatggctgtacccttaaaatagggtgcatgctgggcgacagcaggtgcatggtatgaggagctggtgctaaagaattttgcttgactggaaccagaccataatatgtttgtcaagctcgttcttccagaagcagcaagcttgagggctgcagtggcagaaatgccccaaggaatggcactcacatgtcgggcagccgatgctcagagtagccttcccacagcagctaccatcttcagtgcacgcgggcgaaacttcctttgtcttgtacttaggtcttggcctgaatttccatcagcccagaatcttctgctacttcctcccctatttagttcttggtctgaacacagcctagaattatcctcttccttgttccttctggttccaaatgcagaaatcttgagatcctgaatctggcacctcttttcaggtgaccccaggcagaaggagttgggctctaccagctaagctggatatatacggggaagtttggacagagggtctgattaccttttgccaccaaagctttgacacagggttgcaggactaagccttcatgcctttctccctcactgctaaagattgtagaaaagtatccctttgggaagcctcataataagggtctctgtagacttctaaatgtctaagagatcctttttgttggatgagatttttttccaggaagtagtgcattctgagaactgaagtgtgaagtgaattgtttttcttggggaccctcaagtcacatgcttacaggaggcaggtcgtctagacacaagagaaatctgccaggtttcagacgcagaaccctagaaaagaggccccatctgtgcttttcttactctagcagcacccaaagttttgatcctcctttttgcttctccaggcattgtggcatttaacactggtccatctatctgtctgtctcctgcttgcatcagtaatgagtggacccatcttgctcttaaagcctggccaaagagaaggctgtgtccccctaattctgttccattgcaccctttaagaaaccctgaagctgttacagcgcctgctgaagtcaccaggctgccggaagatccccgtgctggtgcagagcaaagatgatgtgattgtcacagcctccaacttcagctctgaaaggtaacgcgtggggagcgcacacttcagacaggcacccttgcaggcaggaccacagtgagtgatgggcctggaatggctgtcagtttgggcataaggtctcatgaaaacaccacatcaacacctctccctattcagagatcggaggaaatagaagcttccaatcttagcgcagggtctcccaagccagcattgttgcccaggggtaatatcacgtaacccagattgtgaggtgctggcattcctggggttggcatcccggctgagacttcagtgtccttatctgtgaaatgggaataacattcccttccctgtagggctcccgtgaatgttggaaatgaagtatgtagagcacttaatgccctgcctggctgatggatggtaaatacacagccatttttgtaactcagttttttatactgttgttcctcaaaagctcactaatcagatcagttttggcatttactcattaatgtattctttcattccataaatatttattggatgtttgttctgcgagactcttcatctagatgttgaggattcagagttgaattgaacacaatccttgtcctcaaggtgttcagctccttggtgagagatgctctctcgataatggtgaactctactaactctgcctgtttgcccagagcttggtctatagcgccaggcccagagcagcctggctttttgcctatgcctctgccctgatgtgatcttcagtaccatcagttagcctgcagagggggcacatttcagacagccccatttgagcttgttgatattcttgagtgcctattctgtgcaggcactattctaggagctgtggggaatgtgtaattcgtgatctcaaggattttaattcagtcaccctgaataggagcaatagaggccatttacaggactctgatgaaaaatcagatgcagtcatgtgtaatagagaaaaagctctccaggaactcagaggagtcaagagtgtccacccaggaaggatttcatggaagaagtggtatttgagatgagctctgaagggtgagagggcctggtagttgcataaaagggaaagaattcaggaaggaaggtcagagtgagcaaatccacaagggcagaaaagttccaaagttttaggagaagggagagttctctggtgtggctggaatataggaatttgcgagaagtgaatctgcagagatggctacaagcccaagccaaagggctgtgagtgttgggagagggatttggggtatcttctctgtggtggaaaggcggttaaggattttaagcaagcatgcgtgtgttttaggaagaagcagtcatgaggttccaaactagggcagtggtggaggacagagaggagaggacaggtgtcagagacagaactgagtgagagaagaaggcctcagagtagggctggccaggagcttgctaggtcagggcaaagaggtcaagcccttggaggcaggtgagggagaggtggagtcatgaatagtggcatctgctcctcgagccctgttgctgcccctggtctgtgtcagggcaggacctggtctcctgagtgcctctctccttttttccttcctcttctccctctgcttaggatgtgcccgatattccagatctccaacgttacaggcgagaacctagatctgctgaagatgttcctcaacctcctctccccccgcaccagctacagggaggaggagcctgctgagtttcagattgatgacacctactccgtcccggtaagtggctctgggcgggtagctgggtgggcacttcctacagtggcatcagggggtgggtctgtgctggggatgcacttatgaggccagggtcttctccttggcagggtgtggggacagtggtttcggggacaacactgagaggcctgatcaagctgaatgacacgctgctgctgggcccagaccccttgggtaacttcctgtccattgctgtcaaatccatccatcgcaagcgcatgcctgtcaaggaggtgcggggtggccagacagcatcctttgcgctgaagaaggtgagtagcgatgatactgaacgctcccctcagactccatcatgctaggctcttggccagatgccctgctcacccactctagtcctcatggctgctctgcaaggtcgggattactggcttcatttttacagatgaggaaactgaggctcagagcccagggacttgcccaagacacacagcttgtaagtgctagagcgaggaatgcctccttctaagctccgttcctccctctggtgcctgagcagggtggcctgagctcagtggtgaggtcaaataggagtatccctgctgtgcaaggatccttctacataggaccattgggatctgcgccacatcctcttcccattcagccttctatctcctggggtttggggtgggttgtagttcaggggtcacctacctttacccaccaactaaattaaccaggaatagtaggactttcttccccacagtggtcaggtcatgcccacctgttgttccccctgaatgcttgcctgcctttgcttcctcatgcgtccttcatggccgagcagctgaagtgctgattcccgcatgaagccttcctgacccccagtagtagtgttgagtcttcccatggagcactgagggtgctcgtgctgtccaccctagaaggcctgtggtccagttggtgaggaaaccaggcagagttggggtggtccctatccctagaaagactcttggtccctgggaccaggggtgaaaccagaaggcataattgtccctgagggctggggctccctctttctttcagatcaagcgctcgtccatccggaagggcatggtgatggtttccccacgtttgaatccccaagcctcctgggagtttgaggccgagattctcgtcctccaccaccccaccacaattagcccgcgctaccaggccatgggtaggtgtctaaggccctgccagcccaggaggccgtcgtgttagctcccctcagaaggtgttccagcaacccaggccccctagttccagctgcagctgggtggtaggcctccttcctgtttagtgatgccgttccttctgttctacccatgagccgcagtgttgattccttcccacaaacactgagggctgggctcttgagacccagacctgtcctcagggacctcacatgcaatccttcagcaaggtctgctgaacgctgctatgtgcccagcggtgttgctaaggtgctgggaacaaagatgaagtagatgggcaaggatccttccccgcagaagcccacagtccagcgaggaggtgcatgtgcagtgtgctgtaatcccaggaactgggacccttgtctgcccagggcctgggggtgggggatgacgggtgggcattagctggaggaaaaggtgggagatggtaaggcaggatcagagccaagaacaggcttcacgggggtctgtagccccagagataagcccccacccttccacagcttaagcgtatttcatgctttcactcactgcctcccgttgtcctgaagccaccaggtggctccagcctatcctgacctctggcttccttgacagtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaaggtatggccaggacagaccttgcctgcctccaggaagcaccaggggccactcctgttctgtgaccctgagtgcagggcagaggtttagtcactgccatgggagagctggacccactgaggtgtggcctcggtgccatctctctactcccttagaggtatcctgtggcctcctgtcctgggcagtggtggtgaccatggagaggagaaggtagggttagggtatgatcttcctccatagaaaactggtgacagaatgtctgggcccagccaggctcagcctccagggtgctgtcacaggttcctatggcctcactgggaccatgtctaaggtctcctctcagagcagaggtctggttggagtaagtgcagggggttatgggcgtgagttctcttggggcttaagctgttggtgtatcctggacacttgcccactgcagaccttgcccctggtcttggaggggcatttgatagaggggtttgacccctgctccgtacaaaggaggtactggccccagcctatctgagatcttggaatcagtctttggctggccttgcctccagaaaaggcccccatccatggtcaccctggggctacagatgtccttgaaggcctgcatgctcctgggactgctgagtttggccaaggctgcagcaaacactgtaatgtcctctgggactcactgggcttcttttgtgctttgtatgagatagaacttgggccacaagggaagatttcaagtcagttacttctggccaaactccagatgtttccagctgaggagacattcacttggtctcttcgggaggccctgagttaacacttgccctagacttgttacgggggcagcagcagcgtgctggggctggagctgcagcatgctctgaggagtctccaccagcttagcaatcaggagatcccggagctccacttgccaggctctgtgcaggctctgggctctgggggctggactgagcgggaggtgggagcaaggttcaccaatttctctgcaggaatagtagctgcagcagagaacaggatggagcctttctgggctgggcagaggcaggaagtgaggcatgagtccagggccatagcagtcctcagccactgagtggggatgagaatgcctcttcatccccactgcctcctgtcacagccttcctgccatctgccttgccctgaactggcaagatcaaggaatgaggagtctgtgggagaagggggctgagggtggggggtagccaagccagtgccactgccccgcagctccagcctcagcctctctccatggctcccacagctcctccagaccaccaacaactccccaatgaactccaagccgcagcagattaaaatgcagtcgacgaaaaagggccccctgacgaaacgagacgaggggggcccgtctggtgggccagcagtaggagcacccccacctggagatgaagcctcctctgtaggggcagggcaaccagctgcgtccagcaatctccagcctcaggtgagcacgggcccctcgcagcttcggcatggtggtgggggctgtggcttttactctgattcggtgagggtgacatgtaggcaagcctcaaacctggctagagggtctcctccacagctctggcactgaagtgctcctaagaatgaggcatttgtctctagaagctataaggcagtgcttccaaatcagggaatacagcccacctgaaaccagtttaattggccctaactagcatttggttttaatgaaataaaatagaacagaaaaatgtcgaagcttccctttcatagtaagattaagtattgcaagtattgctggtgtgagtgtccaagtgatatatgtgtgcactgcagtccagcaggtttgagagacactgccttagagggtcctcctctgtcccctccctgacgtgcacacatcctgaaggggaggtggctttgggatgtgccagtgcgcctcttactcggcatctcctgccagctgtctcccacaggcactctctcctggcgtgatgaaggcctggtgccccttgcacccctctccccagcatctttctccattgtcccctcattggaaaaggaggctatgcctggatctgtctgtccattctgttatctgtctcccatgggtctttcctctggttcgttcgcttcctttctctctctcctgctctgctttgtgcttctctgaacggccgcttctcacaccctcatcatgtgtgtcctacccaccctgtaaggaaggcagggcaggcactggctccattttagagacagaggggaggtgctgcatgcagagtgacccagtaaattcctggtcaggctagggtgaggaccacgcagcctgctcacgcatcttccgtccctgtctccccgctgctcagcacctctgctctctggccctgctcctgatgggccagtgcttctcaagctccttctctctctttcagcctaagcccagcagtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctcccgctcaggccacagccggagcctccgcattgcccccacccccattttccaggggggttgtaatttataagctgacgaaggtagccagacttccggaggactgaccatctctcactgtcctccccaccttcttcctcactcacacattttttgtacatctgggcccttagtttttattctgtttattatatgtctctgtctctctctattgtgtgtgtgtgtgtgtgtgtgtgtgtgtgtgtgtgtgtggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttgtaacctggagacatgtggaggggaatggcgatgggattataggactctccccatctcgggccctgaccctgacccttgccaccaacccaaagacagctggtgggtttccccttggagacaatcctgcgtttgcctgggccggccctggctgccctcagctttcgctgatctgcccggcctggagcctcccatcaccccgcttcttgttgggcctcaggcactggttaccagaagggggtctgggtctgctcaggatcatgttttgtagcacctcctgttggaggggtggagggatgttcccctgagccaggctgagactagaaccccatcttccctgagccaggctgagactagaaccccatcttccccaccacgccacccctgtggctgctacaggagcacagtagtgaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttgacagtgtggtgctccctgcccagcccctccaggtggaggtgctgccacgggaacgcagttgctctgcctgccctggggcccctggcgacagctgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagccatccatcaccttgtgtggattcagagaatgtgaggccctggggtgtcctacacaagggaaaggcttgctcagtgagcggtctgcacaccgttagccaccctgccacctctgtgccctgggcaggctccaaaggaaagctctggctgggactgccaggagtctcacacgctcctgttgacattcccagcagccgcccctgaggtcgatgtttgttctgtttttctttttcttttttgagacggagtctcgctgtgttgccaggctggagtgcagtggtgtgatctctgctcactgcaacctccgcctgccagtttcaagtgattctctgcctcagccttctgagtagctgggactacaggtgcacgccaccacgcccagctaactttttgtattttagtagagacagggtttcgccatgtcggccagggtggtcttgatctcctgacctcatgatccacccgcctcagcctcccaaagtgctgggattacaggtatgagccaccgcaccgggcctgttctatttttctagttaagggaactgaagctcagagaggtgtcaccagcaggtgttcattcccatgccagccttgccccccggcttttcccaggcaggctcctgcgtgcccactggctccagcctggtcctctgtctcttggctgcttcactcctgctctttgtcccgactctggccctgcttacaggggccactacctgctggtgcctccataacaagcgtctggcgttgagacccctggcatggcaggggctttggggtctggtttccacaaggcttagccatggcagaacctcgttttattttaactctttgcccctacaaacaaacagcagtacttgccagaaccattcttgggattcaggagctcgggcgactgccttggcctctggccgcacccaggagggtggggttggatctgtgtagttgccaggcccacacctgccagcagggggctgactggatccatgctttactgtgtttaatgggggtaacaggggtccctacagccctcccagctaaacatttggaacaaaacaccagcccttttgtagtggatgcagaataaaattgttaatccaatcacctccaatggcaaggcctga

SEQ ID NO: 11603 - DNA, 1139 bp, Homo sapiens
gtgactctggagcctcttccagggcgctttccacaggcttcccaattctcagtttccttgtctttatccttcatggtgctgagctccgcacaagccagaattgggtcttcctcgacctctgacaagtagcagagactctggtgcttctggtcactgcctgcacgcccggtggtccagccaccccacctgccttctccctagagacttctcccagtctcgctctagctgtgtccctttgctgacatgtgctcgttcatcgagggccccaacgaaccttgatggaaaacctttcccatgtagaccccacctatgttctttttttttttttttttttttttgagatggagtctcgcgctgcctcccaggctgaagtgcagtggtgcaatcttggctcactgcaacctctacctcccaggttcatgcgattctcctgcctcagcctcccaagtagctgggattacaggtgtgcgccaccgggactggctaatttttgtatttttaatagagacggggtttcgccatgttggccaggctggtctcgaactcctgacctcaggtgatctgtccacctcggcttcccaaagtgctgggattacaggcatgagccaccacgctcagccaaaaggatttttcttttcttttcttttaataatagagacagggtttcaccaagttggccaggctcccacctacgtcctgatggcgcttgcactgtctgtccccacggtgcacactgtgctgccacatcttggtaagatgatgataaaatggtaagtgtctgctgggaccgggctccttgtatacctcatttatattattagaagcaaggtaggtatcattactcccatctacaagggaagaacctggacactgaggcaatgggtaacttgtccacagtccccagcctgtaagtgccaaagccagggtttgggctcagctctgacaggctgtagggcctgggtctttctactcaggcataaagttttccagttgtttcaggaatgtattgaagattctagttgtgtgtcctcagctagaatcttttttagcctcacacatgcgcaaaacaaggctgtatacaaacttgttacacaacaaatatttgttagcaaactaacaaaatagggaggaggagggca

SEQ ID NO: 11604 - DNA, 1249 bp, Homo sapiens
ggaggaggtagcctggcaaatggcaactgagggagcaggggcctagggtcgggttcaggactcatacacagtggagctgacctggctgtgctaggttcttggaagtcctggctgaactcagagaactggttcttgggccatgccgggggtgcaggcaagtaagcctgcatgtgggtgaaaggtagccccagcagcaaggctgtaaggaaaagagggaatgagcacttagtgtacacctaccgtgtgccacaccccctccatatgttgcctcattctggccactccgcagcctctggtggtgcctcatgcccactttgcagaggatgagccacaggttctgatcaggtgctggaacaaaccacccttcttaagtgagtcccccacgaacttagaatttgagactcactcattggccaggctcaatggcctctgttctgctatcaagaggctgctgggatgttacccatggcagggatagatggggaagtcaccatattcaaaacaatcatgtgttgaaacacctccccagcttctgatctaccggtagtggcagcggaagcaaatacagcaaatctgaaacccgatgcctacagaacaggggtgtgaaatgtgacgccagaggcccccacacagaagtgggtgtggacagccacctgcctgtgagcaaccaggggaagctagcttggtgccgagtttacacagtgaatgttaaaaagacttcgaagctggccccagtgtattcgcacacagttgagaaaggccagggaggataacaagggctagaatatagggtcagctccctacagttgctgtaaccccctgggcagctccctttacttctctgagcttcagtgacctcctctgtaagtgaggataacatttcccagagtgaggattaaataacattatgcatggacctgcccatagacaatgacctagcaatggctcagtgagtgtcagtgatgattatccccaagtaaaataaatttgaatttaaaattttaaaaatggtcatttttgcatccattgtcttgagccaaatgggaaacggtttggttcagcctctaagcccctgcgggtaggccctgggtctttcagccctgtgtctgctggtacgcctggggctcaggaaatgcacatggtgtgttaaaaccaagtttgaatttgtcaaatcccaagtcaatccaggatgttcatttcttaaatgatacagtgagacaaagtttttttgaagaggaaaaagaaaaaa

SEQ ID NO: 11605 - DNA, 1249 bp, Homo sapiens; identical to SEQ ID NO: 11604

SEQ ID NO: 11606 - DNA, 1248 bp, Homo sapiens
ggaggaggtagcctggcaaatggcaactgagggagcaggggcctagggtcgggttcaggactcatacacagtggagctgacctggctgtgctaggttcttggaagtcctggctgaactcagagaactggttcttgggccatgccgggggtgcaggcaagtaagcctgcatgtgggtgaaaggtagccccagcagcaaggctgtaaggaaaagagggaatgagcacttagtgtacacctaccgtgtgccacaccccctccatatgttgcctcattctggccactccgcagcctctggtggtgcctcatgcccactttgcagaggatgagccacaggttctgatcaggtgctggaacaaaccacccttctaagtgagtcccccacgaacttagaatttgagactcactcattggccaggctcaatggcctctgttctgctatcaagaggctgctgggatgttacccatggcagggatagatggggaagtcaccatattcaaaacaatcatgtgttgaaacacctccccagcttctgatctaccggtagtggcagcggaagcaaatacagcaaatctgaaacccgatgcctacagaacaggggtgtgaaatgtgacgccagaggcccccacacagaagtgggtgtggacagccacctgcctgtgagcaaccaggggaagctagcttggtgccgagtttacacagtgaatgttaaaaagacttcgaagctggccccagtgtattcgcacacagttgagaaaggccagggaggataacaagggctagaatatagggtcagctccctacagttgctgtaaccccctgggcagctccctttacttctctgagcttcagtgacctcctctgtaagtgaggataacatttcccagagtgaggattaaataacattatgcatggacctgcccatagacaatgacctagcaatggctcagtgagtgtcagtgatgattatccccaagtaaaataaatttgaatttaaaattttaaaaatggtcatttttgcatccatggtcttgagccaaatgggaaacggtttggttcagcctctaagcccctgcgggtaggccctgggtctttcagccctgtgtctgctggtacgcctggggctcaggaaatgcacatggtgtgttaaaaccaagtttgaatttgtcaaatcccaagtcaatccaggatgttcatttcttaaatgatacagtgagacaaagtttttttgaagaggaaaaagaaaaaa

SEQ ID NO: 11607 - DNA, 1249 bp, Homo sapiens; identical to SEQ ID NO: 11604

SEQ ID NO: 11608 - DNA, 1249 bp, Homo sapiens; identical to SEQ ID NO: 11604

SEQ ID NO: 11609 - DNA, 522 bp, Homo sapiens
gaaaattggggtgtcttaccggaagtgagaatggaggctggtcaggcagaaacatcctgcatccaccattgcgacctgctaagacttgtgggctggtcattccgccactatgacctgctaagacctgccggctggccagctgagccatgtgttctgctatgcatcatcccttcgggtcagccccgtgaggtagagtttgttatgatccctattttgcagatgagaaaactgaggcttagggagacacagtcacttgccgaaggtcacactgttagcaaatgtcctcaaatcccaaatcagcttgacctgaagcccagaatcttaaccacatgctccactgccttacagcaatcagcaaagagtttgaagaggatgcctagggagcttggatggaggacaggctggcagaggagactggaggcagaggatgggagtaggaggcgggcgccacactggcagagaggagggatcctaagacatagagctgtggtgtgctaaagcccggctctcaacgcactgtca

SEQ ID NO: 11610 - DNA, 303 bp, Homo sapiens
atcagccgggcctggggtgtggtcaggctgtggttaagagcccagaccttgggaggccaaggcgggcggatcacttgaggtcaggagatcgagaccagcctgaccaatatggtgaaaccccatctctactaaaaatacaaaaattagccgggcgtggtggcgcatgccggtaatcccagctacttgggaggctgaggcaggagaatcgcttgaacctgggaggcagaggttgcagtgagcctaggtcgtgccactgcactccagccttggacacagagcaagactgtctcaaaaaaaaaaaaa

SEQ ID NO: 11611 - DNA, 303 bp, Homo sapiens; identical to SEQ ID NO: 11610

SEQ ID NO: 11612 - DNA, 522 bp, Homo sapiens; identical to SEQ ID NO: 11609

SEQ ID NO: 11613 - DNA, 303 bp, Homo sapiens; identical to SEQ ID NO: 11610

SEQ ID NO: 11614 - DNA, 522 bp, Homo sapiens; identical to SEQ ID NO: 11609

SEQ ID NO: 11615 - DNA, 522 bp, Homo sapiens; identical to SEQ ID NO: 11609

SEQ ID NO: 11616 - DNA, 303 bp, Homo sapiens; identical to SEQ ID NO: 11610

SEQ ID NO: 11617 - DNA, 522 bp, Homo sapiens; identical to SEQ ID NO: 11609

SEQ ID NO: 11618 - DNA, 303 bp, Homo sapiens; identical to SEQ ID NO: 11610

SEQ ID NO: 11619 - DNA, 2127 bp, Homo sapiens
cagagacaccgcggaaccctgcagatgctgtggccgacccggcagtgcgggccagagcccctccgcccccatagccacaattcagtagtcgtagggtaggtttgagctactaagcaaataccacactaaccactttttcgataattaaaagaatcatttgaaatattttttttaattgaaaaagatattttaatttcagctcttttattctgcaggtgtattattctgcatgtttttaaatgatataaaacatttatatagacaataagcaacttagaaaaaataagattttgcatttctaaaattataattgaaaacaaaatctgacattctctgctaagtcttatctgaatgcttcagataatggtagtgtagtcagtgactaaaatatttttatcaaatttcctctctgtagacgcctgcaggtattgacgtctgtcagatctcgtcacattggctggtgccgcagctgttggagagtatttttctttatgattattttagaaaaaaaattttcttttccacaatgtggttctcttagaagaatgacgtatcttcttttcctcagcgagttggacacattgtgcccagggcagccctgtccttgggcagcgaccgcacaccaaagctgggaggaggctggtccggggggcctgggcagaagacagtgatttgcaggggtggctcccagacaccctgcccagggatgggctgggcaccacctgggggcggagcgtgagctccagacgagctcctgcgtgcgcgtgtgagtgtgtctgcgcccagccatgtgaccccgctcgtcccgtctgaaggactctcctaggaggccaggttgcccctccagaccgctcccaacgtcagggggaaggaaacgttgactttcactgcactttgattcgtctctaaaccatttgctggggattcctgagagcagagctcccagcgggccctgcctcccaagtcccgccgcaaggctacctcgggtgtgtggatgtgcgagggcctcccccgcttgcgaaggggacatgcgtgctggaacctgtcggaactccatgccttcctcgcctgctcacctgctcgacgctggaatcgggacaggtgcaaagggacgcagacgtctgggacagctaaggcccgtgtcaccggagggctccgcacagtcgttctggtttcaacgaataagcaaaactcgggcaagtactgcagctatttggaaatgttttccaaaccacagtctctttagaactaagcctatttgaaacggtcggtgtaggcttactgagatcaggagacagggaggccccgcacatcacacagataaagtcagacaattgtaattaatacttttgctgcctcaagttgttttttaaataaagtactttgaaatgcatgagaatcatgctgcaatatgatcattctagagcaaatatatatatacacgtatatatatttcaagatgaaactaaagcagtttttaaataaattacttgaattttctgtgtatttaaaggaacgactgtttaatgtacttgatgggcctctggtcttgccgtgtctcctgccgctggtggcactttgtagattgtgtgtttgtgtccgggtggcagttgggtacctgctcacgcacggtgtgtctgccaggccacggtgtcccaggatcgcagagggctgactttcaagacttcaagaacattttctggatgtgtggaaacttgagaatggccttgtgaatctcgtgcttggacagggcaagtccgactactgaaagtgctgccagctttgctgcgagccctccggccagcgggagccccgtgggctgggcactgtggcccttcttctctgggggacggcacccctggcttcctcacctcggccgggcgtccgtggcagctcactctatgcaacttgatcctctagcggctttaagactgtagatcccctctctgagacctggctgtacttgtcaggatctcgaggcgcagctcccgtcttagctggtttctccggcttctcgtcctgacgactataaaacagttggaggcaagaaagcagcggatgtggggtggcagtggcctgacccgaatcaagatccgacccaaaccacaccaaatgtgggttcatctg

SEQ ID NO: 11620 - DNA, 342 bp, Homo sapiens
ccatcctgtcctgccaagtgtacatctcgcagatcctggtggcctctgcccttgggggcgtggtcgacgccgtggggactgtccgcgtcatccccatggtggcctctgtgggctctttcctgggcttcctgacggccacattcctggtgatctatcccaacgtgtcagaggaggccaaggaggagcagaaaggcctgtcttccccgttggccggcgaaggcagggccggtgggaacagcgaaaagcccaccgtgctgaagctcacgcggaaggagggcctgcagggaccggtggagacagagtccgtggtctgagccgcactcccgtttacacacattccag

SEQ ID NO: 11621 - DNA, 218 bp, Homo sapiens
agtaaggacaacaaaggccattcagtgccctccacatggccttgccacagtcactgtcagggtatgaacgtgccggaagccagtgccagccagggacaggcgtgactgttgtgtgctcctcggtgacaggagtcggtggctgcacactttgtagactcgtcaagctgtcagcacttcaggtgtttgcaagcaaagcccttcttagtgtgcaggtcagt

SEQ ID NO: 11622 - DNA, 1932 bp, Homo sapiens
cctgggcctcacaaagtgttgggattacaggtatgagccacggcacctggcctggtctcttaactggttccctaagacagctggaaatagagaatgtcatggagcattcctaaccatgggctccagcctggctttcattctgtttctcccctgaaacaacattcctttagtaatattccgaataacagcttcatcagtctgtctaccgaccactcttcaggcttcatcttatatgacctcccaaactgcactaagggttgtattagagaaaagtggataaagttcggagtcaggctgcttgagcttaaatgccagcttcacttaccagccacctgaccatgagtcagctgcttaaccattctttgccacagtttccttgtctatgaaaagggaaatggctcccacctcaaaaagttgttaacattaaattcaatcatgtattcaaagtcctgagcagaatgtctggccatgactgggacttaacagatgttagcatttattattagtatctgtcagtcttgaaatgttctcttcccttggctttcatgacattccacactctcctggttttctcttacctctctggtaatacctgtttgcttatccttctttgtccagctctgggatgttaccattccttcaggcgtgctgttttctccttaggcagtcttacacacactcatgacttccttccattgtcctccacacactgatgaccctaaaatcagtatctccagcctaaacctttccactgagttctagacccatatgttgtactatcaacctggcttgtccatttgaatgtcttccaggcacttcagactctcttctctagactttgctggactttcactcttccccctaaaactggctcctcttccactgaaacatgtatgtcattgagaggcaccaccatccacccagtgcctaagccagaaacctaggaatccttgatacctgttctctctcatcctgcatatccaagcctatcagttttatctctaaattatattttggtaggtttacttctttccttttctcccaccaccaccctgctccaagctaccatcatctcacctggatgtctgcaatagcctcatctcccacagccactctgcaccccctaatctgttctctatagagcagttggaaggagtgatttttgttgtttgttttgttttgttttagacagagtctcactctgttccccaggctggagtgcagtggcacaatttcggctcactgcaacttctgcctcccgggtttaagcaattctcctgcctcagcctcccaagtagctgggattaaggcaccggcccccatacccagctaatttttatatttttagtagagatggggttttgccatgttggccaagctagtctcgaactcctgacctcaagtgatccacctgcctcggcctcccaaagtgctgggattacaggtgtgagccactgcacctggctggaaggagtgatcttaaaaaaaaaaaaaacaaaaaaaaacttgactgtgtcactctgtgttgtctctcctaccttgtatacttccacaacttcccagtgttcttggataaagaccaaaatccttaacttggccaggcgcggtggctcacacctatcatctcagcactttgggaggccgaggcaggcagatcatgaagtcaagagattgagaccatcctggccaacatggtgaaaccccatctctactaaaaatacaaaaattagctggtcgtggtggcgtgtgcctgtagtcccagctacttgggaggctgaggcaggagaatcacttgaacctgggaggcagaggttgcagtgagcccagatcacgccactgcactccagcctggtgacagagtaagactccatctcaaaaaaaaaaaaaaaaaaaaaaattccttaatttggcctacagtagagccctccgtaa

SEQ ID NO: 11623 - DNA, 707 bp, Homo sapiens
cttcctatagcagccaccgtggctgcagttactgtaaatggcaagacggaatcagttccggacattgggttgttttagaaaattgcctgcaagtgtcagggtgataagttaaagctttgtcttttgccctcagaggagctatcccatagtgagtagaagccagagaagctgaccccaggagtccttctttccagcagcaggtcttgagctgcacttctctgtagctacaatccaggcaggaacaagccctaggtacctccggagaggagggcaagagaggaagaatgagttcagctactctagccaccaaactgattatgaattgccctgaaatctgaaaaatttcaattccaatcgtaagtttgttttgtttcattttgttttcttaaattgtatatttgaaagatggcattaactaaagatatatattcaatatagagtggaaaaaatggaatacttgcatagtatcttttacttataggtgatttatgatggggagtggggtggataggttggcagttcccccaagaagttggaaatgaagtttgtcctctgtgagttgaactaattagatccacaagtaatgaaagcagtattgtgttgtagttaagagcacactctagaaccagattgcttagtttcaaatcctggttctgccttttattatctgtgtactttgggcaagttacttgccctttgtgtgcttc

SEQ ID NO: 11624 - DNA, 279 bp, Homo sapiens
ggactctgaaaacattagaatggtttaatgtgaaggattagcagcagcacatggcaacattgtgcatcttatattaactatccaaatatatcaagcgtcatttgctatatataaaagtcatcaaattaggcactgtgggggatacggagttggcatactagcctggcctcttaattaattcattaattagcttatttatttttgagataggtcttgctctattgcccaggctggagtgcagtggcatgatgatagcttactatagcctcaatctcccag

SEQ ID NO: 11625 - DNA, 1118 bp, Homo sapiens
gaagcagctcaacgtaatctacctgccactgggcaactagctaatgaccctccacagtgatgctgtattgaggacttggtgttgatctctaccgctggtcagttgggcactcagcggtggctctagccaggtcagctttggtgagtggaagtccatgttgctgagccatgcataacctccatccctgtcaccatggctactttgttcatgagcccactgtggaatgacagcagtggctggagaaagaggctgactagtatcacagaatgggctctcctatttccttgatcattaaaatacctctctgctaagatcacctgttggtgagcattcacatgggacacaaatatcttcactataaaggcccagatagtaaatatttcaggctttgtggactacatattgtctctgttacatattctccttttcttctctcccctctcccttctattttccttcttctttatagccctttaaaaacataaaaaccattcttacattgtgtgctatagtttgctgacccccagcttacatgttaaaaaatgcaagattcatttaagtgaaaattgtattgggaaggaatccacatttccagataatgagggttgaggaaggcactgcatttattttaattataaattgggatttaaatctaagaaaacatgaataaagcacccaaaggtattataaaaacacacacttatgtatatgtgtctatgtgtgtgtgtgtgtgtgtgtaaagatacacacacatacaattactcaataaataattacaaatcacctaatattttataagtttattaaccaaagttactggcacaaactcagatgcctactaggacctggcagataaaagggcatttttgaagtggttaagtacacagtagtaactgaactgcttatatgtcagtaaattcaaacgttagcagaatgactttgccagactttgtgaggactgagtaaaacatggttccaaacatatatgtggcccctgggtaatcagtttttatgatcacctgtaaaagcagaggcttgtttctaacatctatacttttaagaaattctttttttctcttaccctggtcataagaaaaaagaaaaaaaagaaaaaagaa

SEQ ID NO: 11626 - DNA, 328 bp, Homo sapiens
attttctagaaggaagaatgcaggcaaaggcatggaaatatgaagtcataagaataggatctatgaaggcactggtgtatatgcagaatagcaaataactcaatttggctgacacaaagggtcagagaaagcaagcaataactgagaaaggcaagtataagcaaaataattgttaccctccaatgccaaggcaagatttggacttaaatctttaataagcacagctgaagtttttgatattaagtcgacatgatcacttctgtgcattagattataaaactaggtataaaactgatataatatgtaggcgtgaaggcaggggccaaag

SEQ ID NO: 11627 - DNA, 267 bp, Homo sapiens
cccagcagtttgggaggccgaggcaggtggatcacgaggtcaggagatcgaaaccatcctagctagcacggtgaaacccagtctctactaaaaatacaaaaaaaaaaattagccgggcatggtggcgggcacctgtagtcccagctactcgggaggctgaggcaggaggatggcgtgaacccaggaggcggagcttgcagtgagccgagattgcgccactgcactccagcctgggtggcagaagcgagactccgtctcaaaaataaa

SEQ ID NO: 11628 - DNA, 142 bp, Homo sapiens; identical to SEQ ID NO: 7551

SEQ ID NO: 11629 - DNA, 184 bp, Homo sapiens; identical to SEQ ID NO: 7572

SEQ ID NO: 11630 - DNA, 183 bp, Homo sapiens; identical to SEQ ID NO: 7394

SEQ ID NO: 11631 - DNA, 193 bp, Homo sapiens; identical to SEQ ID NO: 7396

SEQ ID NO: 11632 - DNA, 153 bp, Homo sapiens; identical to SEQ ID NO: 6795

SEQ ID NO: 11633 - DNA, 193 bp, Homo sapiens; identical to SEQ ID NO: 7690

SEQ ID NO: 11634 - DNA, 150 bp, Homo sapiens; identical to SEQ ID NO: 7399

SEQ ID NO: 11635 - DNA, 122 bp, Homo sapiens; identical to SEQ ID NO: 7739

SEQ ID NO: 11636 - DNA, 166 bp, Homo sapiens; identical to SEQ ID NO: 7759

SEQ ID NO: 11637 - DNA, 268 bp, Homo sapiens; identical to SEQ ID NO: 7767

SEQ ID NO: 11638 - DNA, 1090 bp, Homo sapiens; identical to SEQ ID NO: 7782

SEQ ID NO: 11639 - DNA, 1483 bp, Homo sapiens
ttttgaacaagtaatatgttcatgtggtttaaaatgctaaagttacaacattatacatagttaaaaaaaatctgtcttctaagtagatactccattgtcctctgtagggagaattggagttactagtttcttggctgtcattctatgcatttataaacagttgcatttttttccccttatttttactagcatattatgtatactagtttatactttgcatttcccatgtaatatagaatcttgagagattattctatactgtaacataaaagagcttccttgaaaagatattcttaaaatagaatattccataaaatattctataaaatactgctttgaatatttgcaccactatctttttttctttttttttttgagatggattctcgctctactgcccaggctggagtacagtggcaccatctcggctcactgcaacccccacctcccaaatctatgatctctttcatatttgcttacttttctattagattgttgatccttcctcttactgatttatagaagccctttgttaggtgcattagctcattgaggtatgagttgaatgtatccagatttataaattttaaaagagggatttacaaaagtcctctaagtcttgctttaagttaatggttagagctgtgaaaacctaattaagtcatttcacacaatgttctcccatgagaaaatccaaagtttgtttaaaattcaaaatttaccattttaatcattttaagtgtatagctaagtggcattaaatacattcacaatattgtataaccaccaccactttctatttccagaagtttttcatcacccaaactacaactctattaaagtaataactactcatttccttcccgtcctcccagcccctggtaacctgtactctgctttctgtctctatgaatttccctactctagatacttcatataagtgggattacacaatgtttttccttttttgtctggcttatttcacttagcataatgttttcaaggctcatccatattgtaagcatacggaggaataatctattggaatatttttatatagcatattatttacatataatattccatatggaggaataatattcaattttttgtgtacaccacatcttgtttatccattcatctggtgaaaaataatttgggcctaggcacagtagctcacgtctctaatcccagcacattgggaagctgaggtgggtggattgcctgagcccagaagatcaggaccagcctgggcaacatggcgagaccccatgtctataaaaaatttaaaaattagttgggcgtggtggtgtgcgcctgtagttctagctactcaggaggctgagatgagaggatcacctgagcttaggagatggaggttgcagtgagctgagattgcaccatgcactccaacccgggcaacagagaccctgtctcaaaaaaagttgatgaacgcatacatattaaaaaaaaaaaaaaaaaa

SEQ ID NO: 11640 - DNA, 465 bp, Homo sapiens
ggtttccctctcgggctgttgggaataatgctgctgtgaacactggcatacatactgtttgagtccctcttttcagtacttttgtgtgtttacgtaagagtggaattgctgggtcctatggtaattctgtgttcaactttctttttgagatggagtcccactctgtcacccaggctggagtgcagtggtgcgatctgggctcactgaagtctctgcctcctgggttgaagcgattctcatgcctcagcctcctgagtagctgggattacaggcatgtgccatcacgcccagctaatttttgtatttttagtaaaaacggggtttcaccatgttggccacactgatctgtcttctgacctcaggtcacccaccctcctcagcctcccaaagtgctgggattgcaggcgtgagccaccaagcccagcctccatgttcaactttttgaggaaccactattttttttaa

SEQ ID NO: 11641 - DNA, 1516 bp, Homo sapiens
gatttccctgggccattaagaaaagtaccttttaatgtgctcaagaattcagggtttagaaagatttccatccagattggctccttaaagaaaaaagatgcggtgcataatttattttactttcagttatctgctaacgcagctatgcaaaatgactcatttattggggagtgggtggtggcattaggtaaagtcttaccatattgtctattttgactgtttcattcttaatagaagtctacacattgcctgcaattgaggtataattttctttaaagggagtgttgtttcagataaggtagctgcgacctaagaaaggaataattctatattgattttaaggtctttagggaatggaagcactgtcttattaattggaaagtcccaactgatagcactgacatattcatgtgctttctttgcctgcctgctcatctgcagccctgatcacagaaggaagggagaagtagataagaaatagtagttatgaggatgaaacgtgcacatataggagccctctcacgttaggcttggtttggtgtctggaggcacgtgatgagaacagcagtggatctgtgggctcatgtttccttactcctgctctattaggactccagtctgaagggatgatctagtaccaaccaggagatgtttagaagaccgagatgtttcctgaagtattctgagctgtctcaggttgattacgtgctttcttatcttagatggctcctggagagctgtctgggtaatatgctctcccactttggtaattttggattttttgcagatgctttttgtaaaagaacacctatgagtgaggcctatggttttggggtttgcagtgcccaaccagtcaagctggtctttgccttttttgtggttggatatggaaagagtggtcagtagatttcccagtgctgtactcatgccattcagctcatagtcacataggtttccatatttgctagtaaaaataagaaaattcggaaaggggagtaggttggaattgtcaagttgaactgtgaatggtgtggatgagatattctggggagagaatggacagaccaggtttggcttagctactagttgagtgtccttctagctctctgggatttctttctaatctgtaaaatcaccattttgttgaagtaggcttgcctgtcctttcaattcttggacatttcagaacataagctatgtgtttttctggaaaaaaaaaaggatatttgttagaattagaatttacttgttatgaatctaaccttcacacaccaaacccccagctaagacagtaagttgcatatataattgtaataaatactatgtaagtctgaaaggggaaagagaacttgagtttgcgacttttcttataatcttgaagaagtaattcccagacttcagagtgtgtaagaaatcactagaatgctagtttaaaaaggcatggattcctataccccagttacacagttcttatggcctgggatagagcctggaagtctgcatgtcacaggtgaaa

SEQ ID NO: 11642 - DNA, 351 bp, Homo sapiens
acactcccaagccaacagcacaccactaaaaagtcaacgaacaaatatcaagaaacaaagcttcccagttggttgggaatgagaagcagccaggtcttctctcttctgttgcaggtacacgtcacaccaccatggaatcttctcttttgatttagtgagggagactggcgtcttctagatgtgcagtgtatgacaagcttctctcatccttgcatgtctgcagaggtgtgacatggttttgtgacacagcttctagtcttggggggattcattgtgctcaccctttttttcctggccagttgctaactcaaacctgtccccttctgggatttggaaaggattgtttgcagc

SEQ ID NO: 11643 - DNA, 1618 bp, Homo sapiens
tttttttttctctcctctctaaacatttatgatgtatgatacagtgtgtcctggctggatttttcctgttagcaggcagaaagaatccctcctggattccagaataataaatacagtcatgtgctgcttaatgacgttttggtcaacaatgggccacatatatgatggtccaaagcactatactgtacatcatctcattggaaaaccttatgaaataggagggcaactatcatcataatcatcttccttccccccaccaccaacttcagggagtgaggtcctgggaaatgaagggacactatccatgtgcttggatgtctctatcctggttccgtactctttccgctatgatatactgccttctatatatagataaaagttcaattttctttttcacaaatgagaggagaatatgattgagttttagtaaaattgatatccagtaatactataatgtatttagatcaagttagcacctaaatagcaaacctgcttgctctattaagctagtgatttttcactataggtgctaacaaccattacgtagcatctattctctaaaattgttgctatcggtctagcagaggagcagtgcactaatgtgggtgcagatattatagaaaccagaatacatgggtgatgactgttccactcaccatcttctcatatctctggggatctcattgtggagtaaggggcataatgttagtataccttttagagatcaaaggggcaagtcagcatcagctgaaagttgaatcacctcattaaagaattttatatccctttcagggggttgatttggaaaggaaaacagacataagatttgaatgtatcagtgtggctacttgtgaacatactgcattcaactaatggatagaaatttgaataaaatatttcagaagaggtttttcttgtgtgtgtgtgtttttaaaaagaattttgtaatgcacttcttccatgcatatcttatctactcttcagggaatacagaagcagatttacaaatgaagagacagtgtcattctgcttgagggtaatggtgggtgtcataatactctatgaccacgtacatccagtgggagcatttgctaaaacttccaaaattgatgtaagttattgttttatataaataatttcaaacgagtttctccatggaaaccataggattttattttatgataagagccagcaaaccggactctcacaaaactcagatttatagtttgtgaaatggtggactttcatctcctctgtccctgtgctgtttttcttgtggcctgtattcaggtggaatagaatgatcaaaggatgactatattgtctagtgagtacctcctggaaggcttctactacgtatttggcaatataaatagataattagatataaggaattttgagtcatatcctttaattcctttggccaaaggccatttcaaataaaatgtttatttcagaatgcatataaaaagtcagtagtgctgctgggcgtgctggctcatgcctgtagcccaagcactttggcaggctgaagcaggaggatcacttgagcccaggagtagaagaccagcctgggcagcatagtgagacccccatttctacaaaaaaaaaaaaaaaa

SEQ ID NO: 11644 - DNA, 1618 bp, Homo sapiens; identical to SEQ ID NO: 11643

SEQ ID NO: 11645 - DNA, 3532 bp, Homo sapiens
aaatgaagtaaataatgaattggcaaatcgaatgtctttgttttatgctgaggcaactccaatgctgaaaaccttgagtgatgccacaacaaaatttgtatcagaggtaagcattgcctaggcaggtactctgtgttgttatttatgcccctgttggcagacgtgatgtcagcaagcccaagacattaaataccatcttgaaaccaacagactcccagatgtatgtgttgagtcctgacttttttctgaggcccacatgtgcacacctgtccacgtatttgcagtttctctggagggatggtggaaacctcagtgatagctgatggcatggccaaaccaaactctgggttgcgttttctaaccctgccctttctttagtttttgctttctcaattaacagtaccagtgcaggcaaaaacttacaacttatgtcatcctaaattcctttcttttttttttgagacagagtttcactcttgttgcccaggctggagtgcaatggcgtgatctcagctcaccacaaactccgcctcccgggttcaagcgattctcctgcctcagcctccctagtagctggggttacaggcatgtgccaccacgcccggctaattttgtatttttagtagagatggggtttctgcatgttggtcaggctggtctcgaactcccgacctcaggtgatccgcctgcctccgcctcccaaagtgctggaattataggcatgagccaccgcgcctggccatcatcctaaattcctttctatacctcactccctacatgtattccatcaaacagtctcattggctttccctccaaaatactaatatatcatgaatctgaaaacttaagttgctttcttgccaccagccacatcagacttctcatctggattactgcattcgtgtcctgaccattcttacttcctccactcttgccccaatatagtcctttctccatagagcaaccaagtaatcttaaaacataaaccatgttccctccctcctccatgtaaaatgttcccagtgacttcctagtacccttaggataaaatccaactatttcatagcctataaaactctacacctttgaccccctgtctgcattgttgcagttgttcttacattgctggaatgcaggtgcctttcagaagagtcctgccttcgctgtcttgctcatagctgtatccccagtgcttggaacagttgcttagagtctagtgcattatttagaaaattaggagtaggaaccaggttttaaagttgctaatttttcatattacgctaaattttaaattgtgcttaagtaataacgtttgttacttttactttttttgttcttcatatacttctacagaataaaaatttaccaatagaaaataccacagattgtttaagcacaatggctagtgtatgcagagtcatgctggaaacaccgtgagtatcagctgatctttttcactttaacagtgctgttgagatgactgatatttcaaaacatgttcatatatgaacatgttaacatgttttatctggaaggtggaaagtaagtatattccaaatattgaatgttaatatatgaacaaacttaaaataatttggctatttaacgtaacttctggttaagtataaaatagagttagttggtcttcaggtacctcagaccactcagactgactcagactcttagttctcttctcagaacagaagtggtggtggtgttttggtggctgggatgtaggagaagaactttaaagttccttggttatacttaccataaatgttctttttccatatttagtaaagaatcttacccttttgccaaagggctggaattattcttctgtttatccctttttctctcaataattaattgtcactcttttcttttttttttccaacacgaacctgaattctgtttttttttctctcctctctaaacatttatgatgtatgatacagtgtgtcctggctggatttttcctgttagcaggcagaaagaatccctcctggattccagaataataaatacagtcatgtgctgcttaatgacgttttggtcaacaatgggccacatatatgatggtccaaagcactatactgtacatcatctcattggaaaaccttatgaaataggagggcaactatcatcataatcatcttccttccccccaccaccaacttcagggagtgaggtcctgggaaatgaagggacactatccatgtgcttggatgtctctatcctggttccgtactctttccgctatgatatactgccttctatatatagataaaagttcaattttctttttcacaaatgagaggagaatatgattgagttttagtaaaattgatatccagtaatactataatgtatttagatcaagttagcacctaaatagcaaacctgcttgctctattaagctagtgatttttcactataggtgctaacaaccattacgtagcatctattctctaaaattgttgctatcggtctagcagaggagcagtgcactaatgtgggtgcagatattatagaaaccagaatacatgggtgatgactgttccactcaccatcttctcatatctctggggatctcattgtggagtaaggggcataatgttagtataccttttagagatcaaaggggcaagtcagcatcagctgaaagttgaatcacctcattaaagaattttatatccctttcagggggttgatttggaaaggaaaacagacataagatttgaatgtatcagtgtggctacttgtgaacatactgcattcaactaatggatagaaatttgaataaaatatttcagaagaggtttttcttgtgtgtgtgtgtttttaaaaagaattttgtaatgcacttcttccatgcatatcttatctactcttcagggaatacagaagcagatttacaaatgaagagacagtgtcattctgcttgagggtaatggtgggtgtcataatactctatgaccacgtacatccagtgggagcatttgctaaaacttccaaaattgatgtaagttattgttttatataaataatttcaaacgagtttctccatggaaaccataggattttattttatgataagagccagcaaaccggactctcacaaaactcagatttatagtttgtgaaatggtggactttcatctcctctgtccctgtgctgtttttcttgtggcctgtattcaggtggaatagaatgatcaaaggatgactatattgtctagtgagtacctcctggaaggcttctactacgtatttggcaatataaatagataattagatataaggaattttgagtcatatcctttaattcctttggccaaaggccatttcaaataaaatgtttatttcagaatgcatataaaaagtcagtagtgctgctgggcgtgctggctcatgcctgtagcccaagcactttggcaggctaaagcagaaggatcacttgagcccaggagtagaagaccagcctgggcagcatagtgagacccccatttctacaaaaaaaaaaaaaaaa

SEQ ID NO: 11646 - DNA, 929 bp, Homo sapiens
aaagcgttctggaattagatagtggtggtggctgtaggacctggtgaataataaactgaaaatcactgaatcgtaccccttaaaaacacacaaagcaaattgacaaattattgggaggcaacataagagaatggggtgtgaactttggatcagtgcggcctggatatcagctgtgtggtgttcaaatagattgcataacctcgttgagtctcagtcttcccatctgtgaagtagggatcattcctacttcgtagggttggcatgagactccgtgagatgaagttggtgggtcacttggctggggcaggtgtcacggagcgggacctgtgattgttcagccacctactctgtgcccagtgctgtgttggtgaccaggtatgtatgaagtcagtaagccacagtcctgagttatggtgcagaccccacatgcacccagagtcagcttggcaagaccccttgacaccacgtgcgtggagggtgcaggtcggagagctcacctccatggattccgtagagctttgaggcgtatccacaaagtgtccaggagaggtggcgtcgcctccacttgatagaggaaaaagcagagatggaggcagccagaagcatggtgcagtggtggggtttggtcattaatttgataatcacatggaatacaagctaatgtttattgagtacttactgcctgcctgctactgtaactaagtgctttactcctgttatctcatttaattctcaaagcagccctgtggcactgaggtggctggagatggagggatgtgtggctgccatgtgtttgccaggaagcagcaggatgggagtgagggcacagacagacacacatgccaggacttgtttgcacgaagctgaggaatgggtgcccatcattcattatactcatctctctgttttatgtatatttgaaaaaaaaa

SEQ ID NO: 11647 - DNA, 1590 bp, Homo sapiens
atgattatttgaatttgtacttccctaagttctagtgaagttggacatattttcgatacattattgtcctttctgctttcctctgctgtaaattaattgcatgttcgtatcctctgctgtaaattaattgcatgttcatatcctctgctgtaaattaattgcatgttcgtatcctctggtgtaaattaattgcatgttcatatcctctgctgtaaattaattgcatgtgcgtatcctctgctgtaaattaattgcatgtgcgtatcttctgctgtaaattaattgcatgttcgtatcctctgctgtaaattaattgcatgttcgtatcctctgctgtaaattaattgcatgtgcgtatcctctgctgtaaattaattgcatgtgcgtatcctctgctgtaaattaattgcatgttcatatcctttgtccagtctccttttgggtggattatctttttcttagtgatttgtagattttctttttttcactctagagactaatcctttgtcagttcatgctattttatactctgcttttttcagttagcagcgtattgagaatgttcttctatgccaatgtatacatcattttattgacattccattgtggagatgggtcatttatttatttaggtggacgtgtaggttgtttgcacttttgcattagtaggaacatgactgtgtgtcggtcagctgggctatgctctggtactaatgaccctccaaatcttagtggtttgcagcaatgaagaattctttgtccctcaagtgacatgaccatcacctgttggttgtggctctgctctatgacgttgtccctcagggagccaggctttcagagcagccccatctgagacattgctggtctcatggcagagggaaaaaagatggtggaacaacataattctatttctgtttttcctctttagagacaggatattgctgtggcacccaggctgcagtgctctggtgctatcatagctcactgcagccccggaatcatgggcacaagtggtcctcctgcctcagcttcccaagtagctgagactataggtatgcaccaccacacctgggtaatttttactttttatatttttcgtagagatgggggccttgttatgttgcccaggctggtcttgaactcctggcctcaagtgttcttcccaccgcagcctcccaaagtgctgggattacaggtgtgagccactggacccggcaggaacaatatacctcttaaagcttctgctcagacgtgggaatggctatgtggtgcgtgtcagttcccctcacattgcattggctgaagcaaaccctggggcccaaccagtgttggcggggttagaagtagacccctcccatagggaggccagggagggaggattttgagccaagaccactcaccacgtgctgtgatgagcagttgcctccccctcctttcgtgtcttcgtgcctcctcacgtattcttacaagtagaattgctacattaggaatatgcatatttgtaaagtatttactatttattatgtcagctaggttttaactgtcactgcatttgctgtgaattataggtaattattcatcctgatgacc

SEQ ID NO: 11648 - DNA, 614 bp, Homo sapiens
tgaggcaggagaatcgcttgaacctgggaggcggaggttgcagtgagctgagatcgtgtgccattgcactccagcctgggtgacagagcaagactccatctcaaaaaaagaaaagaaaaattttatatatgtaatttaacttgcaaatgacaagtttttaatattttcttatttttgcttgtgtttgtttatgcctttaattccttgaccagaatgactgtagctaaattaactttggtagtgtattttcattcatttactatctcgtcatttccatgggtcaggagtctgggcacaccttagctgggtcctctgttgagagtctcaaaaaggctaaccagaaggtatcagccaaattgtatttatttctagaggttggagtgctcttccaagttcatggagttgttggcagaattcagttccttgcaactgtgggactgaggtagccattttcttgagggctaatggccagaaattgctctcagctccttagaggctattcacagttccttgccacgtggccttctcacagaccctctcagagcacagcagcttttacatcttcaagatcatcagcaggagatctgtctcctgctgcttctctcttacctcga

SEQ ID NO: 11649 - DNA, 456 bp, Homo sapiens
attatagtccttaaaaatccactttcataagctaaaagtgattttgtctttgggctgactcccctcatggttgcaaataaagtagcatgctccttctttttagtgggtaggaagtgctgttaaagtaagaaaactttttggaagtttcctcttaactccttgacctgaattggcaatagtttccaatagtcaggttaaaaatacgtaacttcaagtggaattatttaactaatttttgtatttccaaaattttacaaataacacatcttgaaactttttcataaagcaatcggatataatttaaaatatgtactaacatgcataatattttagacttgccacagcctaaaatcagataatcacacaaggtttttaaaagtatgaattaggtataaaagagagtttagacctttgactatgtactattttacctttttttttttttttttaaagaga

SEQ ID NO: 11650 - DNA, 101 bp, Homo sapiens
tggcggggcgggagggcgggccaggacaggaatgcagccgtttttaacagttctgcctacaaccaacaggttgaatgaggaattctagaaactgtctgctg

SEQ ID NO: 11651 - DNA, 1392 bp, Homo sapiens
ctcaggatatgagtcttcctatgtcattctttattctttcacatttatcatcttttatgatatgtacatatggcaaagattattcccactttacagatgaaggagcatttacttgaaaggatgcagaataaaaacagatataattcatatactaaaagacatttcatagacaatggcacaatgatttctccaaaccgccctacattatatgatttcttatcttcattgtgttgctgattaaacagtttaagtgatttatccagttcctcttaggaagtggcagaatagaaagctatgatggttaattttatgcgtcagcttgactgagccatggggtgcccaacatttagtcaaacattattctgtgtgtatctgtgaggatccttctggatgaaatcaacgtttgaattgttagactgaataaagcagatttctctccccaatgtatataggctcatcctatttgttaaaggtctgaaatgttgactctctctcttagtccgttctatgttgctgtagagagatatgtgagactgggtaatttataaggaaaggtggtttatttggctcacagttctgcaggctgtgcaagaggcatggcacaagcatctgcttctggaaagggacgtcaggaggcttccaatcatggcagcaggggaaagggagaagggcaaggtatgtcacatggcaagagaggaagaaagagggagagaagaagaaggtgccaggctctttttaaccatcagttatcatgggaactaatagagtgaggactcagcacaaagtcatgcataaaggatctgacccgtgatccaaacagtttccaccaggccccacctccagtgctggggatcaaaattcaacatgagatttgaagaggacaaatatccaaactatatcaccctcccataagtaagaaggcccctgtgagtgcagtgtgttttagtttaagctactaggaagggtgaggcaggaggattacttgttgagcctagaggttcaagtcctgcctaggcagcacagcaagaccccacctctaaaaaaatggagcccctcctgtcatagtacaccagatatttcctgtcttctaacttgaactgaaacatccatattttaaaagtctcaagtttacaaatcttgggactttttagcctccatatcacacaagccaatttcttataataataataatgatgatacaatatataggatatatattgtttctgtttcactaaagaaccctcatacagaagccaagcagcatcctctctaatgtcaaaatcagtgctttttctgtgacattcatgctcctctacgaatgaaaacctggctcacattttatgctaatactaaggagtaaaaaaacatccattacttattgtataccataaa

SEQ ID NO: 11652 - DNA, 1301 bp, Homo sapiens
gcacagaagtttgaaaagtaaccctgggaagaaatgaatgaggaggaaagaaaatgtacaaatgagaaggacccagtggatttgccatacaaagtaccttctgagtaaaaccactaaattactcttggggttgtggggaattgagatgccactggccatttttgccttagttgaccttttttgggtcagtagtttctcaaacatcaatgtgcctaaggatcaccttgtgaagtgtttaagattcagagtcctgagccaccctgagagatctggattaaacagatcaaggaatctgcatttttaactagcactgccagtgagtttgtggactacactgagaaaatggctctacaatgttaaaagcacacatattttttaaaaatgacaaatgccatttcaaacagacttacaacccatttatataggctttccctgcaaagtacacagttttgacttataatcaagcctacaggaatgtaactagcaagggagcaaaggagagcaggagattagaagaagaatcaataaatggctcaaatatgtgaaataaccttgttcatccaaaatacaggatggtggtgttctaactgtcatggtagggttcaattgcctcagttcaattttaggaaaactggcaatcatttcttttgcaggggacacaatttctgaagaacccagtcctttaaaaaaaaaaagtgagctatcaccccactattgagagagcagctactagctcagtattggtgtacccagatgggcagcctagcagccaaggaaacagaggtgggtctatgtactgtcccatcctgtcaccctttatcagtgagaccttgggcagagcctggctcatttcctggcatacaataggctttcctcatctgcacaatgaatatgcatccacatgttaaaccaccacttcgcaaattataaggttgaaatgagataataaagttgtgtccttagcatacagactggaccgttgagaagtgcagggggaaaaaatcagaaagatctgattttagatttttagtcaaactaagcaagaggacttaacatttcagcaactcagtttgcaccatgaatttctccactcaatttatgagaattactattcccttgaagtgatttaaggaatcattaagatttggcagtggaaggtgggactcatttcatataccattacccttaagccgagactactataagaagttggtacatggccaggcacggtggctcacgcctgtaatcccagcactttgggaggccaaggtgggtggatcacttgagttcaggagctcgag

SEQ ID NO: 11653 - DNA, 90 bp, Homo sapiens
atgagataccatctcacaccagtcagaatagcgatcattaaaaagtcaggaaacaacaggtgctggagaggatgtggagaaataggaaca

SEQ ID NO: 11654 - DNA, 2152 bp, Homo sapiens
tttctttatatatatatatttattatactttaagttctagggtacatgtgcacaatgtgcaggtttgttacacgtgtatacttgtgccatgttggtgtgctgcacccattaactcattatttacattaggtatatctcctaatgctatccctccctcctccccgcagcccacaacaggccccggtgtgtgatgttcccccttcctgtgtccaagtgttctcattgttcaattcccacctatgagtgagaaaatgtggtgtttggttttttgtccttgtgatagtttgctgagaatgatggtttccaatttcatccatgtccctacaaaggacatgaactcatccttttttatggctgcatagtattccatggtgtatatgtgccacattttcttaatccagtctatcattgttggacatttgggttggttccaagtctttgctattgtgagtagtgccacaataaacatatgtgtgcatgtgtctttatagcagcatgatttataatcctttgggtatatacccagcaatgggatggctgggtcaaatgctatttctagctctagatccctgaggaatcgccacactgacttccacaatggttgaactagtttacagtcccactagcaacttcagcaaagtctcaggatgcaaaatcaatgtgcaaaaatcacaaccattcttatacaccaataaaagacaaacagagagccaaatcatgagtgaactcccattcacaattgcttcaaagagaataaaatacctaggaatccaacttacaagggatgtgatggacctcttcaaggagaactacaaaccactgctcaacgaaataaaagaggacacaaacaaatggaagaacattccatgctcatggataggaaaaatcaatatcgtgaaaatggccacactgcccaaggtaatttatagattcaatgccatccccatcaagctaccaatgactttcttcacagaattggaaaaaactactttaaagttcatatggaaccaaaaaagagcccacattgccaagtcaatcctaagccaaaagaactaagctggaggcatcatgccacctgacttcaaactacactacaaggctacagtaaccaaaacagcatggtactggtaccaaaagagatatagaccaatggaacagaacagaaccctcagaaataatatcacccatctacaactatctgatctttgacaaacctgacaaaaacaagaaatggggaaaggattccctatttaataaattgtgctgggaaaactggctagccatatgtagaaagctgaaactggatcccttccttacaccttatacaaaaattaattcaagatggattaaagacttaaatgttagacctaaaaccataaaaaccctagaagaaaacctaggcaaaaccattcaggacataggcatgggcaaggacttcatgtctaaaacatcaaaagcaatggcaacaaaagccaaaattggcaaataggatcttattaaactaaagagcttctgcacagcaaaagaaactaccatcagagtgaacaggcaacctacagaatgggagaaaatttttgcaatctactcatctgacaaagagctaatatccagaatctacaaagaactcagacaagtttacaagaaacaaacaaacaaccccatcaaaaagtggacgaaggatatgaacagacacttctcaaaagaagacatttatgcagccaacagacacatgaaaaaatgctcatcatcactggccatcagagaaatgcaaatcaaaaccacaatgagatatcatctcacaccagttagaatggcgatcattaaaaagtcaggaaacaacaggtgctggagaggatgtggagaaataggaactgcaggttcactttcattttaggattattgaggtataatgtacatgcaacacgtattactatgtctaatgtacatttcaatgagttttaacaaatttatattgtcatgtaataatcaccatgatcaatttacagaacgtttccacttgctgtagtttggatgtttgtcccccaaagtgcacgttgaaatttgatccccaatgttggaggtggggcttaatgggaggtgttggggttattggagtggatccctcaagaatgccttggtgccatcctcgagg

SEQ ID NO: 11655 - DNA, 961 bp, Homo sapiens
gaggctgaatgagttggctcaggattatcttgtccatgttaaaaactgcatttgaacccaggtctgtctgactccaaaaaccaaatggtttcctcctcatcatttcagaaactagcaaaatgcttttatgtacaccatttgattttagaatcctgtacattttctaaatgagggcagtgagactcagaaaaatagtatgtccaaagtgactaaggtagtagagagaagattcaaaaccctatcccaggccttctgactcccattccaatgctcttccagctacatcacagatcttttgagcaccccctgaaatcgcacccaaactgatgttcacgtggcagatacctcaccaccctctcctcacctcacgccttaaattctcatcttcaggcccctctgtctcaggtgacactcatgctggtaaaatgtcctgtgttttctgccggaagtagccagcccagacaggtgcaggagaggtctgctctagagggatatattgcacagccttgtccctgcctcccctatttcaccgctgatttctgatgggacccccagatgagtatcatccccctcctggccatttacaacctgcaaagcaacttgagttcctccagagggactggcagctctgtcaagaccatatacgattttcccatgaaaagtacctttggaagaagatttcttcatcagtttccaccatgaacacagatggacacgtttctccagaatcttctctgctgtcatttgctgtcctgcaaagaacctgggattgtccttcgctgggacagagagggtcaggcccaggctggaagttctcggttccactggtgctctcggggggaaaaatgtggtatttttccttttgtcttttctgcttttgtttttcgctttgctccaagctgatgattctctcagcttctgtcttcatgatgccaacactaccaaatgaaaaataaataat

SEQ ID NO: 11656 - DNA, 630 bp, Homo sapiens
ggaaatataaaaatccctgatctttgaaccaataaacacagaatacctactgtgtgtcaagtactatgctaggtgttgaaacaaagataaagtactatggaaactattaacacacacacacacgcacatgcacacatgcacaaacctatattcttttttcttaccaaaaccccaaatcatgctcctaattttgaatgtgcaggtgcggtttttgggtgattgggttctttctttgctatgtgggaggactccggtagagtagggtggttgtcagacagaagcagatgctcttatcagccgggcattctcaccccaggtagaagtgctgtctgtggtcgctcagcagatcctcagcatccaacaagccatcattcggaagctaaagacattcatctttgaagggactgagctctctctgaacccaacctgcgctgtgttcatcaccatgaaccccgggtatgctggcagggctgaactgcccgacaatctcaaggtaaatgccagcagatatacatgtggggtgtgctttttagaatagaaacctctgggccgggtgtggcggctcacacctataatcccagcactttgggaggccaaggtgggcaaatcacctgaggtcaggagctcgag

SEQ ID NO: 11657 - DNA, 8371 bp, Homo sapiens
ctctgtttaaaaaaaaaaaaaaggagggaggagccaagatggccgaataggaacagctccggtctacagctcccagcgtgagcgacgaagaagacgggtgatttctgcatttccatctgaggtaccgggttcatctcactcgggagtgccagacagtgggcgcaggtcagtgggtgcgtgcaccgtgcgccagccgaagcagggcgaggcattgcctcacctgggaagcgcaaggggtcagggagttccctttctgagtcaaagaaaggggtgacagacggcacctggaaaatcgggtcactcccacccgaatactgcgcttttctgatgggcttaaaaaacggggcaccacgagattatatcctgcacctggctcggagggtcctacgcccacggagtctcgctgattgctagcacagcagtctgagatcaaactgcaagacggcagcctggctgggggaggggcgcccgccattgcccaggcttgattaggtaaacaaagcagcctggaagctcgaactgggtggagcccaccacagctcaaggaggcctgcctgcctctgcaggctccacctctgggggcagggcacagacaaacaaaaagacagcagtaacctctgcagacttaaatgtccctgtctgacagctttgaagagaggagtggttctcacagcacgcagctggagatctgagaacgggcagactgcttcctcaagtgggtccctgacccctgacccccgagcagcctaactgggaggcaccccccagcaggggcacactgacacctcacacggcagggtactccaacagacctgcagctgagggtcctctctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcacctctcctcctccaaaggaacgcagttcctcaccagcaacggaacaaagctggatggagaatggctttgacgagctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctagagaactacgtgaagaatgcagaagcctcaggagccggtgcgatcaactggaagaaagggtatcagcgatggaagatgaaatgaatgaaatgaagcgagaagggaagtctagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcgtgtcagagtaacagcggatctctctgcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagaaattttgtcaccaccaggcctgccttacaagagctcctgaaggaagcactaaacatggaaaggaacaaccggtaccagccgctgcgaaatcatgccaaaatgtaaagaccatcgagactaggaagaaactgcatcaactaacgagcaaaataaccagctaacatcatcatgacaggatcaaattcacacataacaacattaactttaaatgtaaatggactaaatgctccaattaaaagacacagactggaaaattggataaagagtcaagacccatcagtgtgctgtattcaggaaacccatctcacatgcagagacacacataggctcaaaataaaaggatggaggaagatctaccaagccaatgaaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatttgcacccaatacaggagcaccaagattcataaagcaagtcctgagtgacctacaaagagacttagactcccacacattaataatgggagactttaacaccccactgtcaacattagacagatcaatgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagggcaatcaaattagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacttcacaattaaaagaactagaaaagcaagagcaaacacattcgaaagctagcagaaggcaagaaataactaaaatcagagcagaactgaaggaaatagagacacaaaaaacccttcaaaaaattaatgaatccagaagctggttttttgaaaggatcaacaaaattgatagactgctagcaagactaataaagaaaaaaagagagaagaatcaaatagacacaataaaaaatgataaaggggatatcaccaccgatcccacagaaatacaaactaccatcagggaatactacaaacacctctacgcaaataaactagaaaatctagaagaaatggataaattcctggacacatacactctcccaagactaaaccaggaagaagttgaatctctgaatagaccaataacaggagctgaaattgtggcaataatcaatagcttaccaatcaaaaagagtccaggaccagatggattcacagccgaattctaccagaggtacaaggaggaactggtaccattccttctgaaaccattccaatcaatagaaaaagagggaatcctccctaactcattttatgaggccagcatcattctgataccaaagccaggcagagacacaacaaaaaaagagaattttagaccaatatccttgatgaacatcgatgcaaaaatcttcaataaaatactggcaaaccgaatccagcaggacatcaaaaagcttatccaccctgatcaagtaggcttcatccctgggatgcaaggctggttcaatatccgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccagtatcatactgaatgggcaaaaactggaagcattccctttgaaaactggcacaagacagggatgccctctctcaccactcctattcaacatagtgttggaagttctgcccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaacaaaataaaagaggacacaaacaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcaccctacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaacttgatcccttccttacaccttatacaaaaatcaattcaagatggattaaagacttaaacgttagacctaaaaccataaaaaccctagaagaaaacctaagcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgactcctcagggatctagaactggaaataccatttgacccagccatcccattactgggtatatacccaaatgactataaatcatgctgctataaagacacatgcacacgtatgtttactgcagcattattcacaatagcaaagacttggaaccaacccaaatgtccaacaatgatagactggattaagaaaatgtggcacatatgcaccatggaatactatgcagccataaaaaatgatgagttcatgtcctttgtaggtacatggatgaaattggaaatcatcattctcagtaaactatcgcaagaacaaaaaaccaaacaccgcatattctcactcataggtgggaactgaacagtgagatcacatggacacaggaaggggaatatcacactctggggactgttgtggggtggtgggagtggggagggatagcatcgggagatatacttaatgctagatgacgagttagtgggtgcagcgcaccagcatggcacatgtatatatatgtaacctgcacaatgtgcacgtgtaccctaaaacttaaagtataataattaaaaaaaagaaaaaagatcttgctgtctagactgttgcgatctagtaaagggaaataaaaaatttaatgaaacaaataccaacgtgctaaaagtctatagtagaagtacaaaagatgcatcacaaaagagtgtataattctctttggatgatgaataaagatcaggaaatataaaaatccctgatctttgaaccaataaacacagaatacctactgtgtgtcaagtactatgctaggtgttgaaacaaagataaagtactatggaaactattaacacacacacacacgcacatgcacacatgcacaaacctatattcttttttcttaccaaaaccccaaatcatgctcctaattttgaatgtgcaggtgcggtttttgggtgattgggttctttctttgctatgtgggaggactccggtagagtagggtggttgtcagacagaagcagatgctcttatcagccgggcattctcaccccaggtagaagtgctgtctgtggtcgctcagcagatcctcagcatccaacaagccatcattcggaagctaaagacattcatctttgaagggactgagctctctctgaacccaacctgcgctgtgttcatcaccatgaaccccgggtatgctggcagggctgaactgcccgacaatctcaaggtaaatgccagcagatatacatgtggggtgtgctttttagaatagaaacctctgggccgggtgtggcggctcacacctataatcccagcactttgggaggccaaggtgggcaaatcacctgaggtcaggagctcgagatcagcctgtccaatgtggtgaaaccccatctctactaaaaatacaaaaattagccgggcatggtggcatgtacctgtaatcccactcagctgctcaggaggctaaggcagaagaatcagttgaatgtgggaggcagaggttgtggtggccggagatagcgccgttgcactcagcctaggagataagagtgaaactccatctcaaaaaaaacaaagcgaaagaaaagaaacctctggaggtacctacctgggggtaaatttattcctccatccccttgggtggaagtgataagagagacccagctacgcccatatccacggactttaggacatggtctaccccctgttactaatgcattctgactggtgccctggaaacttactcagatggaccacttctctctgagaagagaaaagagtcagagagatgcttcaagtggctcctcccatctaggtcaacataggccagtgaaggccaagatagaatttggatccacatttctctctctctttttttttgagatggagtctcattctgtcccccaggctggaatgcagtggcatgatcttggctcactgccacatctgcctcccaggttcaagtgattctcctgcctcagcttcctgagtagctgggactatagccatgcgccaccatgcccagctaatttttgtatttttagtagagatagagtcttaccatgttggccaggctggtctcaaactcctgacctcaggcaatttgcctgcctcggcctcccaaagcactgggattacaggtgtgagccaccagtcccagccacatttctcattttttactgcccagtatttgtaagcaccccctgcatccatcccagccaacagccatattagatcgtcacaagcagctttcacaatgccatgggatagtagaaagcacccaggcatggtgtcaggaagcctagattctagccctggctctagctctaactgggtgactcaggcaagttacttctcctctaagatctaagataataatgcaatagctggtgcatactgaacacttactatgtgccacatactcttgcaagcacttcagttgcattctatcatttattctcatgataactctatgaagagggtaaagttagtctgttttgagatgaaagaatagagatctacaagggttgtataacttgcccatgctagtcggtagcaaaacaagaactcacatcaagatctgtctggctgggcgcggtagctcacgccttaatctgaacactttgggaggctgaggctgttggatcatctgaggtcaggagttcaagacaagcctggccaacatgatgaaaccccatctctactagaaatataaaaattagctgggcctggtgttgggcacctgtaatccccaggtgtttgggaggctgaggcacgagaatcgcttgaacctgggaggcggaggttgcaatgagccaagatcgtgccactgccctccagcctgggtgacagagactctgtcttaaaaaaaaaaaaaaaaaaaaaaaaaaaaaaa

SEQ ID NO: 11658 - DNA, 913 bp, Homo sapiens
ggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacgatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgactcctcagggatctagaactggaaataccatttgacccagccatcccattactgggtatatacccaaatgactataaatcatgctgctataaagacacatgcacacgtatgtttactgcagcattattcacaatagcaaagacttggaaccaacccaaatgtccaacaatgatagactggattaagaaaatgtggcacatatgcaccatggaatactatgcagccataaaaaatgatgagttcatgtcctttgtaggtacatggatgaaactggaaatcatcattctcagtaaactatcgcaagaacaaaaaaccaaacaccgcatattctcactcataggtgggaactgaacagtgagatcacatggacacaggaaggggaatatcacactctggggac

SEQ ID NO: 11659 - DNA, 1196 bp, Homo sapiens
agaaactttcccttcctgattctgtgcaagcacggctgtgagcgaacagcctccgtatttcaacaaacatcctacttgtatggtcttaggatctgtttccagacagtcacctcggggctcactctagtcctgaaagcatcttcccatccctttgtgatgttcagtctgttgcgggcattcccctctgacaggtgtccttgccctgctgcttctacagggtggcaaagagcaagggcttcagctcccaagctcagctgcagggcacttaggccccgagtgtgtccccagtgaccctgacttgagggacacactgggcgctgcagccacaaggcactgctcctgtagtcatggtgggcagccagcattgccccaggccacagtgctggtgtcccaggctcctcagggacctgaggacagggccaagtgtgccagtccacaccaggctggccctgccagtccacaccaggctggccctgccagtcaacaggtgcacatacaggtcctgaaaccacctcaggtcaaataagggatttgggggcacacaggttgcattctgcctcttgggaagatgatgcaagggaatgacaggcaggctggttccaacgcattgccaagcgccagctgagcgggctgggagcaggcacattccggtaaccaggacagaagtgggctagtgatacctggtcatgtcttttcccaagacaaaaccaggaagactggcccagcccgtttggtgtgttacaggctgaactgtgcccctccccaaatgtgtatggtgaaggcctaacctccagtacctccaaatgtgacctcacttggagagggggtgtttagagaggtaatcaggttaaaatgaagtcattagggtgggtcataaccccatacaactgctgccctgatatgaaggggaaatctggagacagctgtgtagaaaacaccatctgaacaggaagacagccatctacaggtcaaggggagaggtccgggaccgatcctccctcccagcccaaagcaggaactgaacctgacacctggattgtagacttctggcctccaggacagagacaatatgtgctgctgttgaagctgcccaggcagggttcctctgtgaggcagccccaggggactcagagtgtgccccaggagtcctgtgggaattgccccacccttcctggcacactcctgaatgttctcga

SEQ ID NO: 11660 - DNA, 1196 bp, Homo sapiens; identical to SEQ ID NO: 11659

SEQ ID NO: 11661 - DNA, 709 bp, Homo sapiens
ttagcaactcacttctttaatttcagaatccacagaggtaagtccagcttagaccagggggctgagttctctcaaatgaaatctgtgccaatatttactccaggaaggcaagagcccagcccttcaaggctcctgagatcaggaacggctggtggttaggaggcgctctcctggccgctctagctgtgtggggcaccccctgcatatgtggggcacacgtggcctatgcacaccacccacctacaagcttgggcggctccagtgggaaagacaggagagggaagcaacatttgattgaatctgagccaagagggccagaggctgaggaaggcacccccacagcagcctcctgagcaaacagcacctgggggctctacccagttgggacaaagggcgaggctcccagcaacagtaagggagatggcgtcctctgggagagggtggcctggggtggggtgacagggcttccacgccaccactgcaccctcggcaagaacgagcagatgtggagaagaggaatgccatcaatgcgccccccatctcgggtccctgtgctccccaccccacagttcttcctggagggccctctgcactcctcccagcaggctgctcggctccttgggccgctctgggatcccgtctggtgccactcctgaggtcggcacgtctgcatctgcactggctgcaggaggagaggctccctgcaggg

SEQ ID NO: 11662 - DNA, 1403 bp, Homo sapiens
taatttcaatattttaaatttatttacacttactgtagggcttaatatatggtcaatttttgtaaatgtcctgtgtatgcttgaagagaatgtatattaagcagtcccatggcacacagtttttgtttgcttgtttgagatggagtttcactctttacacaggctgcagtgcagttgcatgatctcagctcactgcaacctctgcctcccgggttcaagcgattctcgtgtctcagcctcccaagtagctgggattacaggtgcatgctaccatgcccagctaatttttgtattttttgtagagacagagtttcactgtgttggccaggctggtctggaactcctggcctcaagtgatccatccgcctcggcctcccaaagtgctgggattacatgtgtgagccaccgcacccggccccatggtgtactgtcctatacgggcctcaatcaggccaattttgttaaggagtttgttcgaatcttctacatccctcccaatttgttccatcattttcagagaaagatatgctaaaacctcccaaatatgattgtgaatttgggtgtttctccttttagttctttacattttgaggccagcagaggaaaaaatggattttttttttaacccacaacagtgttaatacaaaataaggcagggaagagaagccccctcggaagaggtgggacaaacaaaaagcacaaagtaagaaagtctgttaaagcctcaataaatcagtcagtcaattacatttaaatggattaagggctcccagttgacgagcaaaatctgtcaagatggtttatgagataaaatccataggttgtgcataggagccacatccaaaacacaaacccgcacaaaggttaacagcatgcctgctgctcttgaccaagcaccttcagcggggagcagtgaatcgtggttcttgcaccccgcaggccagcctcccttccatcaggacccctgggggtggccagaaaataataggggcacgaggagcccattcattcatattttgaagcggaaccttcacatgttcctgcctgctgggggactctggctggcagactgggaaggtcgcactcagatcagccaggacccgttcggctcacccaggatggaatgagcagcctggagccttctctgcccccaattccaaaccctggagctcctttgagttcaaaaaggtccttcagtttctcccatcaaagggaccacatttcctcttccaagccacactgcacagttcttaaaggagatgggcacagtgccaaagacctaaactgcatctagattttccactagatcaattctagaaggcgtttcagtgactgtggacaggtcctggagacctagacctagggaactgcttctgcaggaggaacgcagctgcagaccatgg

SEQ ID NO: 11663 - DNA, 709 bp, Homo sapiens; identical to SEQ ID NO: 11661

SEQ ID NO: 11664 - DNA, 1403 bp, Homo sapiens
taatttcaatattttaaatttatttacacttactgtagggcttaatatatggtcaatttttgtaaatgtcctgtgtatgcttgaagagaatgtatattaagcagtcccatggcacacagtttttgtttgcttgtttgagatggagtttcactctttacacaggctgcagtgcagttgcatgatctcagctcactgcaacctctgcctcccgggttcaagcgattctcgtgtctcagcctcccaagtagctgggattacaggtgcatgctaccatgcccagctaatttttgtatttttcgtagagacagagtttcactgtgttggccaggctggtctggaactcctggcctcaagtgatccatccgcctcggcctcccaaagtgctgggattacatgtgtgagccaccgcacccggccccatggtgtactgtcctatacgggcctcaatcaggccaattttgttaaggagtttgttcgaatcttctacatccctcccaatttgttccatcattttcagagaaagatatgctaaaacctcccaaatatgattgtgaatttgggtgtttctccttttagttctttacattttgaggccagcagaggaaaaaatggattttttttttaacccacaacagtgttaatacaaaataaggcagggaagagaagccccctcggaagaggtgggacaaacaaaaagcacaaagtaagaaagtctgttaaagcctcaataaatcagtcagtcaattacatttaaatggattaagggctcccagttgacgagcaaaatctgtcaagatggtttatgagataaaatccataggttgtgcataggagccacatccaaaacacaaacccgcacaaaggttaacagcatgcctgctgctcttgaccaagcaccttcagcggggagcagtgaatcgtggttcttgcaccccgcaggccagcctcccttccatcaggacccctgggggtggccagaaaataataggggcacgaggagcccattcattcatattttgaagcggaaccttcacatgttcctgcctgctgggggactctggctggcagactgggaaggtcgcactcagatcagccaggacccgttcggctcacccaggatggaatgagcagcctggagccttctctgcccccaattccaaaccctggagctcctttgagttcaaaaggtccttcagtttctcccatcaaagggacacatttctctctccacagccacactgcacagttcttaaaggagatgggcacagctgccaaagacctaaactgcatctagactttcccactagatcaatctagaaggcgtttcagtgactgtggacaggtcctggagacctagacctagggaactgcttctgcaggaggaacgcagctgcagaccatgg

SEQ ID NO: 11665 - DNA, 638 bp, Homo sapiens
tttttgtattttagtagagacagggtttcaccatgttggccaggctggtcttgaactcctgacctcaggtaatccgcccgcctcagcctcccaaagtgctgggattacaggtgtgagccaccatgcccagcctaatctttattatttccttctttctgctagctgtggatttagtttgttcttctttttcttgttccttaaggtgtgcaggtaacttgtttctttgagatctttcttattttaatgtaagcatttccagctgtaagttccttcttagcactgcttttatagcagcccatattgtgtttttgtttttattggccatgttgtgtttttgttttgttttgttttgttttttaagacggagtctcgctctttcacccaggccggactgcagtggcgctatctcggctcactgcaagctccgccacccgggttcacaccattctcttgcctcagcctctcgagtagctgggactacaggcgcccaccaccacgcccggctaattttttgtatttttagtagagacggggtttcaccgtgttagccaagatggtctcgatctcctgaccttgtgatccgcccgccttggcctcccaaagtgctgggattacaggcgtgagccaccgtgccctgc

SEQ ID NO: 11666 - DNA, 279 bp, Homo sapiens
gacggagtctcgctctgtcgcccaggctggagtgcagtggcgcgatctcggctcactgcaagctccgcctcccgggttcacgccattctcctgcctcagcctctcgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcc

SEQ ID NO: 11667 - DNA, 283 bp, Homo sapiens
taagacggagtctcgctctgtcgcccaggctggagtgcagtggcgcgatctcggctcactgcaagctccgcctcccgggttcacgccattctcctgcctcagcctcccgagtagctgggactacaggcgcccgccactacgcccggctaattttttgtattttttagtagagacggggtttcaccgtgttagccaggatggtctcgatctcctgacctcgtgatccgcccgcctcggcctcccaaagtgctgggattacaggcgtgagccaccgcgcccggcc

SEQ ID NO: 11668 - DNA, 138 bp, Homo sapiens
ttttttttgagacggagtctcgctctgtcacccaggctggagtgcagtggcgcaatctcggctcactgcaagctccgcctcccgggttcacgccattctcctgcctcagcctctccgagtagctgggactacaggtgc

SEQ ID NO: 11669 - DNA, 265 bp, Homo sapiens
ctgtcacccaggctggagtgcagtggcgcgatctcggctcactgcaagctccgcctcccgggttcacgccattctcctgcctcagcctccccagtagctgggactacaggcgccccacaccacgcctggctaatattttgtatttttagtagagacggggtttcaccgtgttacccaggatggtctcgatctcctgacctcgtgatccgcccgcctcggcctcccaaagtgctgggattacaggcgtgagccaccgggcccggcc

SEQ ID NO: 11670 - DNA, 285 bp, Homo sapiens
agacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcatgatccgcccgcctcggcctcccaaagtgctgggattacaggcgtgagccaccgcgcccggccaattt

SEQ ID NO: 11671 - DNA, 145 bp, Homo sapiens
tttaagaggagtctcgctctgtcacccaggctggagtgcagtggcgtgatctcggctcactgcaagctccgcctcccgggttcacaccattctcctgcctcagcctcccgagtagctgggactacaggcgcccgccaccacaccc

SEQ ID NO: 11672 - DNA, 129 bp, Homo sapiens
gctggagtgcagtggcgcgatctcagctcactgcaagctccgcctcccaggttcacgtcattctcctgcctcagcctcccgagtagctgggactacaggtgcccgccactatgcccagctaattttttg

SEQ ID NO: 11673 - DNA, 261 bp, Homo sapiens
tcctcccctgacaaatagggataataatgttactgctctattatccacaattatggttataagaaaatatatattttttttcaaataaaatactctaccaaagcctgaggtcaatcatgattctttgagccattcattttccaaagagaactttattgagcacataccatgtgctggaactcaaggtagttgttggcaccatagccataaagcaaggaaacacagaatggttgccctcatggggatcagagcctggcaggg

SEQ ID NO: 11674 - DNA, 131 bp, Homo sapiens
tcacgcctgtaatccgagcactttgggaggccgaggtgggcggatcacgaggtcaggaaattgacaccagcctggctaacatggtgaaaccctgtctctactaaaaatacaaaaaattagccgggcgtggt

SEQ ID NO: 11675 - DNA, 5070 bp, Homo sapiens
ggggccgggcgcggtggctcacacctgtaatcccagcactttgggaggccgaggcgggtggatcatgaggtcaggagatcgagaccatcctggctaacaaggtgaaaccccgtctctactaaaaatacaaaaaattagccgggcgcggtggtgggcgcctgtagtcccagctactcgggaggctgaggcaggagaatggcgtgaacccaggaagaggagcttgcagtgagccgagattgcgccactgcagtccgcagtctggcctgggcaacagagcgagactccgtctcaaaaaaaaaggttttttggttgtgtttagcaactatatactttgccagtggtcttcatcgtaataatcaggtgattaacttatagatgttctagaactcctccacacattctgatgtgattgtatattttcattattcttccttttattaataccttatggcagtcgtagcaaaccacaagccctatgactaagtattcttttcttatactctcttgtcattcagccctgccaccattatctcttacctcaccacctccacaacatccactgctgtggctcatctccctgtcatccccctgaccaccattctgccagctggccggaaagaatctggtgaatcttgactaccaagttatttgctgaatccaggcattttccttgctgtcataacttcatcacttgttatgttctatcctaagatgcttcatctattcagtgcacttttattgctttttggctctgggcagtgtgatgctgggagtgcagtggtgagtaaggcagcttggaagctgccttacttccatgagctgtgcttaaccatgcttagaatgccaggcccagaccacggctttatcgctggtgtttaggcctaagccaagcacaagttggagtcttgaattatgatgaaatctagtatgctcagagtctttgaaggttgaacaactgaggtcatgaaccccaacctggtagattgtagggtaccagctgccgtcattcccaactcattgcttaaaagattcttgtattcctgggagtggtgctaggatgacagagctgaaggggtgatagctgtccccacacctctaggaagatgtggtctgaacccacagatcccctcactgacatgctgcccttcctcctccaccaccacttgctctccagtgttggagtagcatcataactcatccccacaaaaagattagggattcctttttaaggctgaagtgtaccactaaccattttatgtgtatttgttccccacactccaccctataatacttttaagattgtgaagggtcatcattttaataaaaatagctgccagccactttctattttgcttagactggaatcaaagggaaggggcttattatatgtgccaggaagacatttgtttgttgtttgtttgtttcccccaggaaggaattttagggataaaaagaacatcataacagggatgatttggaatagtttacaggtaattctgattagaggcatcttagacacacatgcctttctgttgagcagttttttgcatgctaggaatgatgtgctgacaccatttgcatgctcattttcactggagggtgggcagtggcacttagaatataagagtaaatgtttcacttggatgtctggctctagttcattgtatgaagaaagagggcatggaaatgtattaaataatacatttagatttgaggattgtcttaatttacttactgcctagtctttcctcacattacttcagataattagaaattgttgctattctaaatagtattaccttccacattttgaaggtagagatttctgtctttgttctgctgtatacaatgccagtgtctgacacatagtagaggctcaataaatgctggctgaaggggtgaatcagtgggaaattttagacctagacaccatcttggataaatcttcaggaaatcctgctgtgcctgactcttggatctctcaagtcatccattccagtcggttgccgggcccaccattttcagcaagtggtggttatggcaggtttagtttggctgattcaggtatgtggcatgttgacaagcactatactggagtctgtcaccatggcatttcaaacacatcaacagcattcataggcatagcagtgatcctgatggacatttgggctttggggaaaaacaggaccatatcattacattattaatgtttctcatagaccaacaccatcttctgaattcttaggaagctattcttcttgtagatatatactagatacataaagttttaaccgatacacttgaatttgtatttctaactgattcataatatcagttagcttaaaaacataagaaataggtgaatgatttctgctattgaaactgaagatataaattaataatagctgccatttattgagtccaagctatgtcccaggctctaggtgaagtagtttacaaatatctcagtagatcctcaaaatgatcaagcgtggaagaagtattgtcctcattctgtaaatgaggacatggagactgagaggaataaaataatgtctgcaggatctcccatttaatatgtggtggagcctaagttagaagcctcagactctagcctgcgttcttaacaccacaccatgttcacactttctgtgctaaccagtgaaatgaaacttcatgatgacatggcatataaatgatctgggttgttcatacagtccaaaggatggtagagctagggcagttatttgggtaattttaatattgtaggcagccaaacacattgcatcaggaattatgcagaatccactttgaattgtttttattgtggtaaaatatacataatagaacatttatcattttgaccattttaaaatgtatagttctttactttgactttttttttttttttttgagacggagtttcactcttgttgcccaggctggagtgcaatggcacgatctcggctcactgcaacctccacctcctgggttcaagcgattctcctgcctcagcctccctagtagctgggattataggcatgcatcaccatgctcagctaattttgtatttttaatagagatggggtttccccatgttggccgggctggtctcaaactcctgatctcaggtgatccacctgcctcggcctcccaaagtgctgggattacaggcgtgagccaccatgcccgggctgacctttataaaataaaattatttacatggaaacaattgtaaattgcctttacagcgtgtagccaaagtgaagcatttgtatttgaggctggaagaagggaggatagaggagttgtttgtcatttaaacaataatgtatgtttttctggttgcaaaaaggatacatatactacaggaaactttgaaaatcccaagaaatcatctaaaatcccactactctgagagatatattctgttaacgttttatttcatgtattctttgtctatgtgtatatgtgtgttttatatgatttatatttatttatattttatgtttacttacaaagttggaagccagacctggaaggacttcccctaccatactaaggaaatttaatttaattttgagtataaaggagaggtgctaaaggattttgatcaatgaagtgatagttctagtacccttacggaaagtggattagaggaggctaagaatgaaagcagggaagctggatgtggtggctcatgcccgtaatctcagcagctcgggaggcggaggtgggaggactgcttgagttcaggagtttgaggccagtctgggcaacatagcgagacctcatctctaaaaaaaagaaagaaagaaagaaaaaaaagaatgaaattaatcagggaaatcaattaaagatgatgggaatccaggtaaagactaatttgtgagaatctgaataaggccatgtgtgtggtaggtaagattctggaatatttaggacattgagtctccaggacttagtgactgattggctatagagaagataactcccacatgtgtgcttgggctggctgactgggttgtattactttcaccaaaatggtaatacaaggacaaatagaagattcagaggagacaagacaatcttgttttactttgttgagtttgccgtgatcacaaggggatatctattggccaatgtccagacagtggtctcttgagtaccccagcctagcccttcagcctcagcttgtgccctccgcccattagatctgtgcagccttgccaagctgactttctttcactcaatccagcggtctctggttcaacatcagcaagagatttacaatgtttctgctatttgccaggtacctgggcttcccctcttcaccgcagctcctagccctttgcctagtttaagtctactaagttcccaggctttggctttaatgtcatttcctcagggaagcctcccctgcccactccagcccctcaaccagattgaattacacccctagcatatgagctccccatgcatcttcatagcagttgtcaaaattataattagttgtatagatattggtttattgtctgttgtctttgttagccatctacaagaggaagagaccttttctatcttgttcactgctagtaggatctagtatagtatcaggcacacagtaggtgctcactaaatatttatgtagtagatggacaggtgagtagttctagcacttagtacagaagtgtggtctggggatatagattttgcagtagcatacaggtgttagtttaaacatttggaaggtaaaccttttagaaataccagacatgggctgggcgcggtggctcacacctgtaatcccagcactttaggaggccaagtcgggcggatcacgaggtcaggagatcgaaaccatcctggctaatatggtgaaaccctgtctgtactaaaaatacaaaaaattagctgtgtgtggtggcgggcgcctgtagtcccagctactcgggaggctgaggcaggagaatggcgtgaacccgggaggtggagcttgcagtgagtggagatcatgccactgcactccagcctgggtgacagagcgagactgtgtctcaaaaaaagaaa

SEQ ID NO: 11676 - DNA, 1152 bp, Homo sapiens
  misc_feature (1110)..(1110): n equals a,t,g, or c
  misc_feature (1112)..(1112): n equals a,t,g, or c
  misc_feature (1120)..(1120): n equals a,t,g, or c
atctagaataccatctccactggttcactcagtaccaagtttttgtccttctttgacctgaatatttggaaattttgtcattagatcaccataagctttatttgtgtttgttccaccttctttccaaacctcgggaagaaggtttgcacaggctctgtgagggctcttgtactgtagctttgcccctcttcccatctttaaacttttctctgaattaggccttgtgtgagtaaaagattatgtcttattaaattcatgtgtttctgacaggttggatttgtctattaagtaacgggtttttctcaggctgtttttatagcatgctattttctccctgcagcatgcctcttccgatgtcgaaagaatgatcctgggtaacaaatgtgatatgaatgacaaaagacaagtgtcaaaagaaagaggggagaaggtaaatgtgaatggaatggataaaggttggaatctactcacattaagcatttcttttcttcatattatttaattattgattttttttaaaatctgtgttttaatccctttaaattggatatcaacaacaaagagatgtaatccatacttgaatggtgtgaattagtattcgagatccagctctctatactgtgtggtcatgactcattcctaaagaatttgctaatgttttctgggagatacaaattggtcctttctcagattcctgcagcttagagttcaggctgtttcttccagatctgtgtgaaaatgcccagttttgaagttaaagtaaacattctttttgaaaaagaagttatagggataggtgaagtttcaacaggaatcattttccaattcatttttttccctaagaatattttactacacattagcgttaggttttatggataaattccttgtaactgatcaagctatggatgtcatttatatgttgtttatgggcatgggcatttctctcttttgtgtcctgtaaagcaaaggaatattttgtgtacatatttacttctgtgacagattctaaattgacttagaagcttcactttttaagtcttggaattttgctttagcctttaaaaaaattatatatgcaaaatgcattttcttttctttttttttttntntgagacanagtcttgctctgtctcccaggctggagtgcag

SEQ ID NO: 11677 - DNA, 890 bp, Homo sapiens
tgtgtgccctgcattccaaggaatgggccaagggtttagatgaccctcatagataaggaatgaggctccaggctggccactcctggatttcttagcttggaactccaaaaccagcactcttcttagaccacagggccagtctcagggtatgtttaagttattgctgtcaggtgcatctgccatacactgtgtgtttgtgtgtgtgtggtgcagtgtggtgcatgtgcgtgtgtgtgtgtgtgatgtgctggagttgctgtgtgtgctgagtgggagagctcaacttcattccttgggtgacaagggagaagatactgatgggaggaggcgaatcacaggtttgcatttctgaaaatttagtctggagaaagacggacaggctatggggacatggagcaaagctacttcagtggtccaacaaagagatgatgagggtcagagtcagggacgcagctgggggaaaaacgtgaaaaatactttggagataaaatggtcaggaccagatccttgcctttaactattcagtgcctgaatatatccttgatgacacagtagactgagaaaggaacaatctgcacaagaatgagaaccttggtggggggtggtggcttacgcctgtaatcccagcactttggaaggccgaggcaggtggatcacaaggtcagaaaatcaagaccatccttgccaatatggtgaaaccctgtctctactaaaaatacaaaaattagcctggtgtggtggtgggcacctgtaatcccagctactcagaaggctgaggcaggggaatcgcttgaacttgggaggtggagattgcattgagccaagatcgaaccactgcactccagtctggtgatagagtgagactccgtcttaaaaaaaaaaaaaaaaaa

SEQ ID NO: 11678 - DNA, 1429 bp, Homo sapiens
tttagatgctgggccatatcactgagtgactatagttgattctcaaaacatccatgtgccaaatgattaatgaagtattaatatttatcaaatctactgatttatcaataacttgatttaaggaatatgcatctggaatatatcatatatgaatatgtacttttttactcagcagtaacttactattctttttctatttactgctccttcctactgggtctctctctcttgctctcgctctctctcgctctctgtctctctcttcttgaggtattttccctcctctttctattcaaagctttattttcagtctttgctttcttacagtgttgagttgtttctctgtattcctgtgtgcagattttgttatttttatataatttattcctttattctttgaagctgatctacccctgtctggctcccttttattgtgactagactctgggcagctttttattgacacagaaaccatttttttttccacacacccactcccactccatatcattcgtaccttttgaaggaggaatacacgtctgaaatagtacttctcacacagcacagcctggttcttgtcttgagccaagtctgtaacttggcttaagcagtttcctcattagataaaccctggctcttaaatgaaaaacaagcaacttcattcaatccccaaaacagcctgccgcagcacgaagagcagccacaccccagtggtgccagctttcttctcttttttttccatgtctgccctcttactagcttgcaccagttctgctgctgcatgatgttgtctgtggagtgatttttttaaaaagtatcagctgcttctttccatcctccttcatcatgtatttcctttaggagactttgttcctctaatccgttccaaaaagtaaaactattccaggctcattgcctcagggggagagtcaggccggtggaaaacaaggagggaatggaggaaatggtctcctcttaacacgttccattccagaagtccaggccctttcaggaaagccacgcgttactggcatgcatgaaacatttgggcgacaacctaaattagagcagtgcatcctcctgccatatccccttccccagctgaggagaggaggcagtttctgaagaacaaggaaggagagcatagattttcctaggctttgaggaagaagacctgcatcctgtttggctggactaattgtagggaggcttgtgggatctaaggagagaaggaatggctgtctcccttgctgagaagggtcacagggaggcagccagaacccagtgggcagcaacgacttcatagtgtggctgaacagcgagggctccagacagctcttccagaggccttggtgtccccaaggccctgatacagtagagagagccactgaaccaagggggcccatgcagacaggcacatagggagccc

SEQ ID NO: 11679 - DNA, 937 bp, Homo sapiens
tcagtggctgtccacatcgccagtgcttcacctgaggaggctggcaaggtgtgtcctctttcacctgcctcagttttcctcattggtgaaatggcctcatggctttggagcaaagagaatgacagataaaagggacaaatgacaccgggatctccatttgtttaacaagtacttattgagaacctactgtgtgcagggcaccaagccaagctgtggagaaaacagaagcaggtgaccagatgggagagctcgagaagccgctaggaggaggaggcagttgagctgtgacctggagcaggtggaggggcctccctgggaagatctgggtgtgggaagcacctgccagggagggggcacctcaagtcaaaggccctgaggtggggacaggtgagacaagaccaggacaagccccgctcttgctgttgtctggaaactaaggcacaaagagaggaggggacggagccaaggccatgcagctggcagaggtggagctgggatgttaggggaggaacagaggtcacaacctccacaggcttcttcccccacccctcactctcagccagtcttccttcccttcctgagccgccccagctgtggcggcgcgctgctgtcctggttcccttgtttaattacaagcaacatttttcaccctcacttaatgatgcaacagacacccgtggatctgccaccatctggccccactttctggcttgagatgatgagtcccagtgactttgagggctgagaggggagcaagggggaggcacctcgactgggagggtgccgagcttggcatggcctcagctctgtgatgtacctggccacgtctccaagtcctcatcagcagaattgggacaattgagggctggcgcgagggtctgtgagacaagagctgcttggcaaagaggagccctcagccctaaagggggcctcgagg

SEQ ID NO: 11680 - DNA, 129 bp, Homo sapiens
gggcgtggtggctcatgcctgtaatcccagcactttgggaggccgaggcggatggatcacgaggtcaggagattgagaccatcctggctaacacagtgaaaccccatctctactaaaaatacaaaaaaa

SEQ ID NO: 11681 - DNA, 1155 bp, Homo sapiens
aaaggattgttttttgttgacttagcaaaaacttctccttacaaaacctcttgagtgtgctgaattgtgaacaggaaattgacttggggtaaggggagagagggaaccagggcactcttaaagagaaaaagacccctgggtcgataaccaagtggtcctgggactggatctggctattacatgcacatcaacaatcttatgtacttgctgattaacaaattatatatattctgcatgtttgcacaaacagttcttgtgctagagagtccacatcatttaaactttgtgggagaattttgcaaatgatccaatcctagaggcttgtactctttcttgagccccactcacctttcctttgtacctcaaacctcagtctgactcttccagaaatataggggatggttcccttctcttctcccattccctacataaccctgagtttaaatacaaacactcagtttaattgtttcataaggcttatttttggataaagatatttcattttccctgcacattaaacttttatcacacttactgataaaatgccacagctcttgtattatcaactacaagttcagtcttctacttagataccaattaatttctgtttctttgagtatcatggactgaattttgtcccccactcattcatgtgttgaagacctaacccacaatgtgtttatatttgacatagggcctttaaggaagtaattaatgttaaataaggccataagggtggagccctaatccaacaggattagcattcttgtaagaagaggaaggggcaccagagttttcaagcacacaagaaaggccatgtgaggagccacaaaaccacggctgtctgcctggcgtcgtggcacacacctgtaatcccagcactttgggaggccaaagtaggcagatcgcttgaggtaaggagttcaagaccagcttgggcaacatagcgagacccatctctagaaaaaatacaaaaattagcagggtatggtggcaggcacctatagtcctagctgttgtaggggctggggtgggaggatcgcttgaacctgggaggcagaggttgcagtgggctggaatcaggccatcgcactccagcctgggtgacagagagagaccctgtcttttaaaaaaaaaaaaaaaaaaaaaaaaaaa

SEQ ID NO: 11682 - DNA, 1156 bp, Homo sapiens
aaaggattgttttttgttgacttagcaaaaacttctccttacaaaacctcttgagtgtgctgaattgtgaacaggaaattgacttggggtaaggggagagagggaaccagggcactcttaaagagaaaaagacccctgggtcgataaccaagtggtcctgggactggatctggctattacatgcacatcaacaatcttatgtacttgctgattaacaaattatatatattctgcatgtttacacaaacagttcttgtgctagagagtccacatcatttaaactttgtgggagaattttgcaaatgatccaatcctagaggcttgtactctttcttgagccccactcacctttcctttgtacctcaaacctcagtctgactcttccagaaatataggggatggttcccttctcttctcccattccctacataaccctgagtttaaatacaaacactcagtttaattgtttcataaggcttatttttggataaagatatttcattttccctgcacattaaacttttatcacacttactgataaaatgccacagctcttgtattatcaactacaagttcagtcttctacttagataccaattaatttctgtttctttgagtatcatggactgaattttgtcccccactcattcatgtgttgaagacctaacccacaatgtgtttatatttgacatagggcctttaaggaagtaattaatgttaaataaggccataagggtggagccctaatccaacaggattagcattcttgtaagaagaggaaggggcaccagagttttcaagcacacaagaaaggccatgtgaggagccacaaaaccacggctgtctgcctggcgtcgtggcacacacctgtaatcccagcactttgggaggccaaagtaggcagatcgcttgaggtaaggagttcaagaccagcttgggcaacatagcgagacccatctctagaaaaaatacaaaaattagcagggtatggtggcaggcacctatagtcctagctgttgtaggggctggggtgggaggatcgcttgaacctgggaggcagaggttgcagtgggctggaatcaggccatcgcactccagcctgggtgacagagagagaccctgtctttaaaaaaaaaaaaaaaaaaaaaaaaaaaaa

SEQ ID NO: 11683 - DNA, 1155 bp, Homo sapiens
aaaggattgttttttgttgacttagcaaaaacttctccttacaaaacctcttgagtgtgctgaattgtgaacaggaaattgacttggggtaaggggagagagggaaccagggcactcttaaagagaaaaagacccctgggtcgataaccaagtggtcctgggactggatctggctattacatgcacatcaacaatcttatgtacttgctgattaacaaattatatatattctgcatgtttacacaaacagttcttgtgctagagagtccacatcatttaaactttgtgggagaattttgcaaatgatccaatcctagaggcttgtactctttcttgagccccactcacctttcctttgtacctcaaacctcagtctgactcttccagaaatataggggatggttcccttctcttctcccattccctacataaccctgagtttaaatacaaacactcagtttaattgtttcataaggcttatttttggataaagatatttcattttccctgcacattaaacttttatcacacttactgataaaatgccacagctcttgtattatcaactacaagttcagtcttctacttagataccaattaatttctgtttctttgagtatcatggactgaattttgtcccccactcattcatgtgttgaagacctaacccacaatgtgtttatatttgacatagggcctttaaggaagtaattaatgttaaataaggccataagggtggagccctaatccaacaggattagcattcttgtaagaagaggaaggggcaccagagttttcaagcacacaagaaaggccatgtgaggagccacaaaaccacggctgtctgcctggcgtcgtggcacacacctgtaatcccagcactttgggaggccaaagtaggcagatcgcttgaggtaaggagttcaagaccagcttgggcaacatagcgagacccatctctagaaaaaatacaaaaattagcagggtatggtggcaggcacctatagtcctagctgttgtaggggctggggtgggaggatcgcttgaacctgggaggcagaggttgcagtgggctggaatcaggccatcgcactccagcctgggtgacagagagagaccctgtcttttaaaaaaaaaaaaaaaaaaaaaaaaaaa

SEQ ID NO: 11684 - DNA, 17257 bp, Homo sapiens
gtagtcagaaccaactttataataatatttaagcttaaattaaatcctaagtaagatacacagcaaagtacctacttttcagctaattcactagacaaacatagcttaacaaacacgtattagaaggcccctcttcacaatacttacccttaaaagctgacattttataattgtgttgtatagcagcaactatatccttccaaaaatcaaatgttttttgaccattgttcagctgaaaaaataattccaaatgaaacaaacacaataattcagtttttaagcatagtgaaaaatgctggcaaacaattacaatgcagacagtccctgacttaagatggttagacttacaatttttttattttataatggtacaaaagtgatgaagattcagtagaaacttaacttcaagtacccatacaacaattgtttttcactttcagtacagtattcaataaattacatgagctattcaatactttattataaaataggctttcttttgatgactttgcccaacagtaggataatggaagtgttctgagtatgtttaagataagctaggctaagctatgatgttcagtaaactaggtgtattaaatggatttatagtatttttgacttaacgatgggtttatcaggaaaaaaccccatcataagttagggagcatctgtattactatattctgatataagtttatattttacaaaacataataaagttatcattcttctaaatgtaattttaaaaagaaatcttccatgaaaatcactgctacatatacacatacatatcactaaattttaatatagctcatatagcccaaataaaataaaaatttccactcgttataaagtctaaaaattatagaatatttttaaacacagcaaattcatagtgttatataatttctgggatatcagaatgtgttatataacatactatggcatcaatgggactaagaagactgacgccctaaaaccccaaaagctagttactttagaattcagtgcacacttaacctgaatttcgatatgaaagagctgcaagtctcaacagaagagatgaatgaggttccaaatccgaactgtaaattgttttcattaagtttttttaaatcagaaagcaaataaacattacattaaaatatacaaccctatgatcctttgcttccttgaaaatgttaaccagtgacctatctaaacaaagacagactactagatatttatatctaattatacaaactccaaaatatttaaagactgatacactttccttgtagtaactaccgaatgagaaactgactccatcttgtgttattaagatttctacaaacatacccaaactattgctcaatggaaactttcacaacacataaatgtaattctgattcacaaataaagcattacctgggttctattatcaaaatgatagtaattattattattattttgagacgcagtcttgctatgtcgcccaggctagagtgcagtggcgtgatctcggctcactgcaacatctgcctcccgggtttaagcaattctcctgcctcagcctccctagtagctgggactacaggtgcacgccaccacacccagctaatttttgtatttttattagagacaaggtttcaccatattggccaggctggtctcgaactcctgacttcgtgatccgcctgttttggcctcctaaggtgctgggattacaggcgtaagccactgcacctggccccaaaagtagttatttttaaaagacatgcataaaggaaagtgattctgacatataaatctgtttgatgttcataggtcttaagtcctaaggataaactagtataaccagagatctatttaatcttgatatacagtacaaaagaaaaaatttatattcattaaatgatgttcaaaatggtgaatttttaaatttcatccgatttttctattttatattatttagaatgcttaaagacacgctgaattttcttaatcacctctaacttttttattttgctaatgaaactatttattttgctaaaaaaaatgttttgtccagatccaagttctgtatttcttttctttttctaaacttttgccccctctgctggagaataggtttatttttcctgagagaaaaaaaaaaggtcactgctatttaattttccaaaaatatttgaaccaaattcaccatgtttttctttcccagtcagctctgaaaccacaaagaagaaactaagcaaaatcacaactcagaagcaatatataattaggtcctccaatttatgactgactacatatcatagttttaaaaaatgagtccccacttacttttgttaaatagtccaccaccctggcacacagaagagctcctggcaggtcaaagtagttgtcgtaaaagtaatactttcctaaaaaagaacaaaattttaaactgggaacaacataatgctgcatgcatgtgaaatacacaggaatatggctgaagagacactagattttgtttaattatctgaagaagcctccattccaattcaaagtggcaccattattggctgtcattgtcttttaagaaagatttaagctctgagggcaccacaagaaagttaaaagatgatatctagaagttaagcattgtattcgaagatattttagtcatcttaaagaatgtaaaaactaaaaagagtatatgcaaaaaataaaatagaatatgaaaaagccatatgatgttatctatgtcactgaatttcaaaacaatcaatttacctaaccctggagtaccatgaagcgctctatacaatagtgctttttcagattggttggctgacccctcctagagtactgtattctatttttatgccatttaatttcagtataatgtgaaaaaaactggggtgataagtagaatataatcatgccatgtgaagacacagtgtgcttaaaaactgtagagtataggacaggtatattccaagatttcgtggaagagagggatttggtttattctgtatgactttagggtagaattacatttgagcccttctttggcacatgtgacttttggatctgctgtccctgaacagacacttttgatgacccatgtcacatccccttggcctgcgtctgattgcagccactgctatgctaatagcaccatcccaccttggcaaaactgtgtcgattctctttctcccaaaggctctggagcccatgtggcaaacttcacatttagaacaggttcaggaaccagtaaaagaatgccctgcttcctgttccatggacagacaactctaggaggtattctctgcgcttctccttggaagtcccaatggagtccagcaaccattgttccttccatgtcttatcctctcattccttcactcctgactactgggatcaggagtaaccactctgcttttgagggaacccaacctcatacagttccctagagaacgcttgatacaaagaagagtcaaacagaaccaataggtaaagccagattttacattaataataaggtgcttgaatacatcattataatcacctgattttgactccccccccctccccccaatttgcaagctatgtatatgaggttatggaacacacttgtcttgttctttagcgttgactgggcacagtgttcagcatattctaagcactcaatagacgtttgctgaatgaatgaatgagtaatccaataagcaaatagattactttggaatgcagaagtattataaggaaattagaagaaaaccatatgcagaagccagggttctgttcctctgaatattgttttctgcctcttacttcttcctgtaaatttattttaaaatgtataaaaaaaaaatcaaagttttctgttagttcacaaaatggctgtgccagtttgtgtccattctctcagttaaaaatattttggttgatatagtcttcctgtttttcattttttcacagcttgaattgttaggggaacctctcaggctgtttttaattcctaagaaaggttaggatggctttgccagtgtgaagaaccagtgatctggaaaaaaaggaagatgatatgccatgtgcttttctgcctctgctttgctatgctgtaggactgtatgacactccaggactcccaagacttaggacagtgggcaaagcttcccaaggttcattaatctgcactttgtcatatcgcttggcctgacactagactgacccaacttcatggtcagctgtctcaggcactgttggagcaggaagcatcccagcattgccagttacatacccttgcttttctcctcccattcttcttcctttgtgggtactaatagatgaaattcagtctaagagttgaactattgattttgagtaagggctgagttctaattaaataattcagggggaacctaatgagaagagctcattggttttcacccacaatgcaagaggctaaggtcatttgactgttgaacttgggctgaatgtccgctgtgtggacacaagggcttgttcagccttgagctgttaactgggccaggctgcttgcaatgcctcacccaacacccaaactctgacactacaccacatgaaagcttcaacgtccacctctgtatagaagagacagctcattgctaatgaagtgattagtgagcccagttcaacaaaacaagcctctgaatcaagatcaagtcctataaccattaagttttacacagagaaaaactgctccccaagaaactactaccaaccctactccctttgtcttagtggccatggtagaatggcaaatgaaggactgaggggaaaggaacaatttatgttaacaaaggttctcacttctgcaaaggtggtattatctccactcaaagatgagaaaactgatgctaagagtgacttagtaccagagacactttatccagcaaataacagagctaatatgatccaggactgtttggcactaagccccttgtgatttccactagaccaagctgtttctgcataatctaccatttggggaagataagttcaaagggatttgctctctggagatcagctggcaaggaacactgttcttatgttaggtcaacaacctgaaaagagattatcaaacaagttgtcatcaaacatctctacatccctcagtgctttaaatttcctaaatgtactgatagggcatgtactttacaattctgttcttaactctgaggattaatatacttaaaggtagaagaaagctacaaatataaaatcaactggagttcctgaaaataaaggacttatttggcaatatttaccaaaattttaaacctgtatatctttagagcaagtatacttctaggagtttatcctagatatatgtatgaaagtgcaaaatatacattcatgaaaacatcaccacaggcttgtttgtaatggtgaaacaccagatacaacataaatgtccattgctaggagcctgattaaatatatcacgatacaggcactgaattgcagagcatcccagcatttagaagaactaagtgtacctagtgtgtgtgtgctgatgccagaatctctaagatgtaaattgaaaagagcaaggtaaatacataattccttttgtatacctttaaaaaataggacaggagttgaagacaattactcttccttctattcatttctataatatttaaattttctaaccatgtgctgagattaatatttaacgtaaacaaactttaattgggctgtggtatcacaggccatttttttccttcttccatacttctctacatttaaaaaaactcatattattttttaaaggcattagctctccctcattttgcaaaaacaatgggcctctattatgtgtcacaacctgaccactgggtacctggatgggaaacacttccctaactaacccaagtaggtacagataaactcccaggaccattctcagaaggctcctgaccaagtaagtgccagatgaagctactgattccaagaggtggcgctctctagtgggcgaaacagtgggtaaacagatgtgtcttactgagtgaatgctcttttagcagctgggtactttattctttaaaatactctggattcttaataaatttcagagtgaaacactcagctatgtgcctggcttttccaggagaaaggaagagcctgtttacacctgccaacatctggagagacaacagcagttctcgaccatcatttgagtaagaggctttcctcccatctgacttgataggtatacaaaggcattctatatctaaccccagtgtgaaatcttagtttctcctatcaactaattttatcaagagcactcatacttcctgacattttcagctcgctataaaaacaaacaagcaaacaaaacagaactctcaaaagatagcaaatataacaaagcaaacacaataggaacaaggagtaactgcaactattttcaggttactatattctctgaaggagaaaaggtgcaattcaatactgtagtgtgggagaaaactgcaaaatggtcaaaaaaattggaacaaataaaaaaactaataattaggatttttaataaggtctatttataaaaacatttaactattccctattaattatgcacatctatgtctataaatcatttctgaaaaatcatttcatgtttacccatggtgaaactctttaaaggcagtagaaaataaaaatagttaaaatcatctggaaaacaggaaaataagagacaaaggcagatgatactaaactggcagtaaggaagataatcatagaaaataggagtggtaggtaatgtgaatgcctggaggaatcagagatggagaaagaaaagtaaggattgaggacaaaacaaaactgataaatacaggacaactaaggattgtattattcctaagtgctaatctttaaaccagaacaagtacaggtaaaaggagtgccaataaaatcttctgtgaacagtattttgaaccatctgccaaacagaagtcaaatacacttggaaaaaatacatcctattgctataaagctgaagctgctccctttggcatcctgcccagcaggggaaaggggggtcttctttgtcctgacatcaaaggtttagggtacaaaacaaacagggagcggatggtggagctgcctcatttgagtcatacctgagcggcaagccattccagtgtccgacaagaagtgcttccactctttcttgccatatgcctctgccagcacctctggagtcatcatcttggtgccatggcttgccctgattttgagagaggaggcacattgctcattaatggttccttgaatgccccttcctctatcattgtgactgttgatccctgttgccactggagctaacaaaaacatatgtattttttctgttttcaactgggtgcctccctgtttaggattctgtaaagcatttctgtgggcagctgtagcacttacccgctttaatccatcaagtagcaggtgattaggagatactcactctgaggtcaacactggataagataccacccttttttagagaagttgtcgtttaactacacaaataagatgaacatacctggagcaattagaaaacaactgtgtggattagtgggaagctggttctggcagcactggagaaagagcagtaggtaccagagtcaaagcatgagtccatcgggcccataggaggcacaggaagcacctggcacccacaggtggatcattgtgagcacgcaggactgtgaagacaagatgaggagcaacctgcccactcaaggacacagcatggctaaaaccaaatagggaaatcgaagagaaatgtggaaaaacagagcaacatgacaagaaagtaggtattttctgtgctcgaaatactgcttttgtccagttaagagaatcctatgctacagagaaatatggtagttcccccttatccagttttgctctcccacagtttcagttacctgtggtcaacctgggttgaaaaatactaagggcataattccagaaacaaacaattcgtaagttttaaactgcatagcattctgagttctattgttatattttatattttcttactatatctattaaaccttatcattggaaaagacatagtacacatagggatatgtactatccatgatttcaaggaaccactgggggttttggaagctaacctccgaggataaggagggactactgtagttgaaatgttaatgtagttcattataggaactagttgaaatgttaatgtagtttattatgagaaattataatgattgagagtattattctcttggtattataatgtggcaacaaaataatatgaaggaaaaaagaaataaaataagaaaagcaaatgggggaaaatcacaaatgggctcctttttataaaggggttaacattttagaaagctatatgtaaagatcaaagaatcctgaatgggaaatatgatcagaaaaggaatctactacactggttgaaagaaagcatcaaggaggtatgctaataaattcaggagaaactaaaggttagccaggacttggatggagagagacagaccttgtaggaggggtactgggacaaggacagacagatagaacaaagagagaaagaaacaaaattgtagaaagcttttcattcttttaactgtggttgaagatagccaagaacactgtgagaatctgacagaagagttaaaggtcatagacaaagctgcatttacacataccctatctctcaatgcctgagaaataaacatggaaacaaactacaaaataccaaaggtggggctacacctgctctaggtagatgcaccttaggggaaggtcgggggaaagtgtgaagggagtttgcatcatgcaaaaagaatgatgcaacaaaagagagtacatatcaggggtctgggagttctctcctttgattctgatcctgtttgtgtatgtaataaatggtatagcttcatagccatgttgacttgcctgtactattagtactggagaaaaaacagatgctccctccctggtgccctgtgagagacagagcagtgacagcagctgcttctggactgcttgtcatacccttagcaaccgttgagaggctgggcccactcagagaggagagaagtaaagaaagtcagcctggagtgtgggaggaggaagaggttgatgagacttggaacagtccagaaaaacttccaaaaggagctaggacacaacatgatccctgcatgacagggccaaatttggataaatgaagaaagagagggtggtgggtatagaccaccaacccctacccaatacccattctttctttcttaacaaaaagaatcccaattttattttaggcagccacacagtcagctaaaacagtaaaattcctgggctcttttgccagaaggagtggtcaatgagacgtagcaggttataaactttctattgtatgtcctacaaatatttctaatgatgtaaacttaaaggaactagacctttaaatctaatgctcacaaattcatatttaaatggcttaaacaattcatacaaagacatgtagacagacaatctgtcatctgattaattaaaataatcatatttaacccatactgtaagggtcatatgccactcagtaataaagtgtctcagagaaggtaaagtttagacttcacaactaagttttattacctgagaacagtgccattatttgcaagtttaaggaagttcccatcttctagatccaatgccaaacctttgcaactgaaataggaaagtttgattattaatcaattcctatatttagctaacctaagaaataacaacctatattttccaaacatcataatgctaaaaagggattctgccacccaggggaatgatatgttaatcacacaattaagaatatctaagaactgtaaaattaaatatctatcactgagcaggtataaaaggaaaattgttatataggtaaacaaggacagcatatttagtttgtaaaatctttaggcttttcaaaagataaatctaaaactcaaaagagaaaaaaagaacctgaacatcatcccatgactttgttaaaatgtacaaatgttttccactaaataaaacacacatacacacacacacacacacatttatattctacaagttaagcacttagccagtctttcctacactctagaattcgtctcaatttaggtcaggttacaagaacttgccatctggacaaggcatatcattgaaaaccactatggccaggcgcggtggctcatgcctgtaatcccagcactttgggaggccgagacgggcggatcacgaggtcaggagatcgagaccatcctggctaacacggtgaaaccccatctctattaaaaatacaaaaaattagccgggcgtagtggcgggcgcctgtagtcccagctactcaggaggctgaggcaggagaatggcatgaacccgggaggcagagcttgcagtgagccgagatcgcgccactgcactccagcctgggcgacagagccagactctgtctcaaaaataaaataaaataaaataaaataaaataaaataaaataaaataaaaagaaaaccactaaaagaaagtcaaatactgttttagctcctttactgtaaaagacttgtgggatttggggagaaaggtgagtacagattcattattatgaataataaaagcaaagtggtataatggctaccaaataccaagggaattaaacaaaaaatgacagggtactttagaaggattatttacttttgttcagggtaaaacttccagagtcagtaatttcatatagtaacatgttactgtttcttccttttacaaaaatgttacatcaaaaaagactaacaaaatatcaaaagaatgcatactagatcaacataatgtaggtatttttcatgtggtttagtattgttattgattctcactctgtagcccaggctggaatgcagtggcatgatcagcggctcacagcagcctggacctcctgggttcaggcaatcctcccaccttagtctctccagtagctggaaatacaagcacgtgccacctcacctggctaattattttttattttttgcagagttggggtttcgtcatgttgcccaggctggtctccaactcctagactcaagcaatctgcccacctcagcctcccaaagtgctgggattacagaattgccaccacgcctgcctggcctgattttaaactgaacaatttaaagtggcttaggatatttgtttgttttgttatctaaatgaggaagacaaacgaagctttgggaagctgagagtcctaacccaggaagggaattcccagtaagagtcttaggaatgtcgaactaaatgacagaaaagcaattgtcctaattcagacttactcaaaatgtgatgattcctccttttctcttatagttcttaaaagatagtaaaccaaacctttttcttaaagatgcaaattttagaaacagttcttactaacctctgaaactattatgacaaacttaaactatatgaaaatatccaaattagtcacataaactcttagcttattttcacatttaattaggcaagtctaaacttgtttaaagtagaaaacactttaattcattaaatacaaaacttttaatatagaaggcatttgtcctttgactcaatctcacatttcacattccatcttcttagaagagaaagcattacagttttatcagtaacaattagaaccacaggaaatgtacagacttaaaaaaaaaaaaaaaaaaagaacttaccagaaatcccaatcctctggggtcacattgagcaattccttatcgtaccctttctccttaactaggaactgggcaaagctattataaatgagctgcaaataaggggaagaaaaacagattaaatataacacccactattcattcttaatgtcacagacctaaaaccctaatggaattgctgatgggggcaggtaggaggaaggaaatatctgtaattgtgaagttctgcagtataattctccttcacaagcaatttatcatcccctgcatgccccaggtagctgtcccattcaaaattataccgtcagcatacaattatacaaccaaagacaattattaaccctactcctgaattctaatgggttggagatcataatttaagacttgacaaagctttttaaacttatttaatacatcactaagatgataaagatgatgaccactctatccatccatccttggtccattctggccagaaaggccccatgtcagggaaatacatatggggaccaggaaggtgatctaaacaagtcatgatgcctctatcagatacaggtaatcactcttgtttctccacacacacatacacaaaaaccattaaaaaaaaaaaatctaaagacaaaggacaaagaaagcctctggaagcaagtacaataattacaataataaatactctgttgattgctgacagatcttatttctcaacaacaaaaaatgctaggtttttgagtaaaatatctggtttttaagtgctggctaactttaaaagaactgtacataccaaacaaaaagtgcacaaaaggtagatggtccaaccttattctacctcgaagtgttctttggccagtgttgggtaaacttgagcctgagcagaacagttgtctgagtcaacctgcacagtgtccaaaaggacacactgaacaatctgacccttcttctacagatattaacccacaacaggtttcgataacatgtcatacttttagggagaagagggaggcagaggagcaggggaaatctctcctgggtagtgaggtttacactgatacttagatgcagcagttcgctgggtgaatgcagagggaatggggggcaactcaggttcagaaactgaggggcctgcacacagctggagtaggggtgtcggggtctgagtgtcaggatatgagcatggagaaagcaaaggctccttgtgaaatgtcaaatcgagttgctccctgtcataaagctaattaaaatcactacacatgtacttccatccagtgcaatgtgaccttatccaggtcaactgttaattgaaccacattatgttaacactatatatcaacagttcttaaccctggtggtgattcagaaccataggtgacacttcttaaaactacccagagcttccaagcatacagggtagagagggccctctctgaagcacagagaacactgaaaatcactgacctgcatgttttacagatttttattcaatcattaaaaggaaaaaagcaacaaaaaatacactgagtcaccctgtggtacaaagtactatggacaataaaaagtccacatcacgatcctgcttataagaaaccagtgctgcagggctaacagatgtaaaatgcttagagcagagcctggcacaccagcaaatccaatttaagtatttgctattattatgttgtatgctgctaaaaacaaaacaaaacaaaacaaaaaaacagaaaacaaaaacactgccctgacaggtagcgcttgcccatctccacggtgtaaatattcccaccatggcctgtttcaagtcaccaacagcagtttacctgcttgcacaattcctgaatagttaacaattggctttcacaagcccctaagagccagctattgtacaccttagatttgcctctcattgaggcacttttgagtttctccagttattcaagtgattagtctaagatatgggcatgtaattctaaaacacttgaattctcctggaagaaaggagccctttccatcagagacgccaacagggacagcaacagctgtgttccttaccttgtggaggagatttttctgtaacaggagagaagggggccaatggacaaggaaaagaagcagagaaaagcagtgtgaagaaaagcaggggcatctgtactctgaaacccctggtctaggcagaaggcttcttgcagtttgtccttagagtacgctgagtctctctagaagccttcatggcacagggctctccatgacattcctcccccagccttagctatcaccacctcacagtctctcaggagtaataataatacacgttctactgcagttgccaattggtaccctgtggtccatatgcagcctacaaattatgtttggttcccacttaaggttgccagataaaatttaaaaatgcctaggtaaatgtgactttcaaataaaaaacaaataatttttttttagtataagcatgcaatatttgggaccccactctcccactcacacatctacgttaactgactggtatcagacttctgagtctgcaaccttagagaggagaaaccatgtgtcatcctctcttctagaatgcctttcctgaggcctcatgtgagggggacacactcagttctgtgtttgcacaactctgtgcagttgttaaatgcctacaaaactgaaaggagacgcactcacagctctccatgatgcagcccccactgacttctccaccatcttctcctgcaacttgccaccttttgcttgcacccagcagttcccggtgctgttgctcacctcgaggttctgacctttactctaactcctctgggtgaagcactcctctccacctcctcacctgccagctcccggcctttcctctgtgttttcgggcaccatacagacagcaaggtgggaagaagcagaaatccacagccggactacctcgcttagttgccctggatacactttccttctgtgccccgttgcttgatgctctcttaacagtgactaaatcactgttaagtgattaaacagtggtgataatatctacctcacagggacgttgtaaggattaaatccattcatataagcagcatgcttattagaatcatggctgtatcatattctgttattaaaatacctattatctattcagtctatttattgagtccagtatgtgcccagcactaagctcggcacacagaacacacaagaaactgtcacagatactgatggagtcatcacgctgggctctaggggaagtccaacaagtaaacaggaagtgttaatatcatgcagcatgtgctatgaggaatgaagggttttgtggaaaactgaaggtgggcttagaatggaagggcaaactttaagggccaaaaagacttcctaaggggaacgatgtttaagatgaggcctgatgggatgaagagcttctgtgcagagcaaagaggccctccaggcactgttggcagcgtgaagcaagacccaggtcatactacccaccacaagggaccaagactaactcttcagcatttttgcctactgtgtaaggctgcctggaggcctgcgtgttgatctctgtatcctcagctctagcatggtgctcagcacactgtgggacttaaaataaaaaagatttccacaccaaacatgatccaaaactcaataggttactgttttcaagctttaaacatcacttattctccaggtttgcagtaaaaaaacctcttgtctttgagaatcttatattctgaaattttatgatcacctatggacaacactagctctaacatgacagtggtttaacaatattacctccaaatgaaggtaactaaagaggagacacacaaaactgtgaaccaggaaggattcgaaagacacagagggaaggaaaacatgtatcaaagacctaggggaagcagtggccaaagaatcaagcagtaaaaaagccttcttaattctcaatgtgactaaggaaaccagacctgtaaggtaagaaagcaggaaagtgtaacagcagaaaaaggacatttaaaaaaaaatttagcatctgggcatagaaaacacacgagaaattcgggcagccactcttttttgacctttaacgtgtacctgaactggtgggtgcaggaactggcgggtgcccataatggggcacaaccctggctgatgtctgcaccagtgatctagagttctacccataaactgtgaggtttccaaatagtttgggtggtaaccataaaagcaaacacttgtctttgccaaggtactattctaagcattatacatctcttactcatttaatccttgcaacaatcttgtgaggtaaatccaattattagctccattttacagatggggaaactgagaagcagcacaggttaagtaacttcctcgaagtcacagagctagtaacagtggagctggtgtcctaagctaggcagtctggctgaggagtcctcgctttcaccactgtactcataaccagctctttttctgtctggatgcttagatcttggactaaaaaaatctggtaacttttcaaaattagtttccttgggaattgggaaaccaaaggaatagtggagggagggcaattaatttgagtgtacaggtctggaagcatgcatactccatgtccccctccctcagggcacagtgaggacccaaacttcgcagactgttggtaggactggaatgtattcaaagtgcacggagcacgtagtcgatgcgcaataaatatgtattttcttctcttgatagaaggtaaaactagggctaagatcttaatgacttttcaactagtgttcctttcaatacactacactatatactacgcatctctcccagattgcagtttaaacactgatgggtggttgatcgtgcaaacagaaaaatgcagccaaaaaaaatgcaagtaccaaatcaagtggctgtgtccacaatcagctggtgtccagaaagacatgcagagaaagttccacgacgtgagatcttcaaggacagccctagtccccctgaccccgcccctcctcggccctagaaatcaccgattccccagcccggtcttgcgcagtttgcccctccttcgttcttccctatccctctcaacattagctaatggctgaggtaaatgtgccggtccccacggcaccggcgcggagcggaggctgcacacttccgccccttctcgccgctggaggccgcgctctgcggcaagactcggccgccgcaggccccgggcagcgtccgccgttgcccaaacctggaggaaactcaagccccagccgccatggaggttgcgcgcagtgcgccccggagcccgcgccactcaccggggcgctctcgggcaggttgtagcgacacagagtgtggtccaggtcgaatccgaccacgtcgcaggcggccagggagaagtgctgagccatggctgcgcggggagcaccagggagcgcctcggccgcgaagggtgcaaggagctggctggcgggacgctgcgggacaggaccgggccggacgcggc

SEQ ID NO: 11685 - DNA, 1320 bp, Homo sapiens
aaaataaataaaaatagaaaaaaaaactcttcagtcaaatatggtggccactagtggctattgagtacttgaaatgtagctagttagaactgcaatgtgctgtaagcctaaaatacacacatttagtacaaaaaagattataaaatatcccaacttttatattgattttgaaataatattttgagtatattgggctaaacaaaatgtagcattaaaattaatctcacttctttcaatgtggctgacaaaaaagtttaaattaaatgtgcggctcacattttgtttctattggacagcacaggtggagaaggtctctgaacataaaacaccgaataagtatattttccactgggactggggatgggtgctttgggggaagtgcataggtgctgggcagtgttaaaatcagggtgggcgtaggtggcagtgaagggcagtctttgtgcagccagcatggcaagtgagagcatgaatgcctgactgttggaaatgacaaaataaatcatggaatcctgaagtttcagggtgtaaaatgctttataaatcatcatctgacccactaaatgatggaaagaaatgccctggactctgaatctgaatgttttggttccagtctcagctccatcatttattatataggacgtcttgggcaagtcagactcttttcttatatgtctaatgggggacataaaatctgcttgatctttcctggaaggtgatttctattattttaactcatttgaaagcccactctaaattccaaagtactgcaacactatgagatattaaatagatgttgcctattttacaatcctggctcagcccagttctacagacagttggtaattttcaaggtgagtaattaatacacagatactctggcagagaaaatattattagagtgtgtgtgcttatgtctacacacagaaaagagaggaggcaaagataaaacctgtggctcccattttcttcttatatatttttacttattttttctgtcacagatataaccccttaagaaaaatttagatgagtactataatctggcaaaattagttaaatcagactgtgatgagtatgatataacacaatgagctgtagaatgatgttttggctgagccactcactctgtcaggggcagcaccttctttaattgactctcttcaaggaaatgcactacacgtggctctctgttgttacctgtgtgtcatgacccgctgggccattaacccatttgtcttgaatagtcaattctctggccccacgattgtcacgagccacgaggagctggggaacatgggtgagacattctcactcctg

SEQ ID NO: 11686 - DNA, 6271 bp, Homo sapiens
caccgccagcgccgtggtggagttcaagcggaaggaggtgcttgtccgcgcgtgctgtggtctacccagtgtctgtctccggccacagttcgtttctcggtcggtttagtgtccgtgtagccacccaaccgtgtggccgaccattcgcgctttcatttgtccttcgcctccgtctgcgccgtctgtcctagggggaggggaagggggagtcctgccagcacccagctgggccttgcctcgggaggcaaggaccaggacgaggcccgagggctcgcgtctggggcatacttgtgccgctgcaggcgggcgcggcgcgctgcccgggcggggagcatctgccgggagggcactccctcccaccagcagttagcccccaacgggagggcccttgagtgaccacgagcagagccggggattggagaaggacgggaaggcggatcacctccggcgccgcccgccccgcccttctccggctcgcgctggtggagcgcgaccgccacctgctgggcctcggccttcctgcagccggcccacccagcaggggccgtgggagagtgggcgtggggactgaggtaggtagtacgttgccttgttccgcttctctgggcacaccacgtgcaggtttggcagggaaagggggtctggtcgaaagcacaatttgtgagtaaaggctatgtgggcctccctggggtgacagcagaggcctggtgggcagagccatccaggtgcccagcggctttcctcacaaccccctccagcctggggtaggaggatgcttggaacagagcgctctgatgtacacctggcctcggagctcggctctgccggctgttcctgtgtgaccttgacctgaccttcaccctgtggggcccagcttcctcaggggagagtggaggtgctcatcctgctctctggggacctggatgggacctgccagcagggtgcctgggcatcggctgtaattctccttataagaggtctgcattgtacctgttacacaggcgaggctcagtggctcagggaaggtgacggccaggctggccagtgaccccgtgggaacttgaacccaggtcagactgtccccagacctggctctgacaacacacatctggtccacctatgggctgtgtgggacgtgcagcattctaaggtctctggttttggggggtctgaggggcccatctcgcctgcactgaccaacgccctctgcatcctgcaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactatagtaagaggggctggtggcacggcctggctaggcccccaggaaatgaggtgctcgctcttcatgggcaagcagcaccctacacacatgcacacctggcatggccctctgtggcccaagccacttcccctccaccctctgcccagcacttcctgtgtctctgccaggcctgccctccagccaccagcagggctttcaccatgggacctctctccctgagctgatccatggccgaccctggcagggccccaccacacccccctgctgacctcaccagggctcaccaccgactgcaaacacacatgtcacctgaggctttcctccagcccctggcactccatcgttgcccctaaggcgtcccaagtgcttacggattattgctccagcctcagcagctctctgctaaacaggctggtgtacagaagcagccccgagccaggtcagggcttctgagcccattatcctgcctgactgctgacatgccaccatgctcacctgcttgcagggcacctttcagcagcggccttgcttcctgcctccctccgccacctcctgcagatttctcctgggatcgccttccaaataaaccacctgcatttggggtctgtgtctggtggaaccccaggccatgagtccttcacccctttctgcctggcctggtcctgttcattcctcagtcctccccacctcaccaagcctatggaggccccacttgtcagaggggagacagcctccttgccctggcactgaacaccctgtgtgccagagtgcccctcccatcattgtttccaccacatgagatccacagtggcagcacgcggcaggtacaccgatggcatgacttccagggcttggcctgcggggtcattgggtctgctggaggttcctgcagtggagggtagttctgccatgctctgggggagctgtctggagggctctagtgtgtccttcccagggccttggtaatgtagacctttaaccccccatgcctcacacacacacacacacacacacacacacacacacacaccctgttacccaaaaaacgaaactctgtaaaacattttaaagaggtttattctgagccaggatgagtgaccacagcctggagaaaacacaaacccaagaagccttgagtaagtggtccccaggtccaaggtggtggagttacagtttgcttttatacattttagggagacaggagttacaagcaaggacataaatcaacacacagaaggtatacattggtttggccccaaaatgcagggtatcttaaaacaggggcttacaggttagaggtagatgcagagattctttaatttacagttggttgaaagagttaagctttgcctaaagacttcaggtcagtacaaaggaatgttaaggaggcctgctatgtgtcgcctgatgctatacagggtcaggagggaaagtaaaccacgttatacctgggtaacttaaaaaaaaaaggtttttaacaagattttatggaccaggcatagtggctcacgcctgtaatcccagcactttagggagaccgaggcgggtggattgtttgagtccaggagttcgagaccagcctaggcaacatggtgaaaccctgtctctacaaaaaaaaaaaaaatacaaaaaattagccaggcgtggtggcacatgcctggattccaggaacctgggaggctgaggtgggaggatggctggagcctgggaggtcgaggctgcaatgagatgcaacagagcaagactctgtctcaaaaaagaaaaccaatgttatggtttgtagggtgtttcttaacccttgcctggcatggccttaggtcctgtttataatttggtatcttactgccacaaagagtccgatctgtcagtcttatgatctctgttttaatgttaatgccggtcagttgtgtccaaactccagcaggaagagggcctaataaggcaagtccaccctgccttcctgtcatggcccagaattctgtttttaaggtttttctggtgtcccttggccaagaggggatctattcagttggtccggggactcaagattttagtttcagtttacaactctatacacaaacaccccatacacacaggcaccaataccctatgcacagacaccacacaaatgcatactacacacttacacataccacacacacgcataccatgcaagcatatcatacacacagacaccccatacaatgcgtacacatgcacacacacacaggctgcctcaaattgagaagggttccttggactttcagttcagtaaatcccaacgtttgaacattggtgctaacttaggaccagccccaggcctgttgcatggcactgtatgtgtgaaagtgcgtgtttgcaccagtgtgagtgcagggctgtgtctgggaagaggtgtgctacacatgaggaagcagccagagcagcttggtggtcattgttgtgcccctacctgcagggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccaggtgagcccatacctattgcctgtctggggaagattgaaaggccaagggacatgggggcacagggaggcaggtgacactgcctcttggcccaaccagcacagagtagactgggtggagtcctgagcccagggccaggaggtacagctgtgtgcacagaagaggcctgggagagctcacagtgggcagggctgggggctccttgggcctctctttttttcccctttccattcttggtatctttaaaatgtattttcaaaaatgcaagagcaatactgggtaaatctgcatatggtgactcggaagaatcttcctggtggattggtgagagtggcttgcagagatgttggtcccacgtgactccctttgtgcaaaagcagatcttccctgacagggatctgcaagtgtgcagagatcacagtgctgtccacagtggtgccctcagggggaggcaggaaacgcttccactttttactttttgtaactaggtttgctagaaagcgtatatttatatttgtctttggaaaataatgactagaaatagaaggcataaaagtaataaatattcattaaagaagatgaggcatgaggcatgaggcgtgatcccttctacccataggcgccagtgttgcacatcgtggtgttctttctgggatgtttctcgtaagcacttattaagttgacttgaaactgcagcacgcatgttctcgcatgccgctctcccttgcagagcagcccgtggcgcctcctcttcaggggccatctgccagttctttcgggtggttctgtgcccgcatcagctcctggcagccacccgtgtccagcccacgagggagcccacccttggacatatctaagctccccgaccacctccttggcctttaatgggagtgggatcagagacagaggggcgacaagacagagggccccggggggtctcatggggggcggggcaagagcaggcattgctgaagttgggtcacctgccctctgtcaggagcaacgggggcctgaatcccagtccagcctcagcctcactgtggtctcacctttctccccagtttgtaaagctgtgaattagggacaggaaccctgaacaattttgagagtcacatgagcatttggaagtgggctttgtaggggaaagtgaggaggcccaggaggctggtttttgctgtggtcacttgtgggcctgggagagcccagccctgctctggcccgcccccatctcgccatctgtggaacttttggtttcaagcagctgcaagagttgccaagaggttgaaagaattcagctgcctgactccaggtcctggcatccccaggagaggcccctctttcccaggggctctggtcaaagtcccagagcctggcatccccaggagaagaggctcctctttcccagaggctctgctcaaagtcccagggaggccccctggtcctgcatgggctggggcaaccatgctcccgagtcttgtggctggggttcagtgctctgaccaggggacaccagggcagggtggacctctaaaccctgtgcactgagggaggagtgaggggtccccagagcactgctggggcagctgggagcagccagggaggagcctgggagacattccggcggctttgttgtctgagtgagggaggaaaggggagtaaagggttgagtcagggcctgcctggggcttttcctgccaccaaactgaacctcgaggccctgggttgccttgacctccagctcccaggaacaggggcagctggtaacatgtggcctgagtggaacggggcagggcagggctggggcaggtgggtgggtatgaaggctctgaggggtggaggacagggtgctcgggggggctgctgtctccaggcccagttgggggctgttccaggacttaggctgtgtgggaatctctaccctcaggccattacaggccggtccagctgcctggctaaggtgttcccctgtgcccccctagatcgggaaagtctgtgtggaaaactgccaggcgttcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcc

SEQ ID NO: 11687 - DNA, 6274 bp, Homo sapiens
caccgccagcgccgtggtggagttcaagcggaaggaggtgcttgtccgcgcgtgctgtggtctacccagtgtctgtctccggccacagttcgtttctcggtcggtttagtgtccgtgtagccacccaaccgtgtggccgaccattcgcgctttcatttgtccttcgcctccgtctgcgccgtctgtcctagggggaggggaagggggagtcctgccagcacccagctgggccttgcctcgggaggcaaggaccaggacgaggcccgagggctcgcgtctggggcatacttgtgccgctgcaggcgggcgcggcgcgctgcccgggcggggagcatctgccgggagggcactccctcccaccagcagttagcccccaacgggagggcccttgagtgaccacgagcagagccggggattggagaaggacgggaaggcggatcacctccggcgccgcccgccccgcccttctccggctcgcgctggtggagcgcgaccgccacctgctgggcctcggccttcctgcagccggcccacccagcaggggccgtgggagagtgggcgtggggactgaggtaggtagtacgttgccttgttccgcttctctgggcacaccacgtgcaggtttggcagggaaagggggtctggtcgaaagcacaatttgtgagtaaaggctatgtgggcctccctggggtgacagcagaggcctggtgggcagagccatccaggtgcccagcggctttcctcacaaccccctccagcctggggtaggaggatgcttggaacagagcgctctgatgtacacctggcctcggagctcggctctgccggctgttcctgtgtgaccttgacctgaccttcaccctgtggggcccagcttcctcaggggagagtggaggtgctcatcctgctctctggggacctggatgggacctgccagcagggtgcctgggcatcggctgtaattctccttataagaggtctgcattgtacctgttacacaggcgaggctcagtggctcagggaaggtgacggccaggctggccagtgaccccgtgggaacttgaacccaggtcagactgtccccagacctggctctgacaacacacatctggtccacctatgggctgtgtgggacgtgcagcattctaaggtctctggttttggggggtctgaggggcccatctcgcctgcactgaccaacgccctctgcatcctgcaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactatagtaagaggggctggtggcacggcctggctaggcccccaggaaatgaggtgctcgctcttcatgggcaagcagcaccctacacacatgcacacctggcatggccctctgtggcccaagccacttcccctccaccctctgcccagcacttcctgtgtctctgccaggcctgccctccagccaccagcagggctttcaccatgggacctctctccctgagctgatccatggccgaccctggcagggccccaccacacccccctgctgacctcaccagggctcaccaccgactgcaaacacacatgtcacctgaggctttcctccagcccctggcactccatcgttgcccctaaggcgtcccaagtgcttacggattattgctccagcctcagcagctctctgctaaacaggctggtgtacagaagcagccccgagccaggtcagggcttctgagcccattatcctgcctgactgctgacatgccaccatgctcacctgcttgcagggcacctttcagcagcggccttgcttcctgcctccctccgccacctcctgcagatttctcctgggatcgccttccaaataaaccacctgcatttggggtctgtgtctggtggaaccccaggccatgagtccttcacccctttctgcctggcctggtcctgttcattcctcagtcctccccacctcaccaagcctatggaggccccacttgtcagaggggagacagcctccttgccctggcactgaacaccctgtgtgccagagtgcccctcccatcattgtttccaccacatgagatccacagtggcagcacgcggcaggtacaccgatggcatgacttccagggcttggcctgcggggtcattgggtctgctggaggttcctgcagtggagggtagttctgccatgctctgggggagctgtctggagggctctagtgtgtccttcccagggccttggtaatgtagacctttaaccccccatgcctcacacacacacacacacacacacacacacacacacacacacaccctgttacccaaaaaacgaaactctgtaaaacattttaaagaggtttattctgagccaggatgagtgaccacagcctggagaaaacacaaacccaagaagccttgagtaagtggtccccaggtccaaggtggtggagttacagtttgcttttatacattttagggagacaggagttacaagcaaggacataaatcaacacacagaaggtatacattggtttggccccaaaatgcagggtatcttaaaacaggggcttacaggttagaggtagatgcagagattctttaatttacagttggttgaaagagttaagctttgcctaaagacttcaggtcagtacaaaggaatgttaaggaggcctgctatgtgtcgcctgatgctatacagggtcaggagggaaagtaaaccacgttatacctgggtaacttaaaaaaaaaaggtttttaacaagattttatggaccaggcatagtggctcacgcctgtaatcccagcactttagggagaccgaggcgggtggattgtttgagtccaggagttcgagaccagcctaggcaacatggtgaaaccctgtctctacaaaaaaaaaaaaaatacaaaaaattagccaggcgtggtggcacatgcctggattccaggaacctgggaggctgaggtgggaggatggctggagcctgggaggtcaaggctgcaatgagatgcaacagagcaagactctgtctcaaaaaagaaaaccaatgttatggtttgtagggtgtttcttaacccttgcctggcatggccttaggtcctgtttataatttggtatcttactgccacaaagagtccgatctgtcagtcttatgatctctgttttaatgttaatgccggtcagttgtgtccaaactccagcaggaagagggcctaataaggcaagtccaccctgccttcctgtcatggcccagaatttgttttaaggtttttctggtgtccccttgaccaagaggggatctattcagttggtccggggactcaagattttagtttcagtttacaactctatacacaaacaccccatacacacaggcaccaataccctatgcacagacaccacacaaatgcatactacacacttacacataccacacacacgcataccatgcaagcatatcatacacacagacaccccatacaatgcgtacacatgcacacacacacaggctgcctcaaattgagaagggttccttggactttcagttcagtaaatcccaacgtttgaacattggtgctaacttaggaccagccccaggcctgttgcatggcactgtatgtgtgaaagtgcgtgtttgcaccagtgtgagtgcagggctgtgtctgggaagaggtgtgctacacatgaggaagcagccagagcagcttggtggtcattgttgtgcccctacctgcagggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccaggtgagcccatacctattgcctgtctggggaagattgaaaggccaagggacatgggggcacagggaggcaggtgacactgcctcttggcccaaccagcacagagtagactgggtggagtcctgagcccagggccaggaggtacagctgtgtgcacagaagaggcctgggagagctcacagtgggcagggctgggggctccttgggcctctctttttttcccctttccattcttggtatctttaaaatgtattttcaaaaatgcaagagcaatactgggtaaatctgcatatggtgactcggaagaatcttcctggtggattggtgagagtggcttgcagagatgttggtcccacgtgactccctttgtgcaaaagcagatcttccctgacagggatctgcaagtgtgcagagatcacagtgctgtccacagtggtgccctcagggggaggcaggaaacgcttccactttttactttttgtaactaggtttgctagaaagcgtatatttatatttgtctttggaaaataatgattagaaatagaaggcataaaagtaataaatattcattaaagaagatgaggcatgaggcatgaggcgtgatcccttctacccataggcgccagtgttgcacatcgtggtgttctttctgggatgtttctcgtaagcacttattaagttgacttgaaactgcagcacgcatgttctcgcatgccgctctcccttgcagagcagcccgtggcgcctcctcttcaggggccatctgccagttctttcgggtggttctgtgcccgcatcagctcctggcagccacccgtgtccagcccacgagggagcccacccttggacatatctaagctccccgaccacctccttggcctttaatgggagtgggatcagagacagaggggcgacaagacagagggccccggggggtctcatggggggcggggcaagagcaggcattgctgaagttgggtcacctgccctctgtcaggagcaacgggggcctgaatcccagtccagcctcagcctcactgtggtctcacctttctccccagtttgtaaagctgtgaattagggacaggaaccctgaacaattttgagagtcacatgagcatttggaagtgggctttgtaggggaaagtgaggaggcccaggaggctggtttttgctgtggtcacttgtgggcctgggagagcccagccctgctctggcccgcccccatctcgccatctgtggaacttttggtttcaagcagctgcaagagttgccaagaggttgaaagaattcagctgcctgactccaggtcctggcatccccaggagaggcccctctttcccaggggctctggtcaaagtcccagagcctggcatccccaggagaagaggctcctctttcccagaggctctgctcaaagtcccagggaggccccctggtcctgcatgggctggggcaaccatgctcccgagtcttgtggctggggttcagtgctctgaccaggggacaccagggcagggtggacctctaaaccctgtgcactgagggaggagtgaggggtccccagagcactgctggggcagctgggagcagccagggaggagcctgggagacattccggcggctttgttgtctgagtgagggaggaaaggggagtaaagggttgagtcagggcctgcctggggcttttcctgccaccaaactgaacctcgaggccctgggttgccttgacctccagctcccaggaacaggggcagctggtaacatgtggcctgagtggaacggggcagggcagggctggggcaggtgggtgggtatgaaggctctgaggggtggaggacagggtgctcgggggggctgctgtctccaggcccagttgggggctgttccaggacttaggctgtgtgggaatctctaccctcaggccattacaggccggtccagctgcctggctaaggtgttcccctgtgcccccctagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcc

SEQ ID NO: 11688 - DNA, 374 bp, Homo sapiens
agcccaggtgacccctgctttgtgaccatgatgtcctgtaccctgccctgcgccctgtgctcctggcactgtctttgctgccctgggtctgtcactccggtccccttgggctccatccgtgggcagctcagctggtgctgttccctgtccttgggcactagctggacgctgggcccaggccagccccctgtgaccctgcttgtctgccacctgcagatgtggccgaggaggcgggctgccccctgtcctgtgcagtcagcaagagacggctggagtgtgaggagtgtggcggcctgggctccccaacaggcaggtgtgagtggaggcaaggagatggcaaaggtaagccctggaaacgcccaagggaggcctgc

SEQ ID NO: 11689 - DNA, 374 bp, Homo sapiens; identical to SEQ ID NO: 11688

SEQ ID NO: 11690 - DNA, 147 bp, Homo sapiens
aaaaattagccgggcatggtggcgggcgcctgtagtcccagctactcgggaggctgaggcaggagaatcgcctgaacccgggagttggaggttgcagtgagccaagatcgcgccactgcactccagcctgggcaacacagcgagact

SEQ ID NO: 11691 - DNA, 134 bp, Homo sapiens
cggagtctcactctgtcgcccaggctggagtgcagtggcgcgatctcggctcactgcaagctccgcctcccgggttcacgccattctcctgcctcagcctcccgagtagctgggactacaggcgcctgccacta

SEQ ID NO: 11692 - DNA, 1031 bp, Homo sapiens
gtgttcaagactttttttttcttttctttaattttcagaagtttgactatgatgtgtgttggtaaggatttcttttggtttctcctatttgggtttgctcagattcttgagtctgtaggtttacatcttttgccaaatttgaaaagttttctgtcattattcctttgagtatattttcagtcccaccctcttttgtaactctttctggaactccaatgacaagcgcattagatcttttgttatggttccacagatccctgagcatcaattcattttttctcattagacttaaatagactttcaagggactcaaaacagagtctactttctctcttttgtttagactgggcagaataatggcctccgaaagatgtccacatcctaatctctggaacctgtgaatatgttaccttatacagcaaaaggacttggttgacatgattacattaagaaccttgtgatgaggagattattctggattataatgggcccaatgtaatcacaagggtccttagaaatggaagagagttagaaggagatatgactatggaggaggttggagtaatgtgatgtgagaaggattcgatcctctgttgctggctttgaggatgatagaaggggactacaagccaaggaatgtgggctgcctccagaagctaaaaaaacaatgaaaaggattctttcctggtgtctccagaaaagaatacagcccttccaacaccttgattttagcacttctgacctacagaactgtaagataaaaaatgtgtaatactttaagcttctaaatttgaggtaatttgttgtgagaacaataagaaacaaacacaggaatccctattgtctgtcttcaagttcactgattcttttcttttctttttttttttgaggtggagtctcactctgttgccccagctggagtgcagtggtgcgatctcagctcactgcaaactctgcctcccgggttcatgccattctcctgcctcagcctctcgagtagctgggactacaggcacctgccaccatgcctg

SEQ ID NO: 11693 - DNA, 220 bp, Homo sapiens
tcgctctgtcgcccaggctggagtgcaggggcgcgatctcagctcactgcaagctctgcctcccgggttcatgccattctcctgcctcagcctcccgagtagctgggactacaggcgcccgccaccacgcccggctaattttttggatttttagtacagacgggatttcaccgtgttagccaggatggtctcgatctcctgacctcgtgatccacccgcc

SEQ ID NO: 11694 - DNA, 840 bp, Homo sapiens
tttttttttgagatggagtctcgctctgtcgcccaggctggagtgcagtggcgcgatctcagctcactgcaagctctgcctcccaggttcacgccattctcctgcctcagcctccccagtaactgggactacaggagcccaccaccatgcccggctaattttttgcagtttactattagtagagatggggtttcaccgtgtagccaggatggtctcgatctcctgaccttgtgattcgcccaccttggccttccaaagtgctgggattacaggcgtgagccaccgcgcccggcctcaaccagcttccactcttatttaaatgtttgagagcatggaatttacccatgacaatgtctgcctctccccacctttgtcaccaccatggatacacatttcctccaaagatggcaggaaaccccaaacacagttgatattataggtcctggacagaccatatgctatttattagctaaaacatttacttgttcccttcatacttttcttaaaaattcaaccaattatataaaaatatatgccaaaagtcttgctgatgagtatactgggcccagtcattccataggatcaagtaaaaatgagtggttaagtgagtacaatagttaactcactgcatattatggctgttttctacattattgagtgtttcttaatttgcaataaccacaatcattactggccttacactgtaaaatcatgtaatatacactgcttgctttgagttgactcctcctcctccttcatttatctgcctaaattttattgggcttctcaaatagctcaggccaccacctcttcagtaacccttccttaacctaaagtacc

SEQ ID NO: 11695 - DNA, 156 bp, Homo sapiens
agtctcactctgttgcccaggctggagtgcagtggtgcgatctcggctcactgcaagctctgcctcctgggttcacaccattctcctgcctcagcctcccgagtagctgggactacaggcgcccgccaccacacctggctaattttttgtattttt

SEQ ID NO: 11696 - DNA, 172 bp, Homo sapiens
ctctgttgcccaggctagagtgcagtggcgcgatctcggctcactgcaagctccgcctcccgggttcatgccattctcctgcctcagcctccagagtagctgggactacaggtgcccgccaccatgcccggctaatttttttgtatttttagtagagacagggtttcaccgt

SEQ ID NO: 11697 - DNA, 113 bp, Homo sapiens
tttttttgtatttttagtagagacagggtttcactgtgttatccaggatggtctcgaccccctgacctcgtgatccgcctgcctcggcctcccaaagtgctgggattacaggc

SEQ ID NO: 11698 - DNA, 1257 bp, Homo sapiens
gaaaacgacaaggcacataagggctgaagaccgcgcctggcacgaagcaagtgctccgtcattgtggctgctgcggccgtggaatgccctccatttttgccctgctcacatctgctccaaacactccccagcctgtgtgggttctcatacatgagccccatcagtgcctttgcttctgaaagcctagaggtaatgacatgctcggcgagctcaaactcctggaaactctcccaggaaaactcgggatgcgaagatgtactctagaagggaacagatggcttctgtttttgtgtgtggtatggaatggatggcaaaaggtcagtgagctctgtgggagacagcacggtgccaaggggacccgtgtcaccttcctcacctctgcctctgtctcagacacctgctgacatatgaccaggtgcagatggagcagtgccagccacgccctgggatgaggagatcaagctggtgctcagccccagcaaggcggggtcagtgacatccctatatgtgaatggggacacatttgtaagcagagacatgaagtgacagaatgagatcacccacagcgacatctgccactacccaggtgactgggccaaaagtgggctgtggaattggaacaaaatacaacagattgtatttagatattgactccattctaatatatagactttgcaaggtaaacatttcaaaattgctctttactatgagaaccaaatgttttctccagatattttgatataaatttttgatgaaataaatgcatcctaggaaaggccttgctcccatattaggaaagtaaattctatatccaaggacactgggtaactacagccttgaatgttcatgggctacaataacgacgattatgagggaaccagattctctctcctttactgtgtttgggtagatcctttcatcagtatgtcaaggctactgaaatgttagtgtaatcttgatgtcagacaggggacagggtctttgcttggaagcctcccaaatccagggcctgtggaaagccaaagcattccctctgagatttcggcgaatcttttgtctcctaattcccctttcttttttctttttctagttttttgttttttttttttttaggcggagtttcgctcttgttgcccaggctggagtgcaatggctcaatctcggctcaccacaacctccgcctcccaggttcaaatgattctcctgcctcagcctcccaggtagctgggattgcaggcatgcaccaccatgcccggc

SEQ ID NO: 11699 - DNA, 128 bp, Homo sapiens
ggcgcagtcttggctcactacaacttctgcctcccaggttcaagcgattctcctgcctcagcctcccaagtagctgggactacaggcacacaccaccacgcccggctaatttttgtatttttagtaga

SEQ ID NO: 11700 - DNA, 302 bp, Homo sapiens
gctgggcgcggtggctcacgcctgtaatccctgcactttgggaggcggaggcgggtggatcacgaggtcaggagatcgagaccatcctggctaacatggtgaaaccccgtctctaccaaaaatacaaaaaaaaaaaaattagccgggcgtggtggcgggcgcctgtggtcccagctactcgggaggctgaggcaggagaatggcgtgaaccctggaggcggagcttgcagtgagctgagatcgcgccactgcactccagcctgggtgacagagccagactctgtctcaaagaaacaaacaaa

SEQ ID NO: 11701 - DNA, 1348 bp, Homo sapiens
ttcttattatttcttgtcttttttgatctaatttatcttttatattgcagaattctccctcctttggctagagggatccttttctctctaatatctgtctttctttttttagttgatctttccacccactcccctttctcctcttctccactgagaataatctccctgtcttttattcacttcattttctatactcctatttatccattttgattgtttatacctactatttgtattcgaatgacttcatttttcccaccctgtgggtcagtttgtgacttttggaattttccacaggtacctgtacaacttgatatttgaaaacaggattcatcaccatatatccccagcccccgttttctttttaaacaggcctcattgcgtaattcctttgccctgaaaagtgtcaccacctttatatttttaccccagccttggagttatctttttctgctctccattctccatgtccaaaaacttgctgtcagtccagtttttaatcagttttctccttgaggcttgatctcccatttctctcatcccattatagcttttcatgtagatctgaggcccaggttactgtaattcttttttttccaatttccttgctcccaggatccccatcttgtataaagtttctaaggtgctcctcctcaaactccatttttacaatatccgtattgtaaaattttcattttcagtaacacccagtagataatttttcaaagacgatcctcctcaaacacccatttttacaatatctctattgtaaaatttcattttcactaagtaacacccagtagataattcctatggagcagtggtgttccaaattctccattacctctatgcctaatattcatcagccttcattactctctagcatattcaccttgattcaacagattcaaacttcctacagccttctactgatgtcttacaagctcttgcctctgtgcctttctcatgctattctttttgcttagattgctctttggtcccagctcatgttcatcactcccttcaaagcctttcttcctttatatcttctgactgagctctccctgattgacatcacctcatgcgatgacctccctcattctgtgctgcctcagcacttatcttttgagtttgtactgtggtccatgtacttactaatatgttgctttgtaattattttctagcactctgtgttacagtttcatatttgtatttatttccaaaattaaattgtaagctccttgagggcaggaataataacttttacatttgtatctctgcacccccgagtgcctagtatagtgctgagcacatagtaggcgtttaataaatgcttgttgaagtattg

SEQ ID NO: 11702 - DNA, 3784 bp, Homo sapiens
gaaataataatcattttatgattgatgggccaaaaaaagcaatcaaagtcttacgtcatagaggaccaccttttggatcataaattctttccctataacattccttctctgcctctctatggcccactttgaccactaacaacatcagaattatctacatcaatttcattgagccattggtgaatgaagacacccatcacttgtcatgttggtttccaacagtcctttcgattatcctttattttcttatcctcccttctcttgtttcttttatttataagttaccattcctagtttctttgtacttgaaattttaagaaaccagaaacaagtaaatctggttgtatctagatctttgctctgtgtttcagttgtgccttaccctctgtaagatactgattcttcctggggccagtattaccttgtatgcaaatattacatatgatgggtgcattgtcagagggaaaatatatgtgtatgtacacatgtgtatgtacacacacacacacacctgccatacactttagaagaacgcttctcttctattccaataaaaagtccttttagcaatgcaacatattaacaaaattgggtgcattcagggtagtatggccatagaccagagcaacacattgaaatgtatacagatgtactagctaaagtctctttatgtgtcagtattaagagtaatatgtagccagattacttaaatctcagaattactaagcatgtggcataaatttggagaaaataatatgactagaaaaattagtgttatattgggtgtgagaaaagactgtgtcttgaaagaattatcaaagctgatacagcacatatacagaattagccaaatggtataagacaatagaaaaaggctgtggattctttgaggacatcactagaaatcattctttgtctcaagttcacactcttagcatagaatattattgactaggctgtatgacattttgagctcttaactgtgaatggcattcattaagctcctttatcctatagattctatctttatgttcatctgaaatgaactattcatcagtactttctcctcccatcctaagcttctcattttaggaactgacatgataaggtggttctttcataactctaatgccatccaacatagccctgggagaggcatgttaggtttcagagattttctccatggagcaaggtgcagtgctagaatatggtggttgattcccaaacagagcagttaactttactcttggttctgagtctccaaataataatagccgacgtttattgagcacttactatgtgcccaaccctgttatgcctttctcaggctcatgataaatgtattagtctgttctcatgctgctattaaagacatacctgacactgggtaatttataaaggaaagaggtttaatggactcagttccacatggctggggacgcctcacaatcatggtggaaggcaaggaggagcaaatcatgtcttatacatggatggcagcaggcaaagagagaacttgtgcaggggaactctttataaaaccgtccgatcttgtgagacttattcactatcacaagaacagcacaggaaagttctgcccccgtgattcaattacctcccacttggtcccacccacgacacgtgggaattgtgggagctacaattcaagatgagatttggatgggacacagccaaaccatatcaataggtattattttatcccccattttataaatgaggaaacggaggcttagttgagtgagctgaccaatatcacccagccagtatgtgataaaactgattctgacccacacagtttgattctagagcctgttctgactactgtgctaaggtgtgtataatgaacatggtaattctaaccagctttttaaaaatatgtagcgcttgtcatgagaggtactggggaaaagaatgtgcagtagagtgcaaatacattacaattactggaaaattggtggaaaatgctttttggggttacaattatatcatttttaagtgttgatgctttgtagtactacaaagctaaattgtgcaaacaaaacatatttaacagagtaattgggaggataaagcaataataaattcaaatatatttttctccaaactgccaaagggaaagtagaattgtggagggaaatgaaatatccatgtaccaggccaggcagatggtcagttaggatgacaatagtaagttcatctacagcataaaatgtgaaatgctttcatcctcattgcccatttccaactaccattctgtttctcctctattgttcatggtttttcaaacatatctttgatttttcaacccccctttttcattaatctgttcttaaaacttctttttactggctttcatacttagcattccagtgaaatgttcttagactcaccagtggacaaataataaggcctttttttattattatttcttgtcttttttgatctaatttatattttatattgttgaattctcccttctttggcttgtgggatcctttttctctaatatctgtctttctttttttagttgatctttccacccactcccctttctcctcttctccactgagaataatctccctgtcttttattcacttcattttctatactcctatttatccattttgattgtttatacctactatttgtattcgaatgacttcatttttcccaccctgtgggtcagtttgtgacttttggaattttccacaggtacctgtacaacttgatatttgaaaacaggattcatcaccatatatccccagcccccgttttctttttaaacaggcctcattgcgtaattcctttgccctgaaaagtgtcaccacctttatatttttaccccagccttggagttatctttttctgctctccattctccatgtccaaaaacttgctgtcagtccagtttttaatcagttttctccttgaggcttgatctcccatttctctcatcccattatagcttttcatgtagatctgaggcccaggttactgtaattcttttttttccaatttccttgctcccaggatccccatcttgtataaagtttctaaggtgctcctcctcaaactccatttttacaatatccgtattgtaaaattttcattttcagtaacacccagtagataatttttcaaagacgatcctcctcaaacacccatttttacaatatctctattgtaaaatttcattttcactaagtaacacccagtagataattcctatggagcagtggtgttccaaattctccattacctctatgcctaatattcatcagccttcattactctctagcatattcaccttgattcaacagattcaaacttcctacagccttctactgatgtcttacaagctcttgcctctgtgcctttctcatgctattctttttgcttagattgctctttggtcccagctcatgttcatcactcccttcaaagcctttcttcctttatatcttctgactgagctctccctgattgacatcacctcatgcgatgacctccctcattctgtgctgcctcagcacttatcttttgagtttgtactgtggtccatgtacttactaatatgttgctttgtaattattttctagcactctgtgttacagtttcatatttgtatttatttccaaaattaaattgtaagctccttgagggcaggaataataacttttacatttgtatctctgcacccccgagtgcctagtatagtgctgagcacatagtaggcgtttaataaatgcttgttgaagtattg

SEQ ID NO: 11703 - DNA, 564 bp, Homo sapiens
actcaccccagctgctcttgagcttggatagttatacattttggtgacttctgactctccttccacctccccactgtacactgtggtacagatagttggcactatcctagttatggcatcaggtaggagaaggagacgaagatgctttaggaagataaaaaccttacaaagaatgtatactcatcttttttggcccattacaatactgctttctcaggttcttaacagcctgtgcaaactccctgactagatggtctgtcactcctatcattaccttgcacccatctctttagatggcctcagcacctcactcgttattctccatctgtttcttgccattagtttatatgactttaatatccacagtggtaatctaataccttacctcacaggttttcattcttttgaactctggtgcactccatctgtaatccatgtctataatctaccaacaaagatgtactcttaaactcagtatcaccaggcactatatttcatctttgaggcttttgttataccaaggaatactatataaagtaatgagactggtttaaagtaacatgc

SEQ ID NO: 11704 - DNA, 2100 bp, Homo sapiens
gctttccatctctgagttggccttcaacgttcaagaaaatggatatattattttttttccttttctatttccttcaggaaagactaggtttcagtacggtttcaaataaaagcagtggagtaattttctctcccgtaggttctccctcagccccctgaatcataagaatcaaccctcattccttttctcccaacctctcaggtgcatttgctgagtcactgcatgttggcctgaaacagggtccatgtgtctccccaccatttccaaggcatggagatgggaagtgggaagtggggagggtgagctttggactgaacacccaaggcccacggccaccagctacgaggcttcccacaggcttgtctttctctgtatgtctgtcacaggattccagttctccagtcaaaccaatgatgcttctttggccctgtgctccctgaagtcctccctttatatcataagtaaccaaggagtccttcatgcctgatttttgaatgctagtaaattttcaacatcctcatccaactctattccccaggcttccctgctccaaactccaaatcacctgaaaaatatgttccagtcaccccacctctgcaccaacttgagtgagtctgaactgagaagcattcattccaatttgtcatatttgtggaggatttttcttaaatggtcacaatatttctagttccatgggctcttccaaggctttgtcacttcccatccagaggcagtttctgtgttcttccccttgaacgtgggaggcatttgtgacggctgccttgaccaacagggtggaagagacactgcatgacctctgagtgagtaaaggccaggcagcccttgcttgactctcttccttgagatgtcatccttagaacctccatgttgtgagaaagctcaggccactgggaagaacacgtgggtgttcccattgttgacagcctacagacaatatcaaacaccagacatgtgaatgaatgagcctccaggtaggtccagccattgagccagccctcagtcaactgtaccagctgtgaccccagacatattggggtagagacaattataatatctctactctgccttgttcctgttgctgacccacaatctgtgagtctactgctggtcatgaaaaaaaacaaattgaactttcattcattcattcattcattcattcattcatctatccacctactcatccatccaccaaagacacacttactgatatcccactgtgtatcatagactataagcatgggggctgcagagataaagaaagaagtgaaggtcctgaggagctcacagacatactactcattctgctgttgacccatcaccccaagtaacaaaagagcacccctcctaatatcctgcttcagattttcacagtcgctcatttatgcttgcatttctgctttgccattccaactaagtgcctttagaataagggatcaactttttttctcatggtgcttagcacggttttataaatttaacacatgtttgatatagcttgttaatttttgaaaaatcagtccatatactgctagaggttttcaaggcttcaagtaaataaaagaattacattttggaaaaataacttaataaatgaaatccttgtgccaataggagaaaaagaagaaaggtatgaatgatttttgggtccttattagatgactggggcctgctatttcatttactcttcataggaaacttatacaaattatgacaatcctcaaattgcagactttaagataaactggctaaattgaatgactatcaaatgtggcacaaggagtttagccaatgccagggactcttttgcagccactgtggtgactccagcacatgaagatgccacccagatgacatttgctttcaagacctttgaacaggctgccttgaaaagaatgctttccaatgtgcaactctatatcttctgtggctctggtaagtgaggactttacagcttatgttcactctttcctgtaatcatttccaggcctcgtggaaaagtgttaccaattaatactcccattatagaactggaacaaaacaaagtgcaggacgtgggacaaatcagttaaatatcctcga

SEQ ID NO: 11705 - DNA, 2096 bp, Homo sapiens
gctttccatctctgagttggccttcaacgttcaagaaaatggatatattattttttttccttttctatttccttcaggaaagactaggtttcagtacggtttcaaataaaagcagtggagtaattttctctcccgtaggttctccctcagccccctgaatcataagaatcaaccctcattccttttctcccaacctctcaggtgcatttgctgagtcactgcatgttggcctgaaacagggtccatgtgtctccccaccatttccaaggcatggagatgggaagtgggaagtggggagggtgagctttggactgaacacccaaggcccacggccaccagctacgaggcttcccacaggcttgtctttctctgtatgtctgtcacaggattccagttctccagtcaaaccaatgatgcttctttggccctgtgctccctgaagtcctccctttatatcataagtaaccaaggagtccttcatgcctgatttttgaatgctagtaaattttcaacatcctcatccaactctattccccaggcttccctgctccaaactccaaatcacctgaaaaatatgttccagtcaccccacctctgcaccaacttgagtgagtctgaactgagaagcattcattccaatttgtcatatttgtggaggatttttcttaaatggtcacaatatttctagttccatgggctcttccaaggctttgtcacttcccatccagaggcagtttctgtgttcttccccttgaacgtgggaggcatttgtgacggctgccttgaccaacagggtggaagagacactgcatgacctctgagtgagtaaaggccaggcagcccttgcttgactctcttccttgagatgtcatccttagaacctccatgttgtgagaaagctcaggccactgggaagaacacgtgggtgttcccattgttgacagcctacagacaatatcaaacaccagacatgtgaatgaatgagcctccaggtaggtccagccattgagccagccctcagtcaactgtaccagctgtgaccccagacatattggggtagagacaattataatatctctactctgccttgttcctgttgctgacccacaatctgtgagtctactgctggtcatgaaaaaaaacaaattgaactttcattcattcattcattcattcattcatctatccacctactcatccatccaccaaagacacacttactgatatcccactgtgtatcatagactataagcatgggggctgcagagataaagaaagaagtgaaggtcctgaggagctcacagacatactactcattctgctgttgacccatcaccccaagtaacaaaagagcacccctactaatatcctgcttcagattttcacagtcgctcatttatgcttgcatttctgctttgccattccaactaagtgcctttagaataagggatcaactttttttctcatggtgcttagcacggttttataaatttaacacatgtttgatatagcttgttaatttttgaaaaatcagtccatatactgctagaggttttcaaggcttcaagtaaataaaagaattacattttggaaaaataacttaataaatgaaatccttgtgccaataggagaaaaagaagaaaggtatgaatgatttttgggtccttattagatgactggggcctgctatttcatttactcttcataggaaacttatacaaattatgacaatcctcaaattgcagactttaagataaactggctaaattgaatgactatcaaatgtggcacaaggagtttagccaatgccagggactcttttgcagccactgtggtgactccagcacatgaagatgccacccagatgacatttgctttcaagacctttgaacaggctgccttgaaaagaatgctttccaatgtgcaactctatatcttctgtggctctggtaagtgaggactttacagcttatgttcactctttcctgtaatcatttccaggcctcgtggaaaagtgttaccaattaatactcccattatagaactggaacaaaacaaagtgcaggacgtgggacaaatcagttaaatatcctcga

SEQ ID NO: 11706 - DNA, 2096 bp, Homo sapiens; identical to SEQ ID NO: 11705

SEQ ID NO: 11707 - DNA, 1477 bp, Homo sapiens
ttacactagataaacctgtattttaaaagtattcaaaacaaaacacaacacacttacttagagcaataataataaatattacagaataatataatccttcccgttctaaaatatttttaaagaatatgataactttatattgggtcctagataccatactgtatttagggaatttaccaagatagagctggctttattgtaagtcaagcaaaatgaactggcgttcttgtaagctgggttcagtctactattatcggttctgtacagtgtctcctcgtgtgctagtgaaacaggatggggggcgaggaacctccttcccatcttttactagcctgagaagtatcttttcaatattttataattttgcctttggcaaagggctgcttatctcctgggaattcaggcacattttgaagatttccccatagccaatgagcacagaatgattattctcacaaaagttcttaagaaatgtcacctctcttgtgtctccttctttctagataagctctccccacacctttctcctgagacagtctagaatctcccttttatattgctgcagaaacacagactcatttccatacacgtttactccggcacctatagcatagatcaatgctatggacacgtgctgttgtgtgagatttaaaagtaaattttccattcagagatttttaaaaaaaaaaatctggtcatagcagccattagtcaacttagtcttcattgccctcctttttatttctaagcatgattcattcaggatataagattgcatgggcaatcattctagtattaaacaccttggaaagatgaggaccatcttcttcctccctgtgtctgcttctctttctgttccatcttctttccttccccatttctttcactctttccttccctgtccaggtcctgttgaatgctgactcaggccatctgtgctttccaggccagctctttcacttattgctcatgattttggccaagccatttaaaatgcctaggcctcaatttcctcatgggtaaaggaagctaataaggtctacctaatggacccacccaataaaattcttttgagaattaagtgggaaaatgtatattaaacacattggaaattcttgtctacaggggatatgtcatcaatgggagttgttactgctgctgtttctactagattccaaattgagaagaaaatctttctaaagcaagtatcaagtagagtcaggaggaagcatctaaagtttctgcaaggaccatggcacatcttcttgaacactgctgggatgattatttggataataggagttggcatcattttcattattttataggcaatatagaaatatatctgcactcttctttaaaaaaattactaatacataatagttgtatatttttatggggtacaagtgatattttgctacctgcatagaaagtgtaatgatcaagtcagaatgttaaggttgtccatcacctcgag

SEQ ID NO: 11708 - DNA, 1477 bp, Homo sapiens; identical to SEQ ID NO: 11707

SEQ ID NO: 11709 - DNA, 585 bp, Homo sapiens
acagatagagaaactgaggtccagacagggaagggactagccctggggccccacagtgccttttggtgagaccccaggccaggcctggagagagacaggcacacacacactaactagtaattcccactcaacagatcaacagattcctcttgcaggaacaagaggaatttcgtttcccttccaccaacaaatcaaagatctgttatggtttcatgctaaccgccactgatgcttggttggcttttctctcttgcttatcacagtgacatctgcagactaccctggcattctgtagaaagtgtgcactgcctggggtgggagttgatgggggttaggattaggtagaccccctctgtgctcccacaatctcctgaggaccctgagccccagtcctgaccacatcctcctccagccattcttgatgtgtctccctgctcaattgggacttcttgagcacagggacccttgtacggaattatctttatgtgactgtcacatatcttggaggtgaacttctggagagggggtcagagggagaggcctgggtgagttgtgctgccttccgtcatccccctcagtctcgag

SEQ ID NO: 11710 - DNA, 585 bp, Homo sapiens
acagatagagaaactgaggtccagacagggaagggactagccctggggccccacagtgccttttggtgagaccccaggccaggcctggagagagacaggcacacacacactaactagtaattcccactcaacagatcaacagattcctcttgcaggaacaagaggaatttcatttcccttccaccaacaaatcaaagatctgttatggtttcatgctaaccgccactgatgcttggttggcttttctctcttgcttatcacagtgacatctgcagactaccctggcattctgtagaaagtgtgcactgcctggggtgggagttgatgggggttaggattaggtagaccccctctgtgctcccacaatctcctgaggaccctgagccccagtcctgaccacatcctcctccagccattcttgatgtgtctccctgctcaattgggacttcttgagcacagggacccttgtacggaattatctttatgtgactgtcacatatcttggaggtgaacttctggagagggggtcagagggagaggcctgggtgagttgtgctgccttccgtcatccccctcagtctcgag

SEQ ID NO: 11711 - DNA, 1116 bp, Homo sapiens
catcatggctccccatgccaggttcctgcttctcatggtccttctcacggttgttgggagttttcctatctctccagtgctcttggaagacggtttatggtatattatcaagggaagcctgaaagggaaactgctagttgtgttcaccacccaacgagatctggagtcctgccttctttctacacttagtcacacagacctagccccacagccctctagttgcagggcttgattgagaaaagtatgcagaggccgagagtgtgtgtgaccgaccacatcatagccatcgaatgtttatcaattcccattcagtgtttcagtgaatcttcagtagtctctgtgttctttgttagtcacctggtttagatgttccatgaattgttcttcctcttctagcaatgatgaccaacgtctatgaattgttaatatttaccggggactgtgctaagtgctttgcatgtgtatttttcatttggtgttcgctataactaggagtaggttgttttgctcctttcacagaggaggaaacaggcttggaaaaggtcactggcatgcataaatcccaagctagtcagtagcagagctagtcggtagcagaactagtccgtagcagagctagtcggtagcagacctagccggtagcagtgctagtcggtggcagagctagcctttgaattgaggtttttctgactccagattccatgccttaaactgacttcctgaatgtatccactgggataaatttctcaaaatggaattggtagatcagatgatatatgagtttaaaatatggatagatagttccaaccggtttttcagggcattgcctggtgtttaccattcttgtgtatgtgcttatttgcaccagcagtatttatcttttagttttgcttttaaaaacaaatcttgtaggccaggtgcggtggctcacgcctgtaatcccagcattttgggaggccgaggtgggaggattgcctgagcccaggagtttgaaactggcttgggcaacatagcgaggcccaatctcccaaataaataaatgatatttttaaaaacaaaataacacagagcccttggaaatcaaaaatctagcaggaggaaaaaacatctctcgag

SEQ ID NO: 11712 - DNA, 731 bp, Homo sapiens
ccatattgtctggttcaggtaatcacttgttatcagagttcttccaaaatgaaaacgttctgatttgtactttctctcttgaaggtgacttgagtagtcttgaattctccatctgttctggagactttggttgaatacaggcactgaggacacaaaagtggacgggggcttctggttcctgccagggagctgctcccaattgttccacggacccccatgagattcctgaaattgcgtgcaaattattgtgcatttaaacatttttcctagggagggagagtgtttttattcagatcgtcagtgggattgaaactcttaacaaggaagaattgatctagcacacatctacatagttcttcagtatttacccaacctcctagtggttacagtaggagggactctttgaaaaaggtttcttggccaggcgcggtggctcatgcctgtaatcccagcactttgggaggccaaggtgtgcagatcacgaggtcaggagatcgagaccatcctggctaacacagtgaaaccccatctctactaaaaaagaaaaaaaattagccgggcgtggtggcgggcacctgtagtcccagctactcaggaggctgaggcaggagaatggcatgaacccaggaggcggagcttgcagtgagccgggatcgcaccactgcattctagcctgggtgacagagcgagactccgtctcaaaaaaaaaaagaaaaagaaaaagaaaaagg

SEQ ID NO: 11713 - DNA, 387 bp, Homo sapiens
ctgaatttatttttcaagtaaaatggtaatagacatatgtggtatgactacctagttatgaaggttaaaagcagaggtacattgtttagtacctattgcacgtatacgtggtaaaaatgtttgtggtttccaaaaaattcaggagtgtggtaaccttgggtgagagtgaaggaacacaggagtttctgggaacgggcactgttctcgatgactttggcagtggttacctggtgtctgccttgtagttatttgtgatagttaatgtcttacagacttttctgttatgtttcacagtttaactattttttaaaaatgagtgatgtctttggccaaaaacttcaaattgagttacttttatcttctattttaaaaagctggagtcacatt

SEQ ID NO: 11714 - DNA, 760 bp, Homo sapiens
attttctgtaaattaaagttgtttttactaaattatgggccatattttttggatgtgtgctctgaaactaatactgcttgcaaggagaaaaaaaggagatgcaagtgtgtctaatatattggatacataaaagctggagtatgcataatcgtcttgcaagagttcttaaatctctgtatataaactgtttaaaagtaaattaaaattattccttaatgaaatacaaatctgaagtcacttgaataactaatcattttatgacccatgcagtgaatttttaatgcctacttctacctgattattttagatatgtctgtgttgtaaattaaaagctacataaatcattaatgtgttgatacagatcagtgaactgcttacactatatgtgattccttaggacatacaatgtctgattcacctccctccctttcaattatatggctgccaggctctttttctctattcattttttgcaaggtcttatttggtagaactgcattccagggtctttatcactttcccaagaggaactgatgtttccaatcaaaagagggctcacactgcaaaaatgaacaggtcctaaatccaagagtgtgaacacacaatctacgagggagaagtttgcttttatttttgtttttgttttagtaatctatgctcccaagaaactgtagcaacgaaacataacctctgcacttttttaggtcattgcagcctttttaccttccttgaaaatgtcgtgccctttctgtacctcgag

SEQ ID NO: 11715 - DNA, 760 bp, Homo sapiens; identical to SEQ ID NO: 11714

SEQ ID NO: 11716 - DNA, 1234 bp, Homo sapiens
ggtgcttccaggtaagagccagctgtggtaaaagcagatgggtatgtacttgatctttgtttactgtgtggtactcttttttgtttcagccctgacgggggtggctggtggagctcctagtgaaatgcactgaagtctctgcaggggggctgcactagctccaagtcttagacaggcagaaatgtgatctctttccctgtcacactcctgtactggggctcataactctccatgcagatgcacactgtcgtctgtctccaggccatagtgtgattgagaaccgcagaagacacctctcccctggctctccactggagtggtttcacgctggaactcctcactcagcccaatacagacagctctgtggctttcctgttctccaatgtggtaatgctgctgattgaagcagagagggagaggggctccatcttttggcacatgcaggtgggtgtcagctgtggtgctgtcagctggctgggtcagcctaagctcagacccgatggacctaatagacatttacagattattctacccaacaactgcagaatatgtatttctcatctgcacgtggaacattcccccaaattgaccatatgcttggccagaaagcaagtctcaatacattcaaaaaaattgaaatcatatcaagtatcttctcagaccacagtggaataaaattagaaatcaataccaagaggaaaaaataaggagtttttcaataggtagaggaaggagaatggtgccctggggttaagaacacattaacaaaagtacaagaggcatgaaaatgcagtgtgtaaaggaagagaaaagttaatgatgcaccttcatggtaaaggggtacaaagccggaggtagtggactggacgaggcaaacctccaagcccagagcctgtaaatggcctgctcgatggtgtatgggaagcctcaggcagtaacagctgagttggtggcagaatacgcaggtggtgggaaccccagggttgatcacagacctgtcagcatgggctctcagaagggctccagctggcagctgaaacggttgggtgggagcagggtggccgtgctgctgttctttcgctgaggaaggcggactccctcagctggagcaagggaggctggcagctgtgggatgcgtggcccgattgcacttcccttttataggagtggaggtgtatttcgctgttggggacatgcaaacgtgctcagcctccccctctctccctggcctcga

SEQ ID NO: 11717 - DNA, 1234 bp, Homo sapiens; identical to SEQ ID NO: 11716

SEQ ID NO: 11718 - DNA, 378 bp, Homo sapiens
ttctgccccaggaatgcctataagttacaggtttggtcactttatgtattccatatttcttgaagactttgttcatttaaaaaaaaaaaaattgggggctgcgtgcagtggcttacaccggtaatcccagcactttgggaggctgagatgggcggatcatgaggtcaggagatggagaccatcctgtctaacatggtgataccccgtctctactaaaaatacaaaaaattagccgggcatggtggcacgtgcctgtagtcccagctacttggggggctgagacaggataatcgcttgaacccgggaggcggaggttgcagtgagccgagatcgcgccacttcactccagcctggggacaagagcgagactctgtctaa

SEQ ID NO: 11719 - DNA, 378 bp, Homo sapiens; identical to SEQ ID NO: 11718

SEQ ID NO: 11720 - DNA, 427 bp, Homo sapiens
aggtgaatgtcttctccacatatccattagcagagtgcatgttcggtaccaaagggtggtgtgatgcaagctctctttcctgctgctctcgtagtttcctgtgttgctgtgaaatagaaggtgggataaggcacttggttctccaggagtactttcctctaactgccaccgtttttaagcttctcagcagtgtttttcacaccctgctttccgtgtgcatgtctgtcacttatgattaaactaaacacaagtttttccatttttaatgctgctatgcttctatacctctggtaagtttgatcatcgtgttctgggttgggagggtgagagttcttgtgattccctttgtacttccctgacactaacacatgccctgcacacccatcatgttgcatcaggtccatggtggtggtataaaattctcgag

SEQ ID NO: 11721 - DNA, 11601 bp, Homo sapiens
gaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaaggtgaattgtcttctccacatatccattagcagagtgcatgttcggtaccaaagggtggtgtgatgcaagctctctttcctgctgctctcgtagtttcctgtgttgctgtgaaatagaaggtgggataaggcactttggttctccaggagtactttcctctaactgccaccgtttttaagcttctcagcagtgtttttcacaccctgctttccgtgtgcatgtcttgtcacttatgattaaactaaacacaagtttttccatttttaatgctgctatgcttctatacctctggtaagtttgatcatcgtgttctgggttgggagggtgagagttcttgtgattccctttgtacttccctgacactaacacatgccctgcacacccatcatgttgcatcagtgtccatggtggtggtataaaattctcgagcttatctcctcttttaaatactgagtaaatacataagctttttctaagcttatgtatttactattaccactatgatctcagctttatttaagagcaatttaaaatgcagttcccataggtgtctttttttacctctcctaagaatatacaggcttgcctggattaagaccctatgatctctatgtagactgacttaaaatccaatggaatgaacaaaaatatttaggatgcttattggtagttgccccttttacacacttgctcccccaacttcaagcatttagcgatgagaccagaccaatgtgagtgtgtaaaggaatatagtagatttcactttgcaagtcctaggtagtgtcagacactaagactcagtagtccgtccgttgtaggaatctgtgtctttttttggaggactctttttctgtagtagtagttgttgttgttcatctgtcaagaaaaaagttttcctttttgtggctctcaaattggggtatagggtaggagacaaaatgaggctgtatttcactgttagtgagtaactaaggcttctccctccctccctgtcctgtcagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtaggtgcctagagataaaattaagtatgactcttttgcttttgctcataaaatgatgatgcatcggaagagatttcatactcccagagggttttacagcataagatttgagcatcccagggagcccttctcccacttctactatacaaccccacatccatttgatattcttgacttgtaactcacatttggctcctcgaggcagcatgagacaagaaattcattttcagtattgtacttacttgaaccaactggtcatggtttcctgaaagacaattgtaagggattctaaactcagaccagcttcagtagcaaaacagggttgacataagagaggcttgtctgtcaacatgcatgtcttccatgtcttttgccataatagatcgaaggcctatgtcctttcaacacatagccctcttagaaggaatatatgcccaagaaggatgtaagttaagtctgaagcaagaataagtcatagagtgaaagtcctaggttctgggcccagctgtgttcctaggtgtatggtaagggtagatcaggcacacatcctgatcagtctctgagcacttctgccataggagctccttgccaatattttggctagcttgagtgttttactgaagctagaacataagtcctagaaagccaaagttgaaaaaagagagaaataagggaagagatggaattttatcagacagctaggatgcattgacgctcttaattcctaaatgtgtcattagcttgtgtgagccgctgatcactctgtggtaggacagtgggaaagtccacttgactgagggctggccttgctattcttagtccatagcctatagttcttttcagactccatggtacagttttcagaaaccctgacaatagtttttgctgtcctgctatggactctatttttcttctcttggcacctctacaaactccaaatggactctggcttgggaggtggaggactgtagacgaggaaggactctcctctccttcggtaaaatctgaccagggatcctggctttctctgcctcctgcagtcagtcatcaggatccttgttttgttttcctctctgtctctgttgttttcctacaaaggaaaatagtttggttcttttacaagaaatctgtttaatcatatctagaatagggtggccagaggaggactgttactcaactgctgagtggcagaaatccgtgagggtatgaaaagccagcttgtcccaggtctctgctcgcatttaccccatcaagaggctctctctaaagacttcatgtctcttgggggcttccccctttctgcgttgctcttttccttgcacccccaagtggagctggttggtacccttccctcacagaagaccagagtgcttgcaatgcaatgtctgcagcgagatcacatcacagagctttttatctgatatcaatgcccttaagaatttttgcagccaatatttaacaagtcagcctgaaaatacagctggaccctataactgtttatttattcagacgaagtgaagctttttggctaggtgcccctgttgagggcttggggtatacaactgcagaatactgatgattgttccaagtttggacatgggactcaaactgagctctacagtatagtccctgtccactagcagggatcctcagccaaaccatggaaggttgtaggtctggcttccgctagacccagctgggggactgtctcccctggagaactgggggggtggggagagggtattgtagaaagctgagccctcagattcaacttgcttgtattttaatctagcctcagaaggtaataaaattaatgttctatacccatgtcccctttttccttattccttgcccctactttgtcaatgtgttcaatgtgttcaatgtgttaaaacacaatgtggggatttggtgggtaggaatgaagactggtataagtatatactgggaaagccttgaattcctggcaaatgtaatatttttctctcctttttttttttttttttttttttgagacagagtctcactctgtcacccaggctggagtgcagtggtgctgtctcagctcactgcaacctctgcctcccaagtttaagtgcctcagcctctctagtagctgggattacaggcatgcgccaccacacccagctaatttttgtatgttagtagagacagggtttcgccacgttggccaggttggttctgaactcctggcctcaagtggtcctcccactttggcttcccaaagtgctgggattacaggtgtaagccactgcgcccagccctaatatttttctcttttacaaataccattctcactaatatgatattttcctaaatgaagacaagttgtccaacatgaaagatgataaaattctaccctcctttttgcacagctaactggtggaaattattagcaagtgatctggcttctgttaatacaatttaattgaatgtgttttaaaatacaagcaacaactttgttcaaactaaacccatttttagagcctgtattgtagaatataacttttctcttgatttgttatgaaaggagtatattcttcagtgaaaatgaagtctaatttctgtatccgtgaaataagtatttgaattaacatagcatttgaaaattaaaattgccccatgccttgctgccaaggaagcagaacaggagaatggggtgccggatttagagccagtgtgcctgattttcagtttctaccatcccagactatgaccttcccaattttaatgaatattcttgcacccagtttcctcacctccaaaaagcatgctgattaagtgaaatggcctgttctgaaacccaccactctctgtgagtacaccatgtgtgcccatggccagatggccagcatgcatgatgagaatggagtcaggtaataccaatgtctcagactaagaagctcgaagatataatcttgtgctccatcactcctaaataccattttcaaagtattccctcttggaaacataaacgtccctaacccaggtctgaagaaaactttcataactaaagaatgccatgcaccaaagctcaaagcaagtagatttcaagagcgaagcatcacccactaatagatatgaggctgaatttaggtttccttcttagcggtgagtttaactgaatcattaatgcacttggaaagaggcaggaaagacagtgccctgtatattagaacaagatgcagggagcgagcctctcaagaatcagaggccatcattggagaggcctggattctggcgatttaacgaattcctgatgacatagcaaggtcgtaggagatggagccattcaccacaaagatcagatgccccaacacaggccattagttaccttgaaagatttttgtttcccattgtcctctctcctcttttaaattctctgttctaacttctggcaaggtttagcaaatggcacatggcaggaagcacttttatttgaaacagtcttcctaggataacatcctttcttccatttttatatataaacgtctaaaactatcttggcattggccaaactttatcttccctttatgtatatagctgtatcagtcttggcagcaataaaaagtgaagaaactttgaaatggtttcttcaggatgcaagcatgttgaggtcttgtgcacatgtgtgattgctggtttccataagactccagacgtgagccagttgccaaatgaaaagatcaaatctgtgactcagagagtccaatggattatcttaattaactacatcataatcagcatggttcatgcataaaaatatattcacttaaataagttcctgctattaacaggctctgttctagttgtttgagatgtatcagacaactagtgtctgtatgataagggcttatttttttgatgagtagatacttatggaccgtactacccttctaatcaggaaagttaaaaagacatggtaggaagaacatgggcctcaaaatgcaaccagcatttgaatgctcactatacagtgttagctggctaacttttacagtgattaatctgtcatattcttcccatatcagcctcagggctcaatggaggtgttagctgtggagaggctttccagagagttgtgctctctgaaattcaagaatcttcttcaagcttgactcctgataagtatttttcttcctcttacttcaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaataacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgagcaagatcaatggtaagccactcaccactctgcctactgttccaacaactatcgccactgccacatggacctaaatgagttccccaaatgaaccctcttcccactcgccaacagctttgctcttgcttctgttggtaatcagggttacggagacaacttaaccatttaccttttggtgataactatttaccttagtcatttctgaggactgacccaatgctgccctctagtgataaatcttaaaagggctgccatgagctattgaaatgtgatgactggtgactcttggagggctgtgtaataaggcgtcatccatgtcccatcagcttaaaatgaggggattctgaatctcttccacttcagataaatatgcatggctttctcttccgagaaggataataattattggggtacctagtatttggtgttgatttttgttccactgatgtaaatttcaaaagtatagaactaaacttcaaaaataagctgactcggggactggcctatatttggggaaagcttgtctactgattgcctggattttttaccttctagaaccaccttagccagctcccagacaagtttccctgccagttaccaaatctactgacaatgcatttgagaaccctttctttaaagattcttttggttcatcacaagcctctgtaagtatgaactactagaagctcttctccaaagtacatgccacatagagctccagcctcctgaattaaccttgcttttataatagcttttatttatttatttatttttttaagacagagtcttgctctgtcggccaggctggagtgcagtggtgcaatctcagctcactgcaacctccacttcctgagttcaaaggattctcctgcctcagcctcctgagtaggtgggactataggcacgtgccaccacacctggctaatttttgtatttttttgtagagatggggtctcgccatgttggccagactggtctcaaactcctgaccttaagtgatccatctgccttggcctccctcagtgctgggattacagtcatgagccaccgcacctggctataatagctttttgatggtaaaacatgtttagctaagatttgtcaccaagaaccttcacagtataaacattcatttaaactggagaaagattatttgcacaagaactattatcttctgaatttgagaaataatatcacatagaaaacatccttcatatctcacttaacctgacccatgaaagcatttcgggagaaaattgagccaaaatactgtcttgaaaacctttcaaaaatttaagttcttaattttccaacaatatttctatagcctgtgaaaataatacttcccatttcggggaggcaaatgaaatgcatctgaaccttgattttcacataaataatatacactgccatctgcaagcagatgaaaacaaaacactgtaagccccatataatgtttgattggctgattggcctatgacctaagcgatttttaaaagaattttggaagtcttcattgcgatttttttcttatgactgtaactgtatttattgactagatgattttatcttcttaggtggcttcttctcaacctgtatcttctgagatgtatagggatccatttggaaatccttttgcctaaattctgtaagtagaagatcctaataagcctgtctcaggggtttttgtgagaaagggtgacatggaataaagagtgaaattttaattttagaattgggaagagggtaaatatctataatttaggagtaatcgacaggaaaatctctactgagatcattcaataatgactaggctgggcacttaagaatagaattcctaaacacatccaaaaatagtaatatacccttggggatgtggatttttatcttattccatgttcttggtttttcagttctgtgtgggaagtaaaactcaaaacaacacatcacaggtttctaacctttttactttcatattgaagtggttgcaaaacaacctagtaataatttggtttcctataaagggttcagattccattgactttctgaagccaccaagtcagcaaaacagattatgatcattacttctctaccatttaactgtgagcaatctcaaagttagtctgaaagagtctgatggtattaaatctgaaagttttaacaactattaaagatctccttcataggcagtaggagctcaaaatgagtctgaaggttgattcttctgtctcatgaactttatcttagataagtgattaggtagaatcaccctcagctgaaatcctgggagggctcagtgtaactctttctctacagaaggtgacagcaactttattctgatctcaaaagactgaatttagtagggaaaggaacgctctccccattttagagcaggtaggccagctggtaggggtagaacaatagaaataatgaaaaacaacaacaacaacaacaaaaaccaagcccattttttttccaatcttgtctcatccaaacaggactactaaactgtgatttggctcatctagaatgtaattatttttaatagatagatatcttaaacgtggcgaaaacaataagattgagcttataggcatctggatcattttccctcaactccagttctacaatgactgtgtttcctgtagtacctttccataaactgcttcagagaactgggtaaatcattaaaaatgcaaattcctgggtcctactgcagccctaaggaatttctctttggtgccaaggaaatgcttccttttaacaagagtgcaggtgattctaaaggtaataaagcagtaagtagatatttaagagctagaagtcttaccagagatcattctcaccttccattcaaggggagatatacccaaaccaatagaaggagtaaactacactcagagtcaagatggattgtatggactaaattgaatgaactagacttctctttggaggtccttccttctttaggtcatgaaggaaggatagtttaggtcaacctgctacatcaatagattgggtaaggggaactctcatgggataaaataactaacattgttgagcacttgcgctaagcattttattagatgctctacatttatcatcttcatcaatcctcacatcagccctaggagatactattactgacatctttaataatgacttgatatttaatacattgatattcagttcaaaaattctaaccacaagtttctttcttctccatacctctctaggaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaatgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaatatca

SEQ ID NO: 11722 - DNA, 6937 bp, Homo sapiens
agatagaggaagccagcaaagcagttgaggtaaaattgcatctttacttcttgttaatcatgtgtgtgacatgcgtaagcccctgttttctacctgcccaaccactctcgccacctcgcttattactatgtgtttatgacttctctgatcatgaaagatgtttagttaaaagatgataccaaaaccattgctgcttagcagactaatagagtggacaaatacattttatagacaaagctcaactaaatccttaaatatttgctatcttttcagaatgggagtgaggccctaatgattctagatgaccaaactaacaaactgaaatcggtatgtattaatatgtgacgtttgacagttcttacttatctgaacatgggttctacttcctgtagatgttgctgataccaaatctgtattgaatctatatgaaaatccaattgagacaactgtttttcaaaatattagtgtaacatctatgtcaatatacaaaagtagtcaaaaaaagattagaaaagtaatctttttagtagccacacctgaatctaatctaatactttttaaggatgtggacaagatagatttgctttgagacatgtctacacttcctgacctaaacagcttaatatgaaatctattagttaaatggaaattaaattgtgacagctactttcctaaactttaggaaacaaatgattacaatatacgaagtaatcttttttagtagacacatctgaatctaatccaaatacttttttaagggtgttgaccagatggatttgtttggggacatgtctacacctcctgacctaaatagtccaacagtaagtgtttgtttttaaatttgcaatgtaataaaatgacatctataactcaaattggcaataaccagaaatcttaagcatctcattgaaacttggaaggtgactgttgatttttgcaaatgaagtgtcaatggtttttagaataaatgtgaatcttaagtcaccatgggaacctatccacactaattcagttatattaatattgcttacagattaaacctgaacaataagtcagcaatgtagtccttcttggtatcacttaggattagaaggaggaggtgaataatagtccttgaataagcctacttgaagaaagtatgactgttagatggttaatcataaagcctcctggcctcttcatttcttttgcattctgtctgttgcaatttagcagcataaatttggtgtgaagtaagatttaaaacaaacaagtggctcagttatattccaccaaagcttgtccttgttagaaagctgcccattctcataggattttataccatatccagtctgctcaatattgaatgatctgtaacaaccctgtaagaacagaacagtattttcctttataaattaaaaaaaaatggtggttcagggaaaaaaaagaagaaaaaaaaataaaaaggaaagaggtccagattcaagacttaggcccaagtcttcagaccttccaaaacatacctctaatgaaaatgtccatgacattttgaatgacttcttgcaacttcttttatttatgtaacagtttcctgagcacctgctatttgcaaggcatagcagtaagatgcacaacatcaatgacatcatggaatttactctccggcagggagaccaacattaaaactaatcacatcgttagtaattgatgttactacagggtatttatctagttcagattcaggtaatgcttctgcaggagtgagtttctagatttgaacataaaagatgagaaggcaataaacagacaaaaagagaattagtctagaataatggggggaaatgtctagaaaggactctcttgtatcaggaaattatcatggaagcctatgtgaccaaggttacaggagttgaagcaatggatcaaagattggataaaattctcccttcagacttctgcagagaatttgaggcctgtgaatccttactgcataaaactttcaggtcaaatgagatggagaggagcagggacttcatgcattcttctctgaccctaaccatatgagtatcacaatgcatggtagcattctaaaatgcctttaagagagaagcctgtttaatattcattttagcagtgagccctaactcacttgcctatagaacctttcattcttcataatttttgttatagttctgaggataaactttttaaagtactagactagattatcctgacaggtccatcctaactctgaggtccttttgatttgtagtcaactttgtgctctcctccattagtgatgttttctcaaataaatcagtatctgaacacttacttcccaagtataaatgacattcaaacaagtaatattcaaagagagcaaagcactcaagatatgaagtggaattccactggaataggcaaggaagtactgcctatataatctacttctgtagacttctagaatgttctaaaaaaggaaatggaaaacaacatggataatcttcagtctcatttttattagactttatgaagtctaagaattttttatttataggaattcaagttttagttaaactaacaataaagtaataaataccatcaaaatatatactctctgataaccaaaagaaggctaacagatctaattatgtgctggttaggctttgacatgttcttatctattgactctatagtcataggtcaaaaatagatttatctctacttggtaaagccagcatgtttaaaaatattcaactctttcaacaattgctctgaaatatgtaaagagagaaagaaatctaaattacctagactttattattggtcctagatggttgtcactcccctcaaatttatacagaaaagttttatgagtttcaaataatgctcatgttgcaaactatgtggtatcccctagaacagaatttttattggcaagccccttgagcattatccttccacactgcatctcaaaaaaggaaaagaaagaaaaacataaaaacccatgttctgcaactttaacaaccacttgaaagcacagttactatggaaagaatataagacatgatctgtgatcaaggagattaaatctggtacaagggatgggatcaggatacaaagcaggagtgtcacttatgtccttgtgtacatgccataagataacacgggtgggcacagggcaagtgcagacagaaaaatcgatgctaaaagctttgtaaagaatctgaatttgagttgggtctttgaagtgtgtaggaaaatagatcatagttgggctagaaacaacgtgggtcttattgtggatcatttggaaatttggcctaaggaggtttattttaatatagggagccagcagtaagccacttaaggctttgagtagagaagtcctcagtctgacaaactggaatggttaggtgagattagccacccagagaagagctaggctatggaactcaggatttatgtccgattactggagctccctacgagcaggttctgtaacgcactgccgtgtctccagtgcgtgcggctcaggtgctcaaacagtggccaactggaggcagtgttgacagttcgacaaagaatgaatgaggcgctgaccaagtgggtggatgaggagtctttgggctctcagttgtagtctgtgaactacacttttaatcttggattaataacaaacccagcctgaggagagccttatacattttacttatagggtgactattcagaagtctaacattgtggctcctgtttggtgtcctaagaacttcttctgaagtatttgaaaacgagaactctaccagctgtgaacactcaactgttctaacccagaggtggctcaaaacaaataaataaatattgaaatcacaagcttttgtaatacattttatcctaccttttgattgtataaagatccctagattaatagctcttccaatccatttctctgattaaatttttttttaattataagctctttcttgtgacaaattcttcttttataaagagaaagcctggctttggcttataaaaactgtatttttatgcctcacagtaaaggaatcccaaagatagattaccatttaggtctgattttgctgtctcttttgtggccatgaaataggacttaaactttctaaacaattgggtatttttttttcttttaaaagccaaggagttctatttgaacccttttgtatttactagtttgcaaattttatattcccttgaagttgtttattttccccaatgatcaaaatatttagtattctgctcagggtaatgcaagataactactataacttgcacttcagcaaggcattttttatcatttatattcttctctgggtagcatagttaagtatttaatggatcaaagtcaagcagaaggaagtgatgtcagtatgaaagttctgttctaggatgagttataattctgtcttttactggaataaagacatgtcggattcatcaaatttactgcttttaagctgagaattttttatcaaacagttgaaaatccaaaaaattaacacaccagagaaatgatagagaggggatagaattagtagagctacatatttgatatgtctttcaaattaactcttaaacccatgtctctaccttgtacaatagtccccctttatctgcagtttcactttctgaaattaagtctgtggtcaaccttggtctgaaaataagtgagtacggtacaatataatattttgagagaagagagacagagagaccacattcaaataacttttattacagcatattgttataatcattctattttattacttgttaatctcttattgtgcctaattgataaattaaactttatcatgtgtatgtatatgagaaaaatactgtatataggttttggcactatgtgccatttcagacatccactgtgggccttggaacatattccctgaggataaggagggactactgtatataaattaaagatcagttgttggttgactttaaccactaaatagatgagattactgtcacaacacaggcaactctaagcaatgttatgaaaagatgtacaaataggagatcttaatgtgtgattgactaaattagatcagtattgagtgtctctttcagaggacatagacaaaaagggtaagcccagaggagagactgggatgatgaggatgagatcctacttgactatcagcttcagcaagagccttaaatattaagagacatacctgaaggccgtgatataaaagaaaagcctctctcccacctctagaggaaagaactggaccgattttagggaaatgcatttgatcttaaatttcatcacagccagaactataaaatatgaatgtattagtcgatgaattttctcatttagagagatgatcctacatgactctgggggtacaatagagaggactgtatgtgtataggtaggaagctgagctaagcttctgaaatcacttactttcaagctcaacatactttgataatcatttatagtgactcacaatcaattccctttaagactttcaaagtcacaaattgaaacaatgctcataatgaattaagccagtctgtatgtgtgaaccagggtgagcagagacatgaagtaagcaacagtaagatttcacctaatgaggttgagacttaaataaaagggcatgatattggggaggaatagaaaggacctagtctatagctagggagtaatggactacgggggttgatggaaggaggtaatgatcaaccgatttatcaagaccaaattcaaatggaaattctgataatcctagtcatcttatgtaattttctcatttgaagtcacaacatggactaacactttctttttttttctttccaaatgtgataggaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaaggtgaattgtcttctccacatatccattagcagagtgcatgttcggtaccaaagggtggtgtgatgcaagctctctttcctgctgctctcgtagtttcctgtgttgctgtgaaatagaaggtgggataaggcactttggttctccaggagtactttcctctaactgccaccgtttttaagcttctcagcagtgtttttcacaccctgctttccgtgtgcatgtcttgtcacttatgattaaactaaacacaagtttttccatttttaatgctgctatgcttctatacctctggtaagtttgatcatcgtgttctgggttgggagggtgagagttcttgtgattccctttgtacttccctgacactaacacatgccctgcacacccatcatgttgcatcagtgtccatggtggtggtataaaattctcgag

SEQ ID NO: 11723 - DNA, 22958 bp, Homo sapiens
taataggcacacatgttccattttggaaactacaaaggaaacactcctacccactcccctgctttcagtcttcagtctaatacagcaggagaaggaacaaaatgagtccaaagaactacaaaagaaagtcactagttgtaagcctattctggcataaagtctgggtctgctgtgttctgatctcaatatgcctctaaactctgcctacaggtgtctgtgggaggttatgtttatttgagacttctccatcgggatcgcctggtgtcaccaagtgtccactggtactgaggtttgctgcctgccttcttgccatgtctaacgaagtagaaacaagtgcaaccaatggtcagcccgaccaacaggccgcaccaaaagcaccctcaaagaaggaaaaaaagaaaggtatggagaaatccacttgaagccaaggaagggagctagagatggttacccctggagaaatgtgagattcagaataaagtaagggctggctctgatcttccttcaacctcagcttagtctcatgttctcctaataggaaagttgtaccttgggagaagagactggttcatctcacgtgtaataagacatctctggaaacctgcgattatacccacttaagtccagttgggaaacagtcatggcatcttgttcagttaataatgcagtcgttaattattatatggttatcattcagttatttatttaccatttgattttactgaactcattgggaatgggactacacagaccttgtaaaaggagcaaaagacattataaagatgggataattatcttaataattttcaagagaacttaggcataattcctttctgccttattgataatttaaaatgttggtaaattgcttggcagcttatttttcttacattaaaaatacatatattatcatccttatattcctttaaagacttaaaaaaaactatgatgaaaaatgtccccaactcccacctcccatattcccatacgtttcccataacgctgtcaattttgtacttctaacagtttattttctccccacctcaactccatacacagttgattgtggaacatgattttgctcaaaggaagtaagaataagacaggacagaatattacatacatgatcagttgtagtataatcaggatttatattacttaaattttggagagtctagagcatatttggtcataattagaactagcattcttcatcctgtattcctttcttttctcaggccctgaaaagacagatgaatatctcttagcaaggttcaaaggcgatggtgtaaaatataaggccaagctgattggcattgatgatgtgccagatgcaagaggggataaaatgagccaagactctatgatgaaactaaaggtaaaagggaaatgaatgctttatctgtatattaagcaaaagtccaagagagggaattatattagaagctcttgttgacctattgttcaattacttgaaaactgcttttaatcacattatccatcagtagtgccccattttctgagaaaccgtgagtgtttgcatatttggagggatgtcctagatacctaattttatcaagtataataggactctagatgccttttccttctggcaagctcaacattaggacgaaccaagcgtattcctatttctattcctataaaagctgtgtgcaaatatttgcattgcttgtcttactatatgtggagagcacggaatatcctgttttagacctgggaattgttctgataaaattgaggattctacttagacattggtgttccttagcgctagcctttctgttttttgaatttaaaaatttagtactatggcactatgtgaaactgactgaataaataatacttgttcaatagttcaaggcctagaagaaacatctctaaagatcttctagttgagctttaccagtgactattctgaggccaagagaattagagtgacttgtccgagttcgcacagctaactaagggatgccctggttcaacgtcttctatgccgtcttgctgtcccggatgaaaagtgccgaatcctctcatcgatggcagatcaagtcgaaaacaaagctgactgactttgaaaattttaatattaaaaccattgtaggatgtttttaaaaattcaacttctcttgtttttccaccctcatcagggaatggcggcagctggtcggtctcagggacaacacaaacaaaggatctgggtcaacatttccctttctgggataaaaataattgatgagaaaactggggtaagaattcacatttgctgatacctctctgaccacctgagtctgaccaacaatttgctacttgaatttcggctccccttcttcgttctcaaagttctgtggggaacaaatatatcatatattacatctccagaagtaacaggcagaaaacagaataggaggtaaaagtcaagatacttgattttgaatttgtgttctataataaatgtgaatctaagtctgttaagtctgttaataggcttagattcacattatgtctataatatataaatatatatatttttgaaattaaataaatatatataatttatataatatacaaatatacattaaaatataaatacatatataatttataaagtaaaacttctatatatatatatttttttttttttttttgacctcgggtatacagaactagattaattttaacccctagtttgtgacacttttatgtattgcttacatgtgaacttaccggctaacctaaagctagaacctcacccataacacatctacctctttttcatttcttttttccctgccttctcacctcacagatgtaaccttgtttttgttggttcctgttgttctattacttgtgaacagtcttacttattttgccttgtttttaagccttatcagaaagctatttatcatacatcaagtcttctgtgattttttttctgtactcaatgtaacatcataagactcatgttttttaaaatgttgtgtgtggctcattttcattgctataaaatactctctcgcatcacgatactgtgaggagacctccagttactattcatccctttctagagtgcccattatctaccatgcaaacctagggccctggcaccctagtggaccccactcagcctgctagtgctggggtcctcaggcaccactctctttatcagtcgcctttatctgtcaactcttattttcccaagcccatcagagaaaggtggcatgtttctctcacccttctgtgtctcctcaaactttctaagatactctaagatatcttagacattcaggacaaaaagccaagacacactctgccacctacaaatatccctaaagagttcaaccttgttaactgcttgaaaggatcaagaaaaaggagggaaaaatagaagaaaagacactaagccaatacagtccccaccccttataattcctggttactgatgtagtcattatgtcattaacatactgtagttattactacattatgttactatgtattaggctgtctaggtgaggctgagaaacacttgatgacagtatttggtatcctccagaatatactgggaatacggttccaataacacataggatggttcctcggccactctgagccatcgtcaatgaatccctgtgaacactcctctagcttagttatgctgttcttttaagtttgtctttgagttgggaaagtagacctatttggcttggcttaagggctaaatgtctcctcttcacttggtcttctaatcctcagtccttcctggctatgtggcatcatgtctttaaagcagggagagtaaagtatcaatattttaagaaggaacattcttcccacttacgttttctattcttctttcttttgagccctttctagaaagagtaatgctctagccttcaaccagaaatgaaaagtctatcttcaaatggtttaaacttttcatatatgccttcatatatgtgtctgaggcttcggtgtgctagcctgcaaatagattctagttttcttaataaattactctttatgttcttttttaaggtaatagagcatgaacatccagtaaataagatttctttcattgcccgtgatgtgacagacaaccgggcatttggttacgtgtgtggaggagaaggccagcatcagttttttgccataaaaaccgggcaacaggtgagctctaagtcttgacatagacctggggacttgtcctctgtggacattggagtgtctgtcactcaactaaaagatttactggaaataattggatgtaagagggctaaataataattccgagaatgactatttttattggcctatggaatcttttaaaaatgtcattgatagctatgcactgctgtgtgccacaggattgtgagaatggaccttcttataaagtgaatactgacttcacaacagtggtgaattattctcaggaaccttaaaggacttcaaatatgatcatgatacctcttgttttgtctaaatacttattaaccctgctgtcttttatatacctaagggtgaggattgggttggtggtgatcccctataagccagcagagggtagtaaggcgttttaagattaaaaaaaaaatcccagtatgaattataattgatagcagacaaaggaaataaaatactaaaattaaaatacggataacagtgctttcccttactgcaggctgaaccattagttgttgatcttaaagacctttttcaagttatctataatgtaaagaaaaaggaagaagaaaagaaaaaggcaagtactacctgattaaggctctattaaatttaaaactggctgggcatggtggctcacacctataatcccagcacttcgggaggcagaggtgggtggatcacctgaggtcaggagttcgagaccagcctggccaacatggcgaaacctcatcactactaaaactacaaaaattagccaggggtggtggtgggcacctgtaatcccagctacttgggcgtctgaagcaaggagaatcacttgaacccgggaggcagaggttgcagtcagccgagatggtgccactgcactccagcctgggcgacagaacgagactctgtctcaaacaaacaaacttaaaactgtactcaggactatgtttaatattatatataaatatggtctatctgaaaatttggcttctatatgtattgtctattcttcccaatagggcaatggatacatttttatggttaggcacttctaatctgcactccctggcttttattttttttctctctatgagattcatattaattctaggaaatatacaggacaaccaagtttaaatccagtaactctactcaaaccttatattgatatgaaaaggggaggggaacggagggcagaaataatatacaagacttattcttgccttatgcctgtgaaccataggcatacttgtttgtgtatttaactccctttcactatgaatatgaagatcactgaatatgtatctttctttttagatagaggaagccagcaaagcagttgaggtaaaattgcatctttacttcttgttaatcatgtgtgtgacatgcgtaagcccctgttttctacctgcccaaccactctcgccacctcgcttattactatgtgtttatgacttctctgatcatgaaagatgtttagttaaaagatgataccaaaaccattgctgcttagcagactaatagagtggacaaatacattttatagacaaagctcaactaaatccttaaatatttgctatcttttcagaatgggagtgaggccctaatgattctagatgaccaaactaacaaactgaaatcggtatgtattaatatgtgacgtttgacagttcttacttatctgaacatgggttctacttcctgtagatgttgctgataccaaatctgtattgaatctatatgaaaatccaattgagacaactgtttttcaaaatattagtgtaacatctatgtcaatatacaaaagtagtcaaaaaaagattagaaaagtaatctttttagtagccacacctgaatctaatctaatactttttaaggatgtggacaagatagatttgctttgagacatgtctacacttcctgacctaaacagcttaatatgaaatctattagttaaatggaaattaaattgtgacagctactttcctaaactttaggaaacaaatgattacaatatacgaagtaatcttttttagtagacacatctgaatctaatccaaatacttttttaagggtgttgaccagatggatttgtttggggacatgtctacacctcctgacctaaatagtccaacagtaagtgtttgtttttaaatttgcaatgtaataaaatgacatctataactcaaattggcaataaccagaaatcttaagcatctcattgaaacttggaaggtgactgttgatttttgcaaatgaagtgtcaatggtttttagaataaatgtgaatcttaagtcaccatgggaacctatccacactaattcagttatattaatattgcttacagattaaacctgaacaataagtcagcaatgtagtccttcttggtatcacttaggattagaaggaggaggtgaataatagtccttgaataagcctacttgaagaaagtatgactgttagatggttaatcataaagcctcctggcctcttcatttcttttgcattctgtctgttgcaatttagcagcataaatttggtgtgaagtaagatttaaaacaaacaagtggctcagttatattccaccaaagcttgtccttgttagaaagctgcccattctcataggattttataccatatccagtctgctcaatattgaatgatctgtaacaaccctgtaagaacagaacagtattttcctttataaattaaaaaaaaatggtggttcagggaaaaaaaagaagaaaaaaaaataaaaaggaaagaggtccagattcaagacttaggcccaagtcttcagaccttccaaaacatacctctaatgaaaatgtccatgacattttgaatgacttcttgcaacttcttttatttatgtaacagtttcctgagcacctgctatttgcaaggcatagcagtaagatgcacaacatcaatgacatcatggaatttactctccggcagggagaccaacattaaaactaatcacatcgttagtaattgatgttactacagggtatttatctagttcagattcaggtaatgcttctgcaggagtgagtttctagatttgaacataaaagatgagaaggcaataaacagacaaaaagagaattagtctagaataatggggggaaatgtctagaaaggactctcttgtatcaggaaattatcatggaagcctatgtgaccaaggttacaggagttgaagcaatggatcaaagattggataaaattctcccttcagacttctgcagagaatttgaggcctgtgaatccttactgcataaaactttcaggtcaaatgagatggagaggagcagggacttcatgcattcttctctgaccctaaccatatgagtatcacaatgcatggtagcattctaaaatgcctttaagagagaagcctgtttaatattcattttagcagtgagccctaactcacttgcctatagaacctttcattcttcataatttttgttatagttctgaggataaactttttaaagtactagactagattatcctgacaggtccatcctaactctgaggtccttttgatttgtagtcaactttgtgctctcctccattagtgatgttttctcaaataaatcagtatctgaacacttacttcccaagtataaatgacattcaaacaagtaatattcaaagagagcaaagcactcaagatatgaagtggaattccactggaataggcaaggaagtactgcctatataatctacttctgtagacttctagaatgttctaaaaaaggaaatggaaaacaacatggataatcttcagtctcatttttattagactttatgaagtctaagaattttttatttataggaattcaagttttagttaaactaacaataaagtaataaataccatcaaaatatatactctctgataaccaaaagaaggctaacagatctaattatgtgctggttaggctttgacatgttcttatctattgactctatagtcataggtcaaaaatagatttatctctacttggtaaagccagcatgtttaaaaatattcaactctttcaacaattgctctgaaatatgtaaagagagaaagaaatctaaattacctagactttattattggtcctagatggttgtcactcccctcaaatttatacagaaaagttttatgagtttcaaataatgctcatgttgcaaactatgtggtatcccctagaacagaatttttattggcaagccccttgagcattatccttccacactgcatctcaaaaaaggaaaagaaagaaaaacataaaaacccatgttctgcaactttaacaaccacttgaaagcacagttactatggaaagaatataagacatgatctgtgatcaaggagattaaatctggtacaagggatgggatcaggatacaaagcaggagtgtcacttatgtccttgtgtacatgccataagataacacgggtgggcacagggcaagtgcagacagaaaaatcgatgctaaaagctttgtaaagaatctgaatttgagttgggtctttgaagtgtgtaggaaaatagatcatagttgggctagaaacaacgtgggtcttattgtggatcatttggaaatttggcctaaggaggtttattttaatatagggagccagcagtaagccacttaaggctttgagtagagaagtcctcagtctgacaaactggaatggttaggtgagattagccacccagagaagagctaggctatggaactcaggatttatgtccgattactggagctccctacgagcaggttctgtaacgcactgccgtgtctccagtgcgtgcggctcaggtgctcaaacagtggccaactggaggcagtgttgacagttcgacaaagaatgaatgaggcgctgaccaagtgggtggatgaggagtctttgggctctcagttgtagtctgtgaactacacttttaatcttggattaataacaaacccagcctgaggagagccttatacattttacttatagggtgactattcagaagtctaacattgtggctcctgtttggtgtcctaagaacttcttctgaagtatttgaaaacgagaactctaccagctgtgaacactcaactgttctaacccagaggtggctcaaaacaaataaataaatattgaaatcacaagcttttgtaatacattttatcctaccttttgattgtataaagatccctagattaatagctcttccaatccatttctctgattaaatttttttttaattataagctctttcttgtgacaaattcttcttttataaagagaaagcctggctttggcttataaaaactgtatttttatgcctcacagtaaaggaatccaaaagatagattaccatttaggtctgattttgctgtctcttttgtggccatgaaataggacttaaactttctaaacaattgggtatttttttttcttttaaaagccaaggagttctatttgaacccttttgtatttactagtttgcaaattttatattcccttgaagttgtttattttccccaatgatcaaaatatttagtattctgctcagggtaatgcaagataactactataacttgcacttcagcaaggcattttttatcatttatattcttctctgggtagcatagttaagtatttaatggatcaaagtcaagcagaaggaagtgatgtcagtatgaaagttctgttctaggatgagttataattctgtcttttactggaataaagacatgtcggattcatcaaatttactgcttttaagctgagaattttttatcaaacagttgaaaatccaaaaaattaacacaccagagaaatgatagagaggggatagaattagtagagctacatatttgatatgtctttcaaattaactcttaaacccatgtctctaccttgtacaatagtccccctttatctgcagtttcactttctgaaattaagtctgtggtcaaccttggtctgaaaataagtgagtacggtacaatataatattttgagagaagagagacagagagaccacattcaaataacttttattacagcatattgttataatcattctattttattacttgttaatctcttattgtgcctaattgataaattaaactttatcatgtgtatgtatatgagaaaaatactgtatataggttttggcactatgtgccatttcagacatccactgtgggccttggaacatattccctgaggataaggagggactactgtatataaattaaagatcagttgttggttgactttaaccactaaatagatgagattactgtcacaacacaggcaactctaagcaatgttatgaaaagatgtacaaataggagatcttaatgtgtgattgactaaattagatcagtattgagtgtctctttcagaggacatagacaaaaagggtaagcccagaggagagactgggatgatgaggatgagatcctacttgactatcagcttcagcaagagccttaaatattaagagacatacctgaaggccgtgatataaaagaaaagcctctctcccacctctagaggaaagaactggaccgattttagggaaatgcatttgatcttaaatttcatcacagccagaactataaaatatgaatgtattagtcgatgaattttctcatttagagagatgatcctacatgactctgggggtacaatagagaggactgtatgtgtataggtaggaagctgagctaagcttctgaaatcacttactttcaagctcaacatactttgataatcatttatagtgactcacaatcaattccctttaagactttcaaagtcacaaattgaaacaatgctcataatgaattaagccagtctgtatgtgtgaaccagggtgagcagagacatgaagtaagcaacagtaagatttcacctaatgaggttgagacttaaataaaagggcatgatattggggaggaatagaaaggacctagtctatagctagggagtaatggactacgggggttgatggaaggaggtaatgatcaaccgatttatcaagaccaaattcaaatggaaattctgataatcctagtcatcttatgtaattttctcatttgaagtcacaacatggactaacactttctttttttttctttccaaatgtgataggaaagcaaagatatcctgttagtggatctaaactctgaaatcgacaccaatcagaattctttaagagaaaatccattcttaacaaacggcatcacctcctgttctcttcctcgaccaacgcctcaggcatccttcttgcctgaaaatgccttttctgccaatctcaacttctttcccacccctaatcctgatcctttccgtgacgatcctttcacacagccagaccaatcgacaccttcttcgtttgattctctcaaatctccagatcagaagaaagagaattcgagtagctcgtctactccgctgagtaatgggcccctgaatggtgatgttgactactttggtcagcaatttgaccagatctctaaccggactggcaaacaggaagctcaggcaggcccatggcccttttcaagttcgcaaacccagccagcagtgagaactcaaaatggggtatctgaaagagaacagaacggcttctctgtcaaatcctccccgaacccttttgtgggaagccctcccaaaggactgtccatacagaatggcgtaaagcaggacttggaaagctctgtccagtcctcaccacatgactccatagccattatcccacctccacaaagtaccaaaccaggaagaggcagaaggactgctaaggtgaattgtcttctccacatatccattagcagagtgcatgttcggtaccaaagggtggtgtgatgcaagctctctttcctgctgctctcgtagtttcctgtgttgctgtgaaatagaaggtgggataaggcactttggttctccaggagtactttcctctaactgccaccgtttttaagcttctcagcagtgtttttcacaccctgctttccgtgtgcatgtcttgtcacttatgattaaactaaacacaagtttttccatttttaatgctgctatgcttctatacctctggtaagtttgatcatcgtgttctgggttgggagggtgagagttcttgtgattccctttgtacttccctgacactaacacatgccctgcacacccatcatgttgcatcagtgtccatggtggtggtataaaattctcgagcttatctcctcttttaaatactgagtaaatacataagctttttctaagcttatgtatttactattaccactatgatctcagctttatttaagagcaatttaaaatgcagttcccataggtgtctttttttacctctcctaagaatatacaggcttgcctggattaagaccctatgatctctatgtagactgacttaaaatccaatggaatgaacaaaaatatttaggatgcttattggtagttgccccttttacacacttgctcccccaacttcaagcatttagcgatgagaccagaccaatgtgagtgtgtaaaggaatatagtagatttcactttgcaagtcctaggtagtgtcagacactaagactcagtagtccgtccgttgtaggaatctgtgtctttttttggaggactctttttctgtagtagtagttgttgttgttcatctgtcaagaaaaaagttttcctttttgtggctctcaaattggggtatagggtaggagacaaaatgaggctgtatttcactgttagtgagtaactaaggcttctccctccctccctgtcctgtcagtcttcagccaatgacttgcttgcatcagacatctttgctcctcccgtctcagaaccttcaggccaggcgtcacccacaggacaacctacagccctgcagcccaaccctctggatctcttcaaaacaagtgctcctgccccagtggggcccctggtgggtctaggtaggtgcctagagataaaattaagtatgactcttttgcttttgctcataaaatgatgatgcatcggaagagatttcatactcccagagggttttacagcataagatttgagcatcccagggagcccttctcccacttctactatacaaccccacatccatttgatattcttgacttgtaactcacatttggctcctcgaggcagcatgagacaagaaattcattttcagtattgtacttacttgaaccaactggtcatggtttcctgaaagacaattgtaagggattctaaactcagaccagcttcagtagcaaaacagggttgacataagagaggcttgtctgtcaacatgcatgtcttccatgtcttttgccataatagatcgaaggcctatgtcctttcaacacatagccctcttagaaggaatatatgcccaagaaggatgtaagttaagtctgaagcaagaataagtcatagagtgaaagtcctaggttctgggcccagctgtgttcctaggtgtatggtaagggtagatcaggcacacatcctgatcagtctctgagcacttctgccataggagctccttgccaatattttggctagcttgagtgttttactgaagctagaacataagtcctagaaagccaaagttgaaaaaagagagaaataagggaagagatggaattttatcagacagctagtatgcattgacgctcttaattcctaaatgtgtcattagcttgtgtgagccgctgatcactctgtggtaggacagtgggaaagtccacttgactgagggctggccttgctattcttagtccatagcctatagttcttttcagactccatggtacagttttcagaaaccctgacaatagtttttgctgtcctgctatggactctatttttcttctcttggcacctctacaaactccaaatggactctggcttgggaggtggaggactgtagacgaggaaggactctcctctccttcggtaaaatctgaccagggatcctggctttctctgcctcctgcagtcagtcatcaggatccttgttttgttttcctctctgtctctgttgttttcctacaaaggaaaatagtttggttcttttacaagaaatctgtttaatcatatctagaatagggtggccagaggaggactgttactcaactgctgagtggcagaaatccgtgagggtatgaaaagccagcttgtcccaggtctctgctcgcatttaccccatcaagaggctctctctaaagacttcatgtctcttgggggcttccccctttctgcgttgctcttttccttgcacccccaagtggagctggttggtacccttccctcacagaagaccagagtgcttgcaatgcaatgtctgcagcgagatcacatcacagagctttttatctgatatcaatgcccttaagaatttttgcagccaatatttaacaagtcagcctgaaaatacagctggaccctataactgtttatttattcagacgaagtgaagctttttggctaggtgcccctgttgagggcttggggtatacaactgcagaatactgatgattgttccaagtttggacatgggactcaaactgagctctacagtatagtccctgtccactagcagggatcctcagccaaaccatggaaggttgtaggtctggcttccgctagacccagctgggggactgtctcccctggagaactgggggggtggggagagggtattgtagaaagctgagccctcagattcaacttgcttgtattttaatctagcctcagaaggtaataaaattaatgttctatacccatgtcccctttttccttattccttgcccctactttgtcaatgtgttcaatgtgttcaatgtgttaaaacacaatgtggggatttggtgggtaggaatgaagactggtataagtatatactgggaaagccttgaattcctggcaaatgtaatatttttctctcctttttttttttttttttttttgagacagagtctcactctgtcacccaggctggagtgcagtggtgctgtctcagctcactgcaacctctgcctcccaagtttaagtgcctcagcctctctagtagctgggattacaggcatgcgccaccacacccagctaatttttgtatgttagtagagacagggtttcgccacgttggccaggttggttctgaactcctggcctcaagtggtcctcccactttggcttcccaaagtgctgggattacaggtgtaagccactgcgcccagccctaatatttttctcttttacaaataccattctcactaatatgatattttcctaaatgaagacaagttgtccaacatgaaagatgataaaattctaccctcctttttgcacagctaactggtggaaattattagcaagtgatctggcttctgttaatacaatttaattgaatgtgttttaaaatacaagcaacaactttgttcaaactaaacccatttttagagcctgtattgtagaatataacttttctcttgatttgttatgaaaggagtatattcttcagtgaaaatgaagtctaatttctgtatccgtgaaataagtatttgaattaacatagcatttgaaaattaaaattgccccatgccttgctgccaaggaagcagaacaggagaatggggtgccggatttagagccagtgtgcctgattttcagtttctaccatcccagactatgaccttcccaattttaatgaatattcttgcacccagtttcctcacctccaaaaagcatgctgattaagtgaaatggcctgttctgaaacccaccactctctgtgagtacaccatgtgtgcccatggccagatggccagcatgcatgatgagaatggagtcaggtaataccaatgtctcagactaagaagctcgaagatataatcttgtgctccatcactcctaaataccattttcaaagtattccctcttggaaacataaacgtccctaacccaggtctgaagaaaactttcataactaaagaatgccatgcaccaaagctcaaagcaagtagatttcaagagcgaagcatcacccactaatagatatgaggctgaatttaggtttccttcttagcggtgagtttaactgaatcattaatgcacttggaaagaggcaggaaagacagtgccctgtatattagaacaagatgcagggagcgagcctctcaagaatcagaggccatcattggagaggcctggattctggcgatttaacgaattcctgatgacatagcaaggtcgtaggagatggagccattcaccacaaagatcagatgccccaacacaggccattagttaccttgaaagatttttgtttcccattgtcctctctcctcttttaaattctctgttctaacttctggcaaggtttagcaaatggcacatggcaggaagcacttttatttgaaacagtcttcctaggataacatcctttcttccatttttatatataaacgtctaaaactatcttggcattggccaaactttatcttccctttatgtatatagctgtatcagtcttggcagcaataaaaagtgaagaaactttgaaatggtttcttcaggatgcaagcatgttgaggtcttgtgcacatgtgtgattgctggtttccataagactccagacgtgagccagttgccaaatgaaaagatcaaatctgtgactcagagagtccaatggattatcttaattaactacatcataatcagcatggttcatgcataaaaatatattcacttaaataagttcctgctattaacaggctctgttctagttgtttgagatgtatcagacaactagtgtctgtatgataagggcttatttttttgatgagtagatacttatggaccgtactacccttctaatcaggaaagttaaaaagacatggtaggaagaacatgggcctcaaaatgcaaccagcatttgaatgctcactatacagtgttagctggctaacttttacagtgattaatctgtcatattcttcccatatcagcctcagggctcaatggaggtgttagctgtggagaggctttccagagagttgtgctctctgaaattcaagaatcttcttcaagcttgactcctgataagtatttttcttcctcttacttcaggtggtgtaactgtcacactccctcaggcaggaccatggaacacagcatctttggtcttcaatcagtccccttcaatggctccgggagccatgatgggtggtcaaccttcaggttttagtcagcccgtcatttttggtacaagtccagctgtttcaggttggaaccagccttcaccctttgcagcctcaactccccctccagtgcctgttgtctggggcccttctgcatctgtggcacccaatgcttggtcaacaacaagccctttggggaatccttttcagagcaatatttttccagctcctgctgtgtccactcagcccccatccatgcactcctctctcctggtcactcctcctcagccacctcccagagctggccctcccaaggacatctccagtgatgccttcactgccttagacccacttggggataaagagatcaaggatgtgaaagaaatgtttaaggatttccaactgcggcagccacctgctgtgcccgcgcggaagggagagcagacttcttctgggactttgagtgcctttgccagttatttcaacagcaaggttggcattcctcaggagaatgcagaccatgatgactttgatgctaatcaactattgaacaagatcaatggtaagccactcaccactctgcctactgttccaacaactatctccactgccacatggacctaaatgagttccccaaatgaaccctctcccacccgccaacagctttgctcttgcttctgttggtaatcaagggttacggagacaacttaaccatttaccttttggtgataactatttaccttagtcatttctgaggactgacccaatgctgccctctagtgataaatcttaaaagggctgccatgagctattgaaatgtgatgactggtgactcttggagggctgtgtaataaggcgtcatccatgtcccatcagcttaaaatgaggggattctgaatctcttccacttcagataaatatgcatggctttctcttccgagaaggataataattattggggtacctagtatttggtgttgatttttgttccactgatgtaaatttcaaaagtatagaactaaacttcaaaaataagctgactcggggactggcctatatttgggaaaagcttgtctactgattgcctggattttttaccttctagaaccaccaaagccagctcccagacaagtttccctgccagttaccaaatctactgacaatgcatttgagaaccctttctttaaagattcttttggttcatcacaagcctctgtaagtatgaactactagaagctcttctccaaagtacatgccacatagagctccagcctcctgaattaaccttgcttttataatagcttttatttatttatttatttttttaagacagagtcttgctctgtcggccaggctggagtgcagtggtgcaatctcagctcactgcaacctccacttcctgagttcaaaggattctcctgcctcagcctcctgagtaggtgggactataggcacgtgccaccacacctggctaatttttgtatttttttgtagagatggggtctcgccatgttggccagactggtctcaaactcctgaccttaagtgatccatctgccttggcctccctcagtgctgggattacagtcatgagccaccgcacctggctataatagctttttgatggtaaaacatgtttagctaagatttgtcaccaagaaccttcacagtataaacattcatttaaactggagaaagattatttgcacaagaactattatcttctgaatttgagaaataatatcacatagaaaacatccttcatatctcacttaacctgacccatgaaagcatttcgggagaaaattgagccaaaatactgtcttgaaaacctttcaaaaatttaagttcttaattttccaacaatatttctatagcctgtgaaaataatacttcccatttcggggaggcaaatgaaatgcatctgaaccttgattttcacataaataatatacactgccatctgcaagcagatgaaaacaaaacactgtaagccccatataatgtttgattggctgattggcctatgacctaagcgatttttaaaagaattttggaagtcttcattgcgatttttttcttatgactgtaactgtatttattgactagatgattttatcttcttaggtggcttcttctcaacctgtatcttctgagatgtatagggatccatttggaaatccttttgcctaaattctgtaagtagaagatcctaataagcctgtctcaggggtttttgtgagaaagggtgacatggaataaagagtgaaattttaattttagaattgggaagagggtaaatatctataatttaggagtaatcgacaggaaaatctctactgagatcattcaataatgactaggctgggcacttaagaatagaattcctaaacacatcaaaaaatagtaatatacccttggggatgtggatttttatcttattccatgttcttggtttttcagttctgtgtgggaagtaaaactcaaaacaacacatcacaggtttctaacctttttactttcatattgaagtggttgcaaaacaacctagtaataatttggtttcctataaagggttcagattccattgactttctgaagccaccaagtcagcaaaacagattatgatcattacttctctaccatttaactgtgagcaatctcaaagttagtctgaaagagtctgatggtattaaatctgaaagttttaacaactattaaagatctccttcataggcagtaggagctcaaaatgagtctgaaggttgattcttctgtctcatgaactttatcttagataagtgattaggtagaatcaccctcagctgaaatcctgggagggctcagtgtaactctttctctacagaaggtgacagcaactttattctgatctcaaaagactgaatttagtagggaaaggaacgctctccccattttagagcaggtaggccagctggtaggggtagaacaatagaaataatgaaaaacaacaacaacaacaacaaaaaccaagcccattttttttccaatcttgtctcatccaaacaggactactaaactgtgatttggctcatctagaatgtaattatttttaatagatagatatcttaaacgtggcgaaaacaataagattgagcttataggcatctggatcattttccctcaactccagttctacaatgactgtgtttcctgtagtacctttccataaactgcttcagagaactgggtaaatcattaaaaatgcaaattcctgggtcctactgcagccctaaggaatttctctttggtgccaaggaaatgcttccttttaacaagagtgcaggtgattctaaaggtaataaagcagtaagtagatatttaagagctagaagtcttaccagagatcattctcaccttccattcaaggggagatatacccaaaccaatagaaggagtaaactacactcagagtcaagatggattgtatggactaaattgaatgaactagacttctctttggaggtccttccttctttaggtcatgaaggaaggatagtttaggtcaacctgctacatcaatagattgggtaaggggaactctcatgggataaaataactaacattgttgagcacttgcgctaagcattttattagatgctctacatttatcatcttcatcaatcctcacatcagccctaggagatactattactgacatctttaataatgacttgatatttaatacattgatattcagttcaaaaattctaaccacaagtttctttcttctccatacctctctaggaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaatgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaatatca

SEQ ID NO: 11724 - DNA, 424 bp, Homo sapiens
agcaggttccaggggaattgaaagtaagccacagatgagctagagaaggctgctgataagaatatgttgcacaaattatctggcttatccaggtgctctgccgtgcgtctaacccgttgagcctgtgtgttatctccacgtgacttaatctgtgagatcttgccacaggttaacttgctcgtgtgtacaagaggcggacattcctttcagtgcagtcggaactactgttgatcaagcagagagtggcagttactgaagtgtccctgcaaagtggaaacacacctgttccttatacagttggctctcctaacctcagatttcgcatctgcagattcaaccagccacagatggaaaatatgtgaatagaaaataaaataaaaataatgcagcaattaaaataatacaaataaaaacaatacagtat

SEQ ID NO: 11725 - DNA, 348 bp, Homo sapiens
gagattactgtcacaacacaggcaactctaagcaatgttatgaaaagatgtacaaataggagatcttaatgtgtgattgactaaattagatcagtattgagtgtctctttcagaggacatagacaaaaagggtaagcccagaggagagactgggatgatgaggttgagatcctacttgactatcagcttcagcaagagccttaaatattaagagacatacctgaaggccgtgatataaaagaaaagcctctctcccacctctagaggaaagaactggaccgattttagggaaatgcatttgatcttaaatttcatcacagccagaactataaaatatgaatgtattag

SEQ ID NO: 11726 - DNA, 424 bp, Homo sapiens; identical to SEQ ID NO: 11724

SEQ ID NO: 11727 - DNA, 1010 bp, Homo sapiens
attcaaaatgcatggcccagctgctcctcatattgaagttgcgaccatgggatttggcaacattgagctccggctctgggcattgctctcacagctgagagtgacgcccaggctctggcagcccagacttgtcatcctgtaaatgaacaatccccagtccccgggcctcattttattcacttggctgagctgcctgtttgctttccgttctgtgctcgccagctcactaagcaagaggatccgtgcctgactgcgtggagaagctgtagaggaaatggccaccctgactgtcccagcacctcccggggtggcccggggcctgggccctgagcagaactgtgataaagggaagcagggaagcagtgcgagagccctgaccaggtgcaggagcctgattccgaatccacctctgccatgggcagattgcatgatgccatcagagccctctaacctctggccttcagttgtcacacctgtaaaatggggaaatattctaaagaagtggctcaaaacctgatcatccatcagcctccccccaagaacatggggacagtgcacatggcaaggccccatgcccagagtttctgattccacagtttgggatgaagcctaagaatgcgcatttccaacaaggcttctggtgaggctgatggcccagggacctcactttgggaagctctgtagtaaatccagtttctcagccagtctgctctgtagagctcctgagacagactctttccctaggcctcccctgaggttcttacttaagcaagtctccatttttcaaaagctctgccaggtaactctatatggcactagggctgagaggcactgggtggatgtttctaagatcccacgtagctctcacatgccaggatgccatgattttgaagcagagtgcctcctgccttgccaaggctgacagcacacacagggcaaaaggccatcgtcacatattggaatttcactctttgaaaacctggtaatcgtgtgtcccatttcagctcgag

SEQ ID NO: 11728 - DNA, 563 bp, Homo sapiens
acaagagacttatttgggctaatcagcctaaagaggatgatgcatataatatgcataggagagatctctctgtctgtgtctgtctctgtctctgtccctctctctccctttctctttgcaaaacacgcattcactgttgccgtgaactgccacagatagctccatagtgaaactgaggctgaaaagggtagagtaggggcacaaagtgagccgtggctcttcatggcatcactcagactcagctgccttgagccagctccacccccgactcccaggtattcaacataataaatttggtggtgttgttttgttttgttttgtttttgtttttgtttgcttttttttgagatgtagtctcactctgtagcccaagctggagtgcagtggcatgattcggctcactgcaaccttcacctcccaggttcaagcgattctcctgcctcagcctcctgagtagctgggactacaggtgcatgctaccacgcccagctaatttttgtgcttttagtggagacacggtttcaccatgttggccaggctggtctccaactcctgggctcgag

SEQ ID NO: 11729 - DNA, 563 bp, Homo sapiens
acaagagacttatttgggctaatcagcctaaagaggatgatgcatataatatgcataggagagatctctctgtctgtgtctgtctctgtctctgtccctctctctccctttctctttgcaaaacacgcattcactgttgccgtgaactgccacagatagctccatagtgaaactgaggctgaaaagggtagagtaggggcacaaagtgagccgtggctcttcatggcatcactcagactcagctgccttgagccagctccacccccgactcccaggtattcaacataataaatttggtggtgttgttttgttttgttttgtttttgtttttgtttgtttttttttgagatgtagtctcactctgtagcccaagctggagtgcagtggcatgattcggctcactgcaaccttcacctcccaggttcaagcgattctcctgcctcagcctcctgagtagctgggactacaggtgcatgctaccacgcccagctaatttttgtgcttttagtggagacacagtttcaccatgttggccaggctggtctccaactcctgggctcgag

SEQ ID NO: 11730 - DNA, 1613 bp, Homo sapiens
acaacaccaacatatctgcagcccatagtgcaaatgtccatgtatgtcagattaaatgttacttattatttaggtctgttttttaaattaaagtttgcacttgctttgcagccagccaggcagggagtcattacctagctctttcacttactcatgtgccaatgtgaatgtgttacttcacttctcctgcctcttgtctacagtgggcaggaggtaagcctcacggtgtgactgtgaagccaagtgaaatctcacacctacctcagaggcctttttcccactctccttttctgactcttttaatattttctcaattatttatagtaataataataatacaatgccaattgttcattcattcatccatttaaatcccaaaggaatttaaaagaagagtaacatttaacctgacaaagacaaaaggaggaagctttttaggtaatattaattataataaagtaacaataataacaacaataataatagcaagctcatataagcaagaagcaatagtcagtgtgtcatgttttgggggaattaagaatttcaaatagttcattttaacaccacctttctcattccttattctcctaccccactggcctgatcacttctagaaacttccagattctttacctcttcatgacatttataattgctgttctttttttggaggtacaatatacatataaaatttaccatctttatcatttttaggtgtacagttcagtggtaatatatctaaatttatattctttatttttctgttctttatgtctaggacatttcaatcctcaacacttcacattgctaaatcctcatctctcaagcctcagcttaaatattaccttttcagagagaccttcacagatgatgtaatataaatcactctcccctaccattattctcaaagacagaaatctattttctttattttactaatcacaggctgaacttattttgctgactttattatctgtctctcctacttgacagtaagttcaacgagggccaggacaaagtctgtagccccagcagttagttagcctggtttccatacatatcatttactcaatagctatttattaactggataaatggaaatgaatgcaagtgataggatagatacagaagagattagataactaaaccaaggtcaggaaatgccatgctaaacgtttgcactaaatctttaaaactctggaaaaatcctgaaggatctcagtggacaaatgcctccaatacgtttctattaaggaaaatcactctcataagaatgtaggggaattgactggaatgagagaactgagggagggagatccattaagggtctgactgcagtaattcagatgagaaatactgcaaaagcttaggctaagttagtggctataaagatggaataaatagagtcaagggttattacaattgaacagaatgtggtgtctgactagaaataaaaagacaatctagagaagtccaaaatgacttatagatttctgacctgggcaagtgaatagattagaaaacaagatttgtagggaaagatgaaaaacagttattggatattttgaatttgatgcaattattggatatgtttcagtctggagctcgag

SEQ ID NO: 11731 - DNA, 1616 bp, Homo sapiens
acaacaccaacatatctgcagcccatagtgcaaatgtccatgtatgtcagattaaatgttacttattatttaggtctgttttttaaattaaagtttgcacttgctttgcagccagccaggcagggagtcattacctagctctttcacttactcatgtgccaatgtgaatgtgttacttcacttctcctgcctcttgtctacagtgggcaggaggtaagcctcacggtgtgactgtgaagccaagtgaaatctcacacctacctcagaggcctttttcccactctccttttctgactcttttaatattttctcaattatttatagtaataataataataatacaatgccaattgttcattcattcatccatttaaatcccaaaggaatttaaaagaagagtaacatttaacctgacaaagacaaaaggaggaagctttttaggtaatattaattataataaagtaacaataataacaacaataataatagcaagctcatataagcaagaagcaatagtcagtgtgtcatgttttgggggaattaagaatttcaaatagttcattttaacaccacctttctcattccttattctcctaccccactggcctgatcacttctagaaacttccagattctttacctcttcatgacatttataattgctgttctttttttggaggtacaatatacatataaaatttaccatctttatcatttttaggtgtacagttcagtggtaatatatctaaatttatattctttatttttctgttctttatgtctaggacatttcaatcctcaacacttcacattgctaaatcctcatctctcaagcctcagcttaaatattaccttttcagagagaccttcacagatgatgtaatataaatcactctcccctaccattattctcaacgacagaaatctattttctttattttactaatcacaggctgaacttattttgctgactttattatctgtctctcctacttgacagtaagttcaacgagggccaggacaaagtctgtagccccagcagttagttagcctggtttccatacatatcatttactcaatagctatttattaactggataaatggaaatgaatgcaagtgataggatagatacagaagagattagataactaaaccaaggtcaggaaatgccatgctaaacgtttgcactaaatctttaaaactctggaaaaatcctgaaggatctcagtggacaaatgcctccaatacgtttctattaaggaaaatcactctcataagaatgtaggggaattgactggaatgagagaactgagggagggagatccattaagggtctgactgcagtaattcagatgagaaatactgcaaaagcttaggctaagttagtggctataaagatggaataaatagagtcaagggttattacaattgaacagaatgtggtgtctgactagaaataaaaagacaatctagagaagtccaaaatgacttatagatttctgacctgggcaagtgaatagattagaaaacaagatttgtagggaaagatgaaaaacagttattggatattttgaatttgatgcaattattggatatgtttcagtctggagctcgag

SEQ ID NO: 11732 - DNA, 946 bp, Homo sapiens
gtgtattttgataactcagtttcccaccttttttctccaatcagagtcgcggcgaggagctttattaatatgctgcaatttcaaatgacctacaaattcttagaagtgtaaagaactaaaaatatgtaaccaactaaaattgggttgtgggaggctgcagaaagcagagagagactaattcaccattgctcaaaataaagtgtcaatactgtctaaagaatgtactctccaaacttcacatcaaacttttttgggatgcagtgcgatgtggtacagagagtaacaggttttggagtcagatggctctgaattggttgacactcttactaacttggacattcgaaagttatgtagtcacttattttcctcatctgtagagaaaggctacactggtgaaatgagatcatgaagctaaaatgcccaaaggtaggcctggggcacagttggttatcattaataatagttattatcagttgtagatacttaggaggactaaaataaatatggaacccaatatcctagtagatgagtaagagagggttcgcagacctcgtgggtgtgaacgtagggagtgttgtatggagtcagaccaaccaaacaaagggagttggcatttgcggtcactcagattttatgcagccaggttactgctggctctggatggttgacacacagtgtgatgtttcactgcatttgtatcaagataatggcgcaaccatccccccaaaatccagcattattcataatcgcatctttcatcatcaatttggggaaagtctttggtacacagtcaattcctggggatgcaaatgatgatttcttccttttttttttgagacggagttttgctcttgttgcccaggctggagtgcagtggcactatatcggctccccacaacctccgcctctggggttcaagcgattctcctgcctcagtctctcgagt

SEQ ID NO: 11733 - DNA, 164 bp, Homo sapiens
ggcctatttcttccatttttaagtattcacatctcttttttttttttttgtgatggtgtctcgctctatcacccaagctggagtgtggtggtgagatcttggctcactgcaacctctgcctcccagttcactctattctcctgcctcagcctcctgagtagctg

SEQ ID NO: 11734 - DNA, 1115 bp, Homo sapiens
cttgccttggcctcccaggcatgagccaccatgcccagctgttttctctgttttatcctggaatctccatgggcctcagcttagcaattgtgagggtgggtatgcaggaggtggggtgtgaggaggggctggcaagcaacctttagaagcaggtctgaagggacttgtcaggggttccccaggtaggaaataggggtcacctgtgcccccagcccacctgccattgaggtgctagcccccagaggctgttatctttgtatagatgctgggggcatcaggacagcctgaaacactgtttccaggagtacagcatagaaaataagtctttccatccaaattggaaatgaaaaggccctggtacttgacagatctactccagtgacttggaacactgtgtgggagacttgtccttggcagcagtagaaatggggcggctgtgaactttctctctgtatccccaggcacatgtgtgcagacttgtcaggccctgtggtccaatcggatgtagtacctggctcttatccgggcatttggtaactcgagtaaaatggacttttcctcttctgctgcttgtgtttctacctttggggccatatcatttgtggcatcgtgccctctaggacctatagcttttgggagtgttggtagacacctattctactagcagagttttttcccccaaggcaggtgttttgatgagggcttgggtcacagcctcgggactcatggctgctctgtatcttccatcctgctggcctggaccacacggttccatgactttgccagattccttggcaggtttcattaagagagatgcacaggccggacgtggttgctcacacctgtaatcccagcactttgggaggctgaagcaatcagatctcttgagctcaggagttcgagaccagcctgggcaacatggcaaaaccccatctctacaaaaaatacaaaaattagcccacgtggtggcacacacccgtggtcccagctacttgggaggctgaggtaggggttgagccctaggggttgaggctgcaggaagccatgatagtgcccctgcacacttcagcctgggtgacagagcaagaccctgtctcaaaaaaaaaaaaaaaaaa

SEQ ID NO: 11735 - DNA, 1114 bp, Homo sapiens
  misc_feature (1114)..(1114): n equals a,t,g, or c
cttgccttggcctcccaggcatgagccaccatgcccagctgttttctctgttttatcctggaatctccatgggcctcagcttagcaattgtgagggtgggtatgcaggaggtggggtgtgaggaggggctggcaagcaacctttagaagcaggtctgaagggacttgtcaggggttccccaggtaggaaataggggtcacctgtgcccccagcccacctgccattgaggtgctagcccccagaggctgttatctttgtatagatgctgggggcatcaggacagcctgaaacactgtttccaggagtacagcatagaaaataagtctttccatccaaattggaaatgaaaaggccctggtacttgacagatctactccagtgacttggaacactgtgtgggagacttgtccttggcagcagtagaaatggggcggctctgaactttctctctgtaaccccaggcacatgtgtgcagacttgccaggccctgtgggccaagcggatgtaggacctggctcttatccgggcatttggtaactcgaggaaaatggacttttcctcttctgctgcttttgtttttacctttggggccttatcatttgtggcatctgccctctaggacctatagcttttgggactgctggtagacacctattctactagcagagttttttcccccaaggcaggtgttttgatgagggcttgggtcacagcctcgggactcatggctgctctgtatcttccatcctgctggcctggaccacacggttccatgactttgccagattccttggcaggtttcattaagagagatgcacaggccggacgtggttgctcacacctgtaatcccagcactttgggaggctgaagcaatcagatctcttgagctcaggagttcgagaccagcctgggcaacatggcaaaaccccatctctacaaaaatacaaaaattagcccacgtggtggcacacacccgtggtcccagctacttgggaggctgaggtagggggttgagccctaggggttgaggctgcaggaagccatgatagtgcccctgcacacttcagcctgggtgacagagcaagaccctgtctcaaaaaaaaaaaaaaaaan

SEQ ID NO: 11736 - DNA, 1115 bp, Homo sapiens
cttgccttggcctcccaggcatgagccaccatgcccagctgttttctctgttttatcctggaatctccatgggcctcagcttagcaattgtgagggtgggtatgcaggaggtggggtgtgaggaggggctggcaagcaacctttagaagcaggtctgaagggacttgtcaggggttccccaggtaggaaataggggtcacctgtgcccccagcccacctgccattgaggtgctagcccccagaggcctgttatctttgtatagatgctgggggcatcaggacagcctgaaacactgtttccaggagtacagcatagaaaataagtctttccatccaaattggaaatgaaaaggccctggtacttgacagatctactccagtgacttggaacactgtgtgggagacttgtccttggcagcagtagaaatggggcggctctgaactttctctctgtaaccccaggcacatgtgtgcagacttgccaggccctgtgggccaagcggatgtaggacctggctcttatccgggcatttggtaactcgaggaaaatggacttttcctcttctgctgcttttgtttttacctttggggccttatcatttgtggcatctgccctctaggacctatagcttttgggactgctggtagacacctattctactagcagagttttttcccccaaggcaggtgttttgatgagggcttgggtcacagcctcgggactcatggctgctctgtatcttccatcctgctggcctggaccacacggttccatgactttgccagattccttggcaggtttcattaagagagatgcacaggccggacgtggttgctcacacctgtaatcccagcactttgggaggctgaagcaatcagatctcttgagctcaggagttcgagaccagcctgggcaacatggcaaaaccccatctctacaaaaaatacaaaaattagcccacgtggtggcacacacccgtggtcccagctacttgggaggctgaggtaggggttgagccctaggggttgaggctgcaggaagccatgatagtgcccctgcacacttcagcctgggtgacagagcaagaccctgtctcaaaaaaaaaaaaaaaaaa

SEQ ID NO: 11737 - DNA, 499 bp, Homo sapiens
cacacatgtgcatttgcagaaatgcacccttgcacttgtgtgacacacctgcacacttgcatacacccatttgcatacaggcacagacacactcgcatacatttgcacacacagccacaaacttgcacaagcagcacttgtacactgacacatatccgtttgtgcctatacagtgcacacttacacatttgcacacagctgtgcttgctcacacatttgcacacacccacctacacacttgcacacatactacacacttgagcgtgcagcacacatacctatgtgcatacatgcacatttgcacatgcacacagcagtggcacacacttctctatcactctccctagtcactgttctcccctgtgattcccacccctctgaccgcccctgctcacttgctgccccctccactggaaggggcctggcctggtgccctgtctctgtctgtctccaccgtgcagggaggtttcacaaggactggctgatgtctcgcctcgag

SEQ ID NO: 11738 - DNA, 970 bp, Homo sapiens
gaaactgaggctcaaagagccacagcgggacggaggaggtggacccggctctgatgcaggtggctggttcgatggcagactcccctgtgccgagactcccagaccaaatccggaggtcctggagtagagtgggtgggtccgccagggcatggccaggctgcctgtctctggagactcccccaaggaagtttcttgaccttgaggatgataacgcagggcaggctcttgagggctgtgcagggactccctggagagccctgggaaaagcaggtccccgcctgcctgggcctctgcctctgctgcaggggccagcacaggtgtcaggtccccacacatttcatgtccaggccattttcccactctagggccaaggctgggcacttcccagtcagtggcacagctggtactgtggggtctctcgctctgcaaaggttggtttcaatcccaagtgtcactgctggaaacactggccaccccgggacatgtggtcttgccagtccttctgcagggctctgtttcttaggtcccaatcatctgcagggagcactagtccgagatcttccaagatgctgggcaggaacaagcctgctatgctcattcccaaaggactccacatctagataaatgaaggcctggaaggctctttggctctacactagcaaaacagcttacgtcaccctgcctaaagagacagtcaggaaatccccttgttcctgggcgaggagaagctggcccacacggagtgacggcattgagcagatactacccttggctcgctcatggatggggcggggcctgctgaccttgacagcaatcaggggagggggtttggagggaaggggttagctggtgaaggtgagggaaaggactggagttaggacagggtgcagcgaccacatcctgtgacgaggaggcatctgtgacctgtgtgatctgccaggcaggcagcacaagtcattgtactgctact

SEQ ID NO: 11739 - DNA, 585 bp, Homo sapiens
cctcattttctctccttttcatgctaactttcccactattaaagagcatttttaaaaagaagatgaaaaaaggcagagagaaaagaaggatgaaagtgtgagcgggtatccggaagtccttttcaattgcctgctgctgtgcagggtctgaactaagagcaagaaattggaggatgctggaggggcgaggtttcgtttcagtcctgcctattgggccaagtctggggcggggaaggagaggtgatggaggtgggcctggctgggccctgcggccctggaggctgcccctctgcctgccacccagcccctggcctgtgcctggcacaggaagcccgtcaataatttcttgttgaatgaatgaaagaaaagaaatcagtggatggagaagggctggattcttttgtggggaccttccacgccaccttctctgtggggctctagggctgagaaagaaaggacagatttggcaaaggtcaggcaggggctgggaaagcattaggtggaccaggcatgctacagcaaggccacgcctgcactgttgtcccactggtgacacccatgggtgcagccatggcgggtgggcgc

SEQ ID NO: 11740 - DNA, 2695 bp, Homo sapiens
gaatgtatgtgtccctccaaaattcatctgttgaaacctaagacccaatgtgacagttttaagatgtgggaccttttgggaagtgataagtcccgatggctctgcccacatgaatgtattagtgagtgcccttgtaacagggctggagagtactatctacgtaggccctctttgccttttttttttttttttcctttctctcgaggtcaccatgtgaggactcagtgttgtggagccactagaagctgaaaggggcagggaaggaaatctcccctagagcttttggggattacggccctgccaacaccttgagttctgacatctgggctctggaactgtgggagaatcaatttgtcttcagccccgcagtttgtggcaatttgttacagcagctgtaggaaatgaacacaccagccacctagaaaaccaccagttcagatgggtgggtcagattccaactccacctgaagggataattctagttttctccctcctcatattttcaactccgttttctgacaagaaacctggcttctgtgatgcttaatagattgacttctttggtcagtcccccatatgacagcgacctccctgctcctctgccacccttggccctgagggggctccctcccgacctccccactggactcagggcagtgtcctgctctgggcacacacccatatcctctgtctcacctaatggctagacacacattactcggaggggaagggaaggagaagggtagaggaagaccagccctggtttatgcccacccttgctggagcatctcgactctcggtgcactgccctgctcccctgggaggtgctgggtgcccaccgtgccaggctggaatgcgggtgcccctgcaggaggctgagcctgtatgtgatcacacagtgcaggggtcaggcttcgatgtaagagtggcaggagtgcgtgtcaccgtcttaccctcccctcctcagagcgtcccgacgcacctgcaaaacccagtgtatctttctacacatgtggtgtcattggccaggccagggcttggctcctgggagtggtgctgcaggcaaactggggagaattgagatcctttatttcagttaggataaggcatgcatttaaatgtcagaggcatttcctggtggcataatggatatttatcccctattagatagggagcaatctgcactgaagaagccttcagattaaatttcagggatgaaccaagattcatcctgacaggtatatagatcctcaaagaataagtcctcataaaatagcctaaaaatgttccttatggcagttcgatactttgtaaagagcccttattatttgtgcttgataatgtatgacttaaatttaagaactgtttaatacaagcatgtcctttctccctaaagtgattcattcattcattcattcacacagatttttctaaatatctaatattgaccagacactgggctaagcataagctaagtactctgtttttagagagctcagtagggtggggaacacagattgctaagtcagtagtacaatgtttatcgatatgggcacatcaaaagatatgatacttagtgccctggggacacaaggtgggaggttctcctttgcacgggctttcctgcaaaggctctgttgctctatcaatcaaacagcaggacataggcaacctaagcaaagggaaatgcttgtaggacttccaggattgattagatatggacagcaggtttgacagtggggaggagcaaaggctatgctgcagggctgcccctgttccttccatcccgtggaactctgtcaagatccaaagtccagaagacagcatctacctgaccaagcttaagtcatatgtctgctcataaacttagggatggggaagggaagggaagggcaaagggagaggtgaaatctgtttctttccctttcagtagagatgaaactggtgcctggaataattaccttcttactaagattaaacacactagggagttattctctaaaaggaaaacaaactcagattaggaatgaagaatggaagctggacaaatctttacaatgaccaatgactcttacctggacattcaggcatggggaagaatatgggtaaaggcaagtccttagtaatactgctgaactgctggatcaagccttacctgaaaccaactgaccttggagctttccagttatgtgaacaagtaagtgtcccctatgccctcccattttttgctctaagcccatttgaatttggttatctgtcagtgtaaccaaaatatttctaactgatagacccccagaatgttttttaataagattctaggcagtcttttttccctaagaaattattgatttttactcatttttcagtctctgagtgacatttgtgctgcacgtttatagctcatatcagatgactgatccagctgataatatcacattttcaagtcatttatctcagataggtagtgtacaaacaaaatgatgtttgtgccatgtaggctaatttttaaaattgtttttgtagagacaagatctcactgtgttgcccaggctggtcttgaactcctgggctgaagcaatccttctaccttggcctcctaaagtgttaggattgcttgtgtaggccaccatgccctgccacattcttgttttcataattaatctgaaatttgttttatccttaagagttgttttta

SEQ ID NO: 11741 - DNA, 427 bp, Homo sapiens
ttttaacaaaatagggatgctttccctatttcataaagttgtgattagatcatagaaagtattatcaaatggaatcatgataactgctatttatggagggtcaagtctcacaacaaccttgcaagtaatattctctttaaagagctgggaaatcaagcccagataattcataagcacttacaacatgccacacatccctatgaagtatacaaactactacaattcccattttatagatgaggaaactgatggaacttgcccaagaccacataactaggaagtagtagagtcaggattcaaatctagaaagtctggctcttgttcagctgggctaggaagttgatgcatgtggtgcagaggacacatgggaagtgggagagatgggagtggtgcccagttctagctccaaaggccatgctggtgcctc

SEQ ID NO: 11742 - DNA, 516 bp, Homo sapiens
taccattgaaacaggtaaaggtttattatatagaatggtgaaacataaagaaaataattttattctttttaaggagccttcattaagaaaacccaatttaaagatatttctgtttccaaataatttatgtatatttgttgcagcataattctccaaacatacctaatgtaaaatacaaaactatttgaaaccgaattcaaatataaaatatatatgtgtgtgtatatatatacatacatatgtatgtacatatatgtatatgtacacatatatacatatatatgtatatgagctataaatgactgtgctaaagatgcagaaacctgaagactcatcagtgcgtcctcaaatcaggcaggttggtcagccaccaacaagcctcaccttttcaagtccttgcccaccaattaagggaaaatgtctataatgaaccatagactaacaaagattttataaaatgactttcaaaggattttttcccgaaatgccctatgtgatctggcaactgcctccttg

SEQ ID NO: 11743 - DNA, 3297 bp, Homo sapiens
gtcccctgggaacaggggtgggagaactagaggatgtctgagtaccaaaaaagaagtgggaagacaggggcaagtaccctacatttctgattatcattttaaaaatgtattttattcaacttggaaaatgagtacaaatccctgggtgttttttgtcagggaggagtggggagtaggcaggaaagagaagagggtaggaggcaaggtaaggtatgagcatcacagtggctgcctcaagaccctgcccagggagggtggggtgggctgggggttgagcacggagctcaggtccggaggaacaccatggtgaggaggcctggaggggggacaaagaaagaatagggtcgcatgggcagccctggggctctgttagctctcctcccgtcccttctccctttttcctggggcctgggtccctggccactactgtcctcacccaagacgtaggcggccaccaacttttgtcccagggagacgtgcaggacttgaggcagctggctgccgagttcgtccgggagtgggagcagcaggaaggccacagacacaatccccgtcagcaagaagaggaggaaggagctggtggccagttgctggcgggggtctgagaaacaagactcatcagatgctgcagcccccactcctgcccagcccaggtcctccagggagaagcctgaacaaggaagatgtatctactttttttttttaattatcttttattttttgtagagatggagtctcactacgttgtccaggctggtctggaactcttggcctcaggtgatcctcctgccttagcttcctaagtagctgggactatgggttcatgctaccatgcccggctaatttttaagttgtttgtagatggtcttgctatgttgtccaagctgatcttgaactcctggcctcgagcaattgcaatcctcccaccacttcagcctcccaaagcactgggattataggtgtgagtcaccacaccctgtatctacttttttttttttttgagacggagtctcactctgttgcacccaggctggagtgcagccacacaatcctgactcactgcagcctctgcctcctaggttcaagtgattctcctgccttagcctcccgactagctgggattacaggtgcgagccaccactcccagctaatttttgtgtgtttttagtagagacggggttccatcatgttggtcaggctggtattgaactcctggcctcaggttatcagcccacctcagcctcccaaagcactgggattataggcgtgagccatcacaccctgtatctactttttactgccctccaggggtacactgcaagtgtcctctccttcctacagcctctgtccccaccaccacaagaactctctcctccagtccctcagcattcattttctctcttctgtggacctatccgacaggcagggacctctcttgatctcatacccagcacacaacttggtacagggttaattgctcaatacaggtttcttattgaactgaactgagctaccacatgataggaagtactgcggttacagtcaaggaagaactttttcctctaagtagaagtcagaaaccagggaagctgtaagtcttttccccctcacctgatataaaatctcaactcggaggaatgtttccaccaaaagacaaaagactgaaccaggagacttcttcaaatccaatttatctcatctctagggaaatgctagttcctccctccctacagaactcaagatcccagtctcccaactcacgctcctggaagtgtctggccgtgggtggtggtgtcccagcaggaggccctgggcgaggcgctggatctggctgtccctgaagctcaagggggtacgctggggctctcagaatggaggtaatgtccttgcgtcccaccactcggccctcagctccttcctcagacagctcaatgcggaagcggtcctggacatcatagtggctgggaatgggtgccacatggcgaatcacactggtcccaaggtaggagagaagcccattggggtgaatgaggcagtaatccaaggaaatctgggcctccccccagaagtctctcccttaggggcacaggcagaggatagggcaaataggttaaagggggcaaggtctcagacctcagacaacaggtggcagcgacccctggcttccacaagcctccccaccctcccagctcactcacatgtcaatgcaagactggggcttcacatatccctctgcgtcaaacaccgtgtatttggcaggtgctgtgcacaggactgggggatagagacacacacagacaagccctgccatgtgggtcatttaagtcccctctgccttctgccccggaggctggacatgactttcccagtccaccaaagctggacgtgcaaccctacccatctgactcctccagccaacacaaccccccagtgtccggccaccagcccccacgaggcgccgatccctttacctcggaagcgaagcgcagttcctgtggggttatagagggtcagcagctgtcggggtccgctccgctggtccgccctgaatactagatccgggggaaagaccaggaccgggacaacgggtcccaagggaggaggggcgccccgggacccccgcccagggggccccggacccaccagctcctggtcctggggcgccccacggcgcatgcaggctctgggcggtcggacatccgagggcagagctcaggggacagggcctggagtcagagctggggggcgtgaggggcgaaaggggacaagatgagctcccggagcagggcctcgactgatgccgccgccgccttggaaccccgctagatggggctcccgcagacccaggcccagggcccccaagacctttcctcttccagctctgccccaggttccttcggacccgccgagccccacctcgacggccacgcccaccccgctaaacccggcccctcgcagctcccaacccggccttctcctcacgcccagctcacgatctccataagccccgccccgccgctggcctcgccccttccgggcgttcccggacgcccgcctcctctctccagccagactccgcccgctgcagcgggcgcctgcagagcgacctgtgacgccgcctgcttcctgggagacctgtgtttgcgtctccggcccctccctaagctcggacacgggccccatcgggcttctgcctcaaaacggtcgctcgcgttaggatgcccaccttgtggttaaagcacctgccagtcagcttgtggtcagattaatgttgccatgttccagagagtccttttc

SEQ ID NO: 11744 - DNA, 434 bp, Homo sapiens
ttgggtgtattttttgtatttttagagacaagagttcaccatgttggccaggctggtctcgaactcctggcctcaagtgatccactcgcctcggccctgcaaagtgctgggattacaggcatgagccactgtgcccagccaagggagttgaagtcttaaaggaaagacccaggaaaacagatatagggtccaaaaggcagaaaaggattctaggggttgtaaacacccaggtaaccctggtgaaaggctttgttgcctccagatggtgggacaggagttccaccgcaggcaggattaggtggtattttcattcatttctttttaggttaatacattggcttagggacaggatcctattccagggctgaaggggatcttgagaatcaacttgcccaatgctctcattttgtaggtagaatctacagctcagagaa

SEQ ID NO: 11745 - DNA, 152 bp, Homo sapiens
tttgcttttttttttttttttttgagacgaagtctcgctctgtcacccaggctggagtgcaatggcacgatctcggctcactgcaaccaccgcctccagggttcaagcgattctcctgtctcagcctcccgagtagctgggattataggcgt

SEQ ID NO: 11746 - DNA, 460 bp, Homo sapiens
cccagctttagttgctggtgcccagatcatatcgtggaattgtacaggtgtaagttaaaaataaacttagagcaaatgattctcttttgattccctacccaatccacactcttccctgtcccctctatgtcattcctggcaggtggacatgaagctccaggtaagaggcaagcatccgtgttcaaattaccattcccagtttgaatgactttgtttgcaggatcttacttctgcttaactaaatttgtaccccaccctctatgcacttaaaatccctttaaaatttgttgatccttagttacctccctggagctccttctatttatacacaataactggtttccaaatattgaaaatcaactcttgtagcccctctagtttttgtttacttacttgcttcattccccacgggctgaacactccagttccctggacttttctcatatgatatgtactcgag

SEQ ID NO: 11747 - DNA, 460 bp, Homo sapiens
cccagctttagttgctggtgcccagatcatatcgtggaattgtacaggtgtaagttaaaaataaacttagagcaaatgattctcttttgattccctacccaatccacactcttccctgtcccctctatgtcattcctggcaggtggacatgaagctccaggtaagaggcaagcatccgtgttcaaatgaccattcccagtttgaatgactttgtttgcaggatcttacttctgcttaactaaatttgtaccccaccctctatgcacttaaaatccctttaaaattcgttgatccttagttacctccctggagctccttctatttatacacaataactggtttccaaatattgaaaatcaactcttgtagcccctctagtttttgtttacttacttgcttcattccccacgggctgaacactccagttccctggacttttctcatatgatatgtactcgag

SEQ ID NO: 11748 - DNA, 303 bp, Homo sapiens
gggcacggtggctcatgcttgtaatcccagcactttgggaggctgaggtgggtggatcacgaggtcaggagatcgagaccatcctggctaacacagtaaaaccccatctctactaaaaatacaaaaatttagccgggtatggtggtgggcacctgtagtcccagctacttgggaggctgaggcaggagaatggcgtgaacccgggaggcagagcttgcagtgagccaagattgtgccactgcactccagcctgggtgacagaacgagactctgtctcaaaaaaaaaaaaaaaaaaaagaaaga

SEQ ID NO: 11749 - DNA, 296 bp, Homo sapiens
gggcacggtggctcatgcttgtaatcccagcactttgggaggctgaggtgggtggatcacgaggtcaggagatcgagaccatcctggctaacacagtaaaaccccatctctactaaaaatacaaaaatttagccgggtatggtggtgggcacctgtagtcccagctacttgggaggctgaggcaggagaatggcgtgaacccgggaggcagagcttgcagtgagccaagattgtgccactgcactccagcctgggtgacagaacgagactctgtctcaaaaaaaaaaaaaaaaaaa

SEQ ID NO: 11750 - DNA, 1003 bp, Homo sapiens
catcaaaaagatacacgggcctaagataaaagatcaactaaacgtctcgtaaagcctctaaacagggcaggaaagcctgggccaacgtggagatgttacatcaaaggcagcagcagctcagtgatcctcacacacagtgggctgaagttaaaaaaagcagagtcatcagtggttcacaatttacattataattgtaatttattatttgcatgtatagttatattagtttatgctttgtttgatatttcatgtttaccatatctttatttgaaatatagtaaatatttatttctatacatatttggaaaaaatatattctgaacaactttttcttaatgctagcatccctggtgttgtggcacttttcagaataaaccctagcatggtcaagatgattggcattagccttcttctttaatcatctcaaaccattgttccctttgcttactatagtctttctgtgtttgcctccttttcatttcttactctaaactctttcctgccatagcctttgcatttgctattccctttgtctggaaggttcttgccatgactctgcatagtggctttactgacacatatctacaacacataatttgtacagagatctaaatattttttccagatttacattcaatgacctttgtataacagatatttctattatatcaagtactgtgttatctacttggaaatattgtcctatcttaactttgccacttgtcaattaattaatatcattgccatttgaggagtggaggaatttcagagtggcttagtgattgcacaaagtcatacagctaataaacaacaatgccagggtttgaacccagggtttctgagtttggatctcttttgcattaatctctgacatcactcatgcttttgcctttctgtatccagcagtctcttcttatctatttttattattatcaatggtagtttttgaaattgtactctgtgtaactgatgcttttatgctttatttgacttgtataatcat

SEQ ID NO: 11751 - DNA, 116 bp, Homo sapiens
gctgaggcaggagaattgctcgaacccaggaggcagaggtttcagtgagccaagatcacgccactgcactccagcctgggcgacagagcaagattctgtctcaaaaaaaaaaaaaa

SEQ ID NO: 11752 - DNA, 1849 bp, Homo sapiens
taagtccctatgaatgaaaccatgacattgtgcaatcaaggcaggaatgttcagactccaatcctgctgaaatacagaggtgatctttgccaatgaggcatcgtggagactccattacacgctccagcaagcaaacctgttatcctcagtggcccatgaccattcttgctgtcagactttgctccgtatgcactgagcccagagctgattttatctgccatgaaaagaggatgtggaacaaagaagggaacagagtttggttgcagagagaagtgtatgctccaagaaccagatgctaagatgggattaaatgtgcaaggctattattaggggagatgcctgtggcagaaaatggggagagagatggacaaggctgggcaagtcatcagatcatgatgcaaggctgatctgagtgaaggaaagagggagaaaaggtagttggacatattctaggctgccatgcagttaaggagtgttcagctagggcattgggggtcctggagccagtgtcaactgacataggacaggaatgagccttagtatctttgccatgaccagttgttggtacgtggcctcaccacaaacacagtgatggatttcagagcccagcagctgaggccgatggtcagttatgctctcatggttaaaggtcttccaggcacattctcatgacagccacgatatatttttgtaagaaattctaccaaggcaaaatatgattaagataggtagccaaaacaaacaaaaaagaaagaaaagccgcaaattcctccctgcttgctctttatgcatgctcctttgcaatgtgattttgctattagctccatcaagagatgggtctccttgaatctgagcttgaccacgtgaattgctttgaccactggagcattcacaaacatggcacaacggaggcttgaaaaatgcatgtgccttgggacttgccctctcttgttacttttggaaccagagacctccatgcaatgagcctagactagcctcctagaagatgaggacaagaagaagcagaaatcaagcaccttcccaccaccaggcatgtgagtgaggccatcctagactgtccagccccagccaagctgtcagtgaccacagagaccagctaagccaaactaaaaccgaaaggactgtgggaaaacctatagtactgtgagaaaccataaatgcttgttgttttaattcactcagttttgggacagtgtgttatgtagtaaaaactaattgatatcatttatgtccattttatagatggaggaactgaaacctggagacatgagaaagcccctcaatgaatggaagtctcaaggtgttcattggtcttcctcagagcctcctacagcaagctgggcttgatcggaaggctctgagtttgggggtagctttactcatttgtgttatttgcctaaaccctggagtctactgagatcgagacccccgaatttgatcattaataaatctcttttggatgaataatataaaggtgttaggaggcccttctaggccattgaagccactagaacagaagtcaaggaattctcaatcttcaaagcatgggaaatgaggggtacagggattctccctagcccagttagaaactccttcaggcaggacgtaaaatttatatttctcttctattcttcttcactactgtgctagtcttataagtctattgttcattcattcaacaaatacttattgagtgtgccaagaaaaaagcaaagatctttgccctcatagagtttactttctaggagggaaatagaaaataagcagaataaataagagaaatatatggtgtaccagataatgatgtgtgctaggaattaaaaataaa

SEQ ID NO: 11753 - DNA, 1849 bp, Homo sapiens
taagtccctatgaatgaaaccatgacattgtgcaatcaaggcaggaatgttcagactccaatcctgctgaaatacagaggtgatctttgccaatgaggcatcgtggagactccattacacgctccagcaagcaaacctgttatcctcagtggcccatgaccattcttgctgtcagactttgctccgtatgcactgagcccagagctgattttatctgccatgaaaagaggatgtggaacaaagaagggaacagagtttggttgcagagagaagtgtatgctccaagaaccagatgctaagatgggattaaatgtgcaaggctattattaggggagatgcctgtggcagaaaatggggagagagatggacaaggctgggcaagtcatcagatcatgatgcaaggctgatctgagtgaaggaaagagggagaaaaggtagttggacatattctaggctgccatgcagttaaggagtgttcagctagggcattgggggtcctggagccagtgtcaactgacataggacaggaatgagccttagtatctttgccatgaccagttgttggtacgtggcctcaccacaaacacagtgatggatttcagagcccagcagctgaggccgatggtcagttatgctctcatggttaaaggtcttccaggcacattctcatgacagccacgatatatttttgtaagaaattctaccaaggcaaaatatgattaagataggtagccaaaacaaacaaaaaagaaagaaaagccgcaaattcctccctgcttgctctttatgcatgctcctttgcaatgtgattttgctattagctccatcaagagatgggtctccttgaatctgagcttgaccacgtgaattgctttgaccactggagcattcacaaacatggcacaacggaggcttgaaaaatgcatgtgccttgggacttgccctctcttgttacttttggaaccagagacctccatgcaatgagcctagactagcctcctagaagatgaggacaagaagaagcagaaatcaagcaccttcccaccaccaggcatgtgagtgaggccatcctagactgtccagccccagccaagctgtcagtgaccacagagaccagctaagccaaactaaaaccgaaaggactgtgggaaaacctatagtactgtgagaaaccataaatgcttgttgttttaattcactcagttttgggacagtgtgttatgtagtaaaaactaattgatatcatttatgtccattttatagatggaggaactgaaacctggagacatgagaaagcccctcaatgaatggaagtctcaaggtgttcattggtcttcctcagagcctcctacagcaagctgggcttgatcggaaggctctgagtttgggggtagctttactcatttgtgttatttgcctaaaccctggagtctactgagatcaagacccccgaatttgatcattaataaatctcttttggatgaataatataaaggtgttaggaggcccttctaggccattgaagccactagaacagaagtcaaggaattctcaatcttcaaagcatgggaaatgaggggtacagggattctccctagcccagttagaaactccttcaggcaggacgtaaaatttatatttctcttctattcttcttcactactgtgctagtcttataagtctattgttcattcattcaacaaatacttattgagtgtgccaagaaaaaagcaaagatctttgccctcatagagtttactttctaggagggaaatagaaaataagcagaataaataagagaaatatatggtgtaccagataatgatgtgtgctaggaattaaaaataaa

SEQ ID NO: 11754 - DNA, 390 bp, Homo sapiens
cagcaacccgctacccttcccctcacccagctttcttctccacctcccatcccaagcccttcttcaatccccaagaacatctcacccagtttattcatagtaccatcttaaaaataatttctatttttttctgtttaggaaattaatacatgttctctgtagaaaatatagaaagcacagaaaagcatcaccattcactgataaccagtgttagtagtttggtacatgtccttcttttcttttttctatagatatattttatgtgtattttatacatatatgcataggtattttttatttttattatttttttaagagaccatgtctcgctctgtcacccaggctggagtgcagtggttcaatcatagctcaccacagccttgaactcct

SEQ ID NO: 11755 - DNA, 301 bp, Homo sapiens
agcgagggcagctcgcttttgaggcagggattgctgaatgaggggagtggctttccaagttaggcgtttaggggaagaataccaactgtcagggacgaatgagagaacaggccaagcagccctggagggccaagtgaggaggcctctgttggagtgcctgaaatgtctggcttcgggaccttggattctttaaatgatgcaatctcctggcttctgcagagttgaaatcaaggcttagatccccaaaccatctgtgagcctggatacttatgcatggaagttaaagtttacagtgactcta

SEQ ID NO: 11756 - DNA, 301 bp, Homo sapiens; identical to SEQ ID NO: 11755

SEQ ID NO: 11757 - DNA, 390 bp, Homo sapiens; identical to SEQ ID NO: 11754

SEQ ID NO: 11758 - DNA, 1109 bp, Homo sapiens
ctgctcttaacctaaaactaaatacacaaaatgtggcgtcaaaaaaccctttacttcactttcctattaaatgtctcgtttagcctgtacttttccttttcgctttggtacttttttacaccattccccccacccccatccccccacccctactctcgcgcttcccaacgccaccaagattgtcttgataagaactccaggttctcccacgaaccgttctgatactattaattaaaagcagtggcctcaggcagagggctcaggaagtagggagggcgcgggcccgcgcgcacaacctcagggaaaaggtctttatgatttcagcatccagagaccctatttctgaggacaactccgcacccatgtcctggtacatgaaaccatcaccaaacgcgaacgggaagtgtcctcttcctgcctaggtgctgctggggcgctgccactcctgctgaccgggttcagaacccgatttttcgcaaccgcggtggcacccacgccggagtccttacctccccgcgcgggctcaatcagtggggattaccgcccacccttaccccagtttacacgcaggaaggggggaaaaagggaagaaaattaaaagctcatgcagttctcctcccattcttttctagatttgggcacagctcggtgacaccttcaaagctactcgtatagaaaggaccgcgggcgggacgcggccaccggggctcaggttaaatttaatctatagctgagctactcgctcctccaactcacccagtggaccagtgtttgacccagggggcgaaacaacggataaagcagcctccgccagaatttcaaaaactccctggaggccactgaatgttttatgcatcagaagggaagtctgggattccggtcactgtggctaggaggggggagggctcggccagcagggtgagggtgggggcggaggcggtttcagccttaagccatccaggcctcgggtttatggcccggggctgcttctggccgcggctctctaccttgttgccccggcctctttcaaaaaagcagaggttttttgctccctggcgcagcccaaagcgagggcacagattgtcggagctctaaagctgccgactcga

SEQ ID NO: 11759 - DNA, 1109 bp, Homo sapiens
ctgctcttaacctaaaactaaatacacaaaatgtggcgtcaaaaaaccctttacttcactttcctattaaatgtctcgtttagcctgtacttttccttttcgctttggtacttttttacaccattccccccacccccatccccccatccctactctcgcgcttcccaacgccaccaagattgtcttgataagaactccaggttctcccacgaaccgttctgatactattaattaaaagcagtggcctcaggcagagggctcaggaagtagggagggcgcgggcccgcgcgcacaacctcagggaaaaggtctttatgatttcagcatccagagaccctatttctgaggacaactccgcacccatgtcctggtacatgaaaccatcaccaaacgcgaacgggaagtgtcctcttcctgcctaggtgctgctggggcgctgccactcctgctgaccgggttcagaacccgatttttcgcaaccgcggtggcacccacgccggagtccttacctccccgcgcgggctcaatcagtggggattaccgcccacccttaccccagtttacacgcaggaaggggggaaaaagggaagaaaattaaaagctcatgcagttctcctcccattcttttctagatttgggcacagctcggtgacaccttcaaagccactcgtatagaaaggaccgcgggcgggacgcggccaccggggctcaggttaaatttaatctatagctgagctactcgctcctccaactcacccagtggaccagtgtttgacccagggggcgaaacaacggataaagcagcctccgccagaatttcaaaaactccctggaggccactgaatgttttatgcatcagaagggaagtctgggattccggtcactgtggctaggaggggggagggctcggccagcagggtgagggtgggggcggaggcggtttcagccttaagccatccaggcctcgggtttatggcccggggctgcttctggccgcggctctctaccttgttgccccggcctctttcaaaaaagcagaggttttttgctccctggcgcagcccaaagcgagggcacagattgtcggagctctaaagctgccgactcga

SEQ ID NO: 11760 - DNA, 557 bp, Homo sapiens
gttggctgttttagaaatgaggacaaaggagagagatcatatactatttttcttaaaatcgacctttttgaacaaaacatattctttggttcctcattgcccacgcggtttgcaaaccgtgtcaagaaagtggcctctgttcatgtcgctcatgggaaaccatccagacacggcagaggcaaaagagttacaattaacgggttatatttattatgcaaatctttcataggtgtgttgtttacagatcacctgtggacattttctttaaaaatatttccagatacttggagaatgaaggtctattctatgccaaaatatgaatgtatagtttccataaaacacaaagtctggagacaagttcttcatcctcattcacagaagctttaatgacacctgacatctcttgttctcagcagagaaataatattttaattcaatagtctcagtttattccactgttaatctgcgatgtaagtgggttgggttttggataatcaattcatttctggtatgtggtagaatcgctgatctaccaggaaataatcacatgttctgtg

SEQ ID NO: 11761 - DNA, 557 bp, Homo sapiens; identical to SEQ ID NO: 11760

SEQ ID NO: 11762 - DNA, 456 bp, Homo sapiens
gcttgccttgtggcactggcagcagcagccaaccacagtggcagatgcagatgagaaatgtcaatggggctacagggatgtggagatgcaggggctattgggccccagggcagaatgcaatctggtggctggctctcaaaatggtactgtgctgtagctgcttagggctcggggagttcatgagacccagcatgagctccctgtctggagcagtgccattatgaggtctctaggaagctcctcatgttagtctcagggcctgtgagggttgaggagcattcccattgataggattgcaggagtcttcaatggaaatatggaccactgggggtctctcactctttctccacattgagaaacctctctgcgctcccagctaatcctggctgagcaggatgcctggcttcctgctccttccttgccttggatgtttcctgtcacttctctgttgaatgc

SEQ ID NO: 11763 - DNA, 260 bp, Homo sapiens
tgagatggagtctcgctctgtcacccaggctggagtgcagtggcacgatctcagctcactgcaagctccaccccctgggttcacaccattctcctgcctcagcctccccagtagctgggactataggcccccgccaccatgcccggctaattttttgtatttttagtagagacggagtttcaccattttagccaggatggtctcgatctcccaacctcgtgatctgcccacctcagcctcccaaagtgctgggattacag

SEQ ID NO: 11764 - DNA, 16747 bp, Homo sapiens
  misc_feature (1512)..(2711): n equals a,t,g, or c
ttttttttttttttgagatggagtctcgctctgtccccaggctggagtgcagtggcacgatctcagctcactgcaacctccgtctcccgggttcacgccattctcctgcctcagcttcctacgtagctgggactacaggcgcccgccaccatgcccagctaattttttttgtatttttagtagcgacggggtttcaccgtgttagccaggatggtctcgatctcctgacctcatgatctgcccgcctcagcctcccaaagtgctgggattacaggcatgagccaccgcgcccggccaaaccaatgtatttcttaaatgtatttgattgatgtctgtgcctccctaaaatgtataaaaccaagctgcactcctaccaccttgggcacatgttctcaggacctcctgagcgctgtgtcatgggccatggtcactcatttcgctcagaataaatctcttcaaatagtttatagactttgattctttttgtccacaaggatagtttgaaatcagccatgatgacagtatttacaacatagaaagcagggctttttcccctagagatctagttgttaagcattcaccagcacaagactataaaatgagtttaggctgggcgcggtggctcaggcctataatcccaacactttgggaggccgaggctggtggatcacttgaggtcaggagttagagaccagcctggccaacatggtgaaactctgtctctactaaaattacaaaaaattagctgggcatggtggcgggtgcctgtaatcccagctacttgggaggctgaggcagaagaattgcctgaacccaagagatggaggttgtagtgagccaagactgcgccactgcactctagcctgggcaacacgagcggaactccgcctcaaaaaaaaaaaaaaaaattggagggagatgagattgtaaatgtaaatatatagacatcattttataggaaatagtgagtcctgaagacctctatgatgggttaattggggaagatgttcatatttctgagtcagaaaaatatttacagacaattttgctgtcagttcagaggatggagaacagaatggaggcagaaagggcattgagaaggtggtggcattatttcaggtgagaggtaagacagtatcagtagaggtgaaagaaggtaaaggacacatgccaaagattaaatcaaggataaatattgaaggtaattgaggtttttgctcggggcacgccactagttaagtaatatagttggacaggcagttttggagataagatcctgttgaatttcttgctgttaaggctttctgaggatttctcagtggaaattttgtaaggttatagttttgggtggaaattctggtttacgaatcgtggtagctgaagccaagaacaagaataatcttgatcaaagggtatgtaagtcatgaggaaaggaaaaagaagcttaaatgagaaagggtggataaacaggagagacaagatggaaagagcattttttttttttttttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggctcaggcctataatcccaacactttgggaggctgaggtgggtggatttcttgagcccaggggttcaagaccagcttgggcaatatggtgaaaccctgcctgactctataaaaaaatacaaaaattagccaggagtggtggtttgatcctgtagacccagctacttaggaggctgaggagggaggattgcttgagtccggcaggtcaaggctgcagtgaacaatgatcaagccactgcactccagcttgagcgacagtgagacactgtctcaataaaaacccaaaaaaccaacaaaacaaaccaattgtaactgctactagttggaacatacattcaaggaaacttaaatctatgtcttcagggttgcagttctcaaacttggctcaaagaaactttccactgtgaaaataagtaactctggctgtacgtggtggcccatgcctgtaatcccaccactctgagagaatgaggcaggaggattgcttgaacacaggagttgaagaccagcctgggcaactcggtgaaacctagtctctacaaacaataaaaaaaaaattaggtgtggcgactcacacctgaggtcccaactactggggaggctgaggcaggaggatcacttgatctcacaggctgcagtgagttgagatcatgccactgcaattcagcctgggcatcagagaaagaccctgtctcagttttttaaaaaataaaataactccaaatatgaattgttggaactttaaaatattcttagccttaaaggaatgggattacagcacctgagtcaaaaaaaaaaaaaaaaagggcaattataacctaggcagctgtagcctttgtttctctgattatagattagccttattctttacctacattgttttgtaaaatgttgtaaataactaaagagctccagggaagcctctttatttgtttgtttgtttgagacagggtctcgctctgtcactcaggctggagtgcagtggcacaatctcttctcattgcaacctccaattcccaggattgtccctctaccttcctaccccaacccttcttcatggagctcacctgggccttgccccgcctcagccccacacttctactgattataaagagataccccccttatttgtctgactttggaatctttacctctggcccacagccatcctgggctctgcccccttttgtacacaaagcctttgtcttcttaggaaaatgaccaggttctgcccataaaagtatcctacctgaaagggaggtggagagagagtgcctcatggaaaatcacagaaacacatttctttgcatctgaatgcttccagtacctcactttgtcagcaaacctactctgggttagaccccagcatccttagcctttttgtgccgtggccttctttggtatctgaggaagcccatggactgctcagaatagatttttttttttaagtgcacaaaataaaatacagagagcaatggaaataaattatatcaaaataaagtttatgaaaatatttgtgatattacatgatatgctttattggcacattaaataacaagatccaaagttaggtctaattactataattttgaggtaatgatgagcaaaaatgctatcccgagatgtctgcaacagctgcagtgtaatatgaaaatatctgtgatttctgttggtaacaaagtaacaggtgctgctaacactaatgaggtttgttcctagcaacattcgccatggaaggaaaagctcaatttcaattaaagtttagagaaaatcaagatgcaatcaccctcctcccatctttctcaattttttaaattattttttatttatttttaggcatggtcttgctctgttgcccaggctggagtgcagtggcacaatcatggctcactgcagcctcaacctcctgggctcaagcaatcctcccacctcagcctcctaagtagctggaaccacaggtgtgcaccaccacacctggctgatttttaaagatttattaatttttttaaattttgagacagagtttcacccttgtcgcccaggctggagtgcagtggcgcgatctcggctcactgtaacctccgcctcccaggttcaagtgattatcctgcctcggcctcccaagtagctgggattacaggcacgtgccaccgtgcccagctaatttttgtatttttagtagagatggggtttcaccatgttgcccaggctggtcttgaactcctgatctcaggtgatccaccggcctcagcctcccgaagtgttgggattacaggcgtgagccacagagcccggtctttttttttttcttagtagagatggggtcttgcctccctcccgggtaccatcatacctgctagtgtggggtcttgcctccctcccgggtaccgtcatacctgctagcgtgtgactgaaggcagtgtccctggccccagctgaaggaccatagccagccagtgggctcaggcaccttggcctgttgctcctaggggtcgcctatgctattcagccaaggggatgacagtgcctgctggcttggctgagctccagccaggcttcccccaccactgactctcgctcttcttttcctggcaggaagggcccagcctcatctatgcgacctgtagccccccaaccagctgaggctcccctcttagacttgtaaatctatggccactggcatctggctgcctgcactccctgcttcccccagggtcctgggctttctgaccacccaggggggacttgggcactccctccagccatgcatcccttttagcttcatcctcttggttcaagcaatgttctttgtctgtcaggcctggtggctgttgtgtagggctccccaaagcgaggggtggccctgggccagtgggttggaagacagggtgacaagtgggaagcccgagggggctgagtttcggtctgaactgtgggtgcactgcctagatgccgtgtgacaggccagcatgtgtggggtggggagggccgccgcagcccccaggcattacctgtgaagctccggctcctccatcttcctcccctttcccttttagcccctcttttccaggaatcttgccacatccacacttgtgtcctcccctccctggccctcccaccactgctgcagtgcgttgcgcttgccttaccagctctctcctcacttttctctctcccgttttctctctgctttctctccaactgccagccaatggggtcaggcaaatccatcccatcctgagagccccagggccctcttctacctctaaacagatccctcctcttctcagagaccttcctttccaagcctgcctggacgactgttctgtgacttgacagtggctcccctagccccaaaaccagcccccttcatctgtgatggtctgttgtagtggtgagctgacacatccaggcataacctttggtgaaaacttgtgccccctctgtggtacacccctgccctgttctataaatactcatatatatatacatatacacacacacatatatgtatatatatgcatatatatacatacacacatatgtgtatatatacgtgtgtgtgtgtgtacatatatgtatacactcctacacatggccgactgcctcgcctctagcgctgggaatcagtcaccgtgctgtccttgtggagtcttgtgacccaactacaagagaacactgtcccccaacaatccccatccaaagtccatcacctccagtgagcctccctgtcatgcctggcctgtggacagccagtccccaccatccctcctgccgcccgacaagcttgggggtgctgtgcagacagctgtgtggcccgacagtctctaccagtcctgctgtcccttggctgggaataaaacccatttctaagtgacggggaatgtgtcctctgctggttgcgttctctgtggagctcaggggaggggaagggtcaacccattaccagggtgctattgggagtggtaaaaaggccacatcctttccaagggacgcttcctggaaagcctccggagcttagcaggctctcatcctgtgaagccggctctggccactagggggcagggccatgaactcagattggaggaagcctgtggggcagctggcaatctagagggacagacagaacaggccaccaggtgcagacaggcgagggaggcaggagaacaaaatggaagacaactgggctggatggaagtcagtgaccttggatgctggcacctgccttacttgccactgctagatcaggcttccgagcctgttagccgtccaggccccatggtcacccataggtgccatggcagttcctgtggaattccccaggtgttaccaggcagcatacaggtaacaggcctggaaggtccccaataccccagctggacatgctcactttggggctccctgttcagtggcacaaactccatgacccagtgagggaaacaggaatacaccaggccaagcagtatatggctaaatacattccaaaataaaaagcaaaataaacaggagtcgcatcaccacagtgccacgaccccatctctgccccttcccctggcctatgctatcaataaataagttttccagccccaaataactatcagaacttcctacccatatgccagctccaacctctgctatgtatgacacaggaggtggccctaccactggaatatacaaaatgttacacggatatagtatgtacactaaggggggccactccagagcctgtgccctcacctggtctacattagccccattgtcctgcctcagccgcctctctgagtaagaagatgggagcccccctgaggaaaaaattgctttggtgagagttaaggaggccattaggcctcctccaaacaagccaattctataagcctctgactcttaaaacaataatcatcgtccagaaatttaaggagtcagctctggccaaggtggcaaagggtctgcatgtttgcctccccctgattagacacgggtcttattttgctattgtgagggtaaaggggtgactgggaaggggtggctgggacatgatggggacggagcctctggccccacacttctccaggctttgctgacagctgcccgcttttattttattcacacttttatccttttttatacttttcataactttttttttgagacagtttcactcttgttgcccaggctggagtgcaatggcacaatctcggcccactgcaacctctgcctccctggttcaagcaattctcctgcttcagcctccccagtagctgggattagaggcatgcaccaccacgcctggctaattttgtatttttagtagagacggggtttctccgtgttggtcagactgctctcaaactccagacctcaggtgatccacccacctcagcctcccaaagtgctgggattataggcgtgagccaccatgtctggcttcataacttctcataacttttataccataacttttatcccataacatttttaatcctataactttttataatcccatacattttttttaaaatcccatacctttttaaaattttttatttttttatttagtggccttttagattatggtgatcttcacctcatctccacctgtctccccacattagacaggggtcttatgcttgctactgtgagggtaaagggttgactgggaaggggtggtagggacatggtaggggcagagcctccagccccacttccccaggttttgctgacagtggccggcttttagatgatggtgatcttcacctcattgttctcatcagtctggtacaaaaaaggaatgcaagggctgctgcccaagcctgggtgctcctggaggttctgcatctcatgaagcagttgcatgatctgctgctcagtggggttgtcacagggagaatgcttccccgcctctccttgtgcagactccccactgctggcaaggctcacctcacaaagatctttggagagagggaggcagggtgctgtgggagccctcccctgctcctgcgtgcccactgtgcctgaggactctactcactaccctggcttgtcagtagccccaagctactggggggcgggggcccctggagtgggctcatcagcagggttctgggcagctgccaggaatctgctatgccacttgttgcagtcgtccacaagccacgccagctccagcagcttcacctggagggaggggtgctcagctgctctgcctgtgtctgagaccatccccaaccccaccccctctaccctccaccctccacccctacagagatgttccacgccctaccttcacctctcccttgtcctgggccagcctgctgatgcactcctcctccttccgcactgccctctggctctggtacagtgcgatgtactctcctgcaggaggacaggactcagacgctggggcccctctgaccaatgtgcagctctctttgccgtgccctggcttcccactccccgatggtgtctgtctctctccagacagctagatgcagcaatgttccagttcctcaaccctctccttcaagtccaccttctctcctgcatgagctccataaagcggctctggagccaaaataatggggtcacattaaggcagcgaccttcctgccccaacccttcttggcccatgccaggaaagactcacccacagcttctccatggccccctgcagggcctggtgggtctccccacacatgggatcacccccagttcttggggctggggctgctgcctcaggttccttctgggccgaggccaacagatgagccaggcgctggcagtgcactccttcagctgcccacatagccgtgcctgctcctcctcggcactagctacagctgagttgaaaaatgccacctgcaggcaagaggtacgcattcttatgggggatacacaggatgaacggggcagggaggtggagagcaggccttgccttggggggcctcagaggatgcacctgttagtcacaggtgaaatggtgtctgaccactggctcccagggaaggggtgagggaccagagaaatcagaaggccaggaacccaagagcagaagggggtctgggagggaccacagagggaggcagcaaaggtggggcagggggagtcaggctcaccatggccttctggctctctagatcctccgggatgcttggcatgggctgaggcacctcctcctcctcctcactgtccatctcctgttgggggtggccagagaggtcctcagacaacccaacaagggcagagtgggcccacctctgcccccaccctcactgtgtaaccctaggccagcccctccctagtggggaatgagcagctgttctttattttgaaacagtctcattctatcatccaggctggagtgcagtggcatgatctgagctcactgaaacctctgcctcctgggttcaagcaattctctgcctcagcctcccgagtggctgggattataggcgcccgccaccacacccggctaatttttgtgttttcagtagagacggggtttcaccatcttggccaggtcggtcttgattgaactcctgacctcgtgatccacccacctcaggctcccaaagtgctgagattacaggcatgagccaccgtgcccggcctctttattttttaaagagccaagatcttgctatgttgcccaggtgcagtcccactaccaataggcatgggagttccgacctgctccatttctgacctgggccagttcacccacccttaggcaacctaacctggtggtcccctgctcccagaaggtcaccatattggtgccaaacttagtgtggacacctggttggcataatgaccagctgttctaaaagtctgtttcagctcctcaatcctatgctgctaacagttcccgtttcctcctggggctctctcctcttcctgtgagcagtctccggtaccttccccagggagagccatgaggctcaactgggcctgaggctgctggttctgctggctgatagcttccaggtgctcctaaggggccaagaaagggagtgagaaggcacaaaggttgccaggtcgttaccctcagggccctgccctgagcaactccctcacctgggtctcccgcaactcttggcagcccatcttggccacagctttgctttgagctttctgctgctgcagccggtccacgagctgggtctgcagcagtaactggttgtgcagctcctcctcctcagaggtcagctgctgataggtgaccacctgctgctgataggtggccacatactgctgcagatgacccaggtactggtcctgctgctgctgcagactctgagcctcctggctcttcagctccacctgcagaaagaccctgggcatgagggcaggtggtggctggcccataaatagggtagcaaggtcactgtgtggctctgttgcctacccaggcccctggccccttggctccaggcctaaatgactgcctccctttcccagagtcccatgcctccttccccagctgcaggggtctgtcctgcagaccccagccgcacagcagatgaataacatactcacaccgatattcagtgacagagcagctaaggggccgggccatgcacagaaagagttgtggcggccacaggccttaactggctggccctcatggcatttattcagcacagacttaatgacaaaggctttgagtcaacacacctgtgggtaattaactccccctgcccccaggtagagagcaatcatgcacctgcggataatcaaaggttggtcttaggaccacatgagtaaacaagctattcagataaactcccccacattcccatgttatttgctctattgctatcaactcaaggtaaaggggattagaggtaaaaaggatttcagccaaatcctttactgaagctatgcaaaccttctggccttccaagaaggtttgtgtctatatcctgtaacttcatcttacaattttccaaccacactgactgatcccctaaatctccccattttctgttttttttgcattcagtcttgttcattggagagtacaggtgtgcgcagcaacaggtctgtcaggcatggtggtcattgctcttattccggctttgcatcctaaaattagtaaataacataagacaaacatgagtataattagcaacattcttttctaatcaaggagtgacccaccaccccccgcccccaggagcggtggtctatccaggagagataatctcacacacccttccatatggctgtttgttgggtgtgtagatctacagtttgaagggattctaaaattgtatttttaagttgccttatgtctgctgttaaattgtcatgaaaggttccccagaggtgttgtttcacctcatcccaactatgcattgactgattccatggtagagaagtgacacagatatgtttatgctcccagtcacagtttaattgctgttggaatgccagtgcatcttgtcgctcccccacatattccaaaggcagcctcgagggcttgcagatgtgcaagaatcttttgatctataccttgctgtaagagaagttcattagaaacatttctggccaaattatctacaaaagcagctgtttgtactgattcagtaatagatgctacagccacactagcagttgctaggatgactatggctgagactatgaaggctgtaagtgtgcctatgaatctttcgggtctgacctgggacagggcacgatctaaagtgggaagggaagaggaaccttgccaaccgcatgtcaaattgactggtgggaatgcctcagattgtctccttaataccacgactctagtaatatttataattagatatattgtaattagtaatacatgaggtgaaccaaggctgtccctgcacctgggtcacaaacatggagttttggggtataacagaaatattagttcccacaaggaaaacatatggatgggtagtgcaaatcaggcactgatcagtgtgattatgaataaaggttgtagtatagttgtgactggaattatgatatgtccaatgccaggtgtcaaaggaggtgctaagatgtcccaggcaccacaaagtgtcttggggtggcatggactttacttggggtctggaatatcctatccccccataggcccaaatcataggggaatgggacgtggctatgaaactgtgattggtgccatgatggatgaggacattagtaaggctgccctgcaagtggctgtgggggctccagtctaagatgttataattgcctaactggagcatatgggcttattccccatgacagacctcccagctaaagtggaatccattactttcccggctttgttctttaacacaggaaggaatgtttgggaaagtggcattgattgcatcgcccggtttgaggctacctgcagctaggaatgttaaggcatctcctttgccatgatgtagccataattgtgtttgggcaggtacacagggttagaacctttataacttacacacagtgggaggatagtggaatgatatgtagtgttacctggcaccttagtttaatgtgtgccattaatgagggaccccactgggggtaaatctatccctcctagccaagcagttatgttattaaaggctgagaaggaggtgtctgcccaggtgacagggtgaaagaaaggtggatctaaaatatgagcccaatagagtgcaccaggtacaggttgcagacaaagcaagagcatatgaagtatcaataccctatgcgagttgcaatgtacaacagagagcatagcaagcaacaaattatctggagtgaatggtgtctgtgtctggagcaggattcattcagcctcctcagttgccgccttcagcatcccccaggtaatgtccagagcttgttgccgtccgaggacactgcattatccagggttgtgagtcctgtagggtcagttccttcatttctaggttgggtcctagtcacgtcatggtatggtttgatgcgtcgtgctggaatccaaagaggacctgagggggtgtgaacacaagcatatcctcttccccaagttaacaattcatttggaccacatcatacattactgttcacatatttccataaaactgcagttttatgtcttgagaggttttagcaaagtgcttttctacaatggactgaaatttgtcatctaaattttaaaaattaagggtaaataaggcttgtgccaataatgctgcagggtccttacccatactccccttttttgttttttgagcatatttttaagggtggagtgggcacattctactatggcttgtccttgggggttatacgggatgcctgtggaatgttggatgttccacatgtgacaaaattgttgaaattgtgagctggcataagctagatcattattagttttaatttttgtgggttgccccataaatgcaaaagttaaaagaagatgtttagtgacatatccagtagactctccaggaagggcatttgcactaattaaatcaatggatacatgtacgtatctaagttttccaaattcagggatgtgtgtaacgtctgtttgccataacttattaggttcccatcctctagggttgaaggagggtatgtgcctgtgagctggcaatctcggcattgcaggataatttgtttagccagcctctgggtaagttgaaattgtttagacaagtttctccagttttggtggaaaaattgatgcgattgtgtggcttggtcaagcactgatgtcataacctgaaggtctgcttcatcattgccataagccagtgggccaggcagtcagctgtggccctgaatataataaaaataggatgtgtacactgatctagcaattgctgaagtcaaagagcacacagggtgggctccagagtggacttaattagggctgtctcaaggttctgcagtaaataaacagagtaagccaagtaactaacaatattgaggggctgagtggaaaaagtttccaaagccaatatcaaggccccaccctcagctctctgagtgttagtaaatccagatcgattgatggaattatgtggtctccaccagactgccacttttccatgtttactagaaccatccgtaaacagtgttaaagcattaggtatgggggagtgaactatcggtggcctgaatatatgactttactgattaactggatatagggagatagtgttttggtctcggtatgtgagcaaaaaatccattctagaaagcatagctctggggccatttgtcctattaaccctgtaggggagtgtttagtggggaaaataaaaataaacaattgaacagaatattctggatctatgagatttagttgtctttgagaaatagcctgttctatttcttccatcttttttttttttttttttttttttttgctgcaggggttaaatatctgggagaatccagggctgtgttaccctttaagatagaaaacaggttttgcagcttataagtaggaatgcccaaggtggggtgaagccagttaaaattacctagtaatttctgataatcatttaaggtgtgtaagttgctagtatttaatttaaccttttgaggtcttactgaccaggaagtatgtacccaagatacttccaaggagaggacatttgtgctttttcaggtgcaatgattaaaccacttagctgtgcattctttatgacagaggtatataaacttaaaagcactggctccactggggctgctagtagaatatcatccataaaatgaataaccttgcaatgaggaaattcttttctactggggaacaaagcttgatttacatgatactgacacatggcagcactgtttagcattccttgaggaagcactttccaatgaaatcggcaagctgacctttcaatattgatagctggtattgtaaatgcaaatttttctgtcttgctttgccaggggaatagtgtaaaagcaacagtggccattattagaaagaggtgttttaaattcttaaattgtacttaaatcttagcagagaattataatctgggatgtcgcttgtatacaaggaacacatgaaattttgccatgggccacccgcggagccagagagtctagccggcgggtcccggggcggcggtcatgttgcgcttgctcaggcgctgctttttgtctgtgccaccttttgtctgtgctgctccctcaccctgctgccgctgggcggaccttcgtgcacgcctcctgcccctccctatcaggccagctctggtgtgctgcgcctggctccttgtcactgctgcctctgtgcaggctgagttcctggaagcacttgctggctccaggtctgcgagcttcctttgctgccaagtatttccttctgcctaccacccatttggccacgcggtttcagcctctaatgctttttcttaactttttataaatgttaaaagaaatgggtttatatacccaattgccctgtcaatcttgtattaccaggcaggctaagagctccccacttaatgcctcttgcctaagaaagggtcccatagctgtagcatagctcttgtcttttttcctatttattggaggagggggctcaggcaaaacctccatttcctctttgttattttggcctggcgatattggggctgagggaaaaggaggtggtaaagcaggtgacggttcctcctccttcccctttttaggctcttctgtgtataatggagccagggctgccctgactaaggcccatagcattaaagatgatactgggacccattgcccttgcacatgatgctgattaagatttctccccacttgttcccagagctctacgtctagcgttcctttttctgggaactatgggttatgtgagacaacagtttgcattaggtcccttaattgagcctgtgaaaatgaggctccactagttttaagcagctgcttcaatacttttatatactgttcctgttgagctgataactgttgtcccatgatgaaaccctagcctgaacaatccccgccaaacttggaaattccgagcgggcatcaatgacttactgacttattgactgtgcagt

SEQ ID NO: 11765 - DNA, 38771 bp, Homo sapiens; identical to SEQ ID NO: 6652
  misc_feature (7892)..(9416): n equals a,t,g, or c

SEQ ID NO: 11766 - DNA, 1096 bp, Homo sapiens
  misc_feature (323)..(323): n equals a,t,g, or c
  misc_feature (401)..(401): n equals a,t,g, or c
  misc_feature (441)..(441): n equals a,t,g, or c
tccaaagaatctctggcttggagtaggcaagtatgatacaaggcagaaatgagcagtgggtctgaaaactgaggtgatcacttgaattcctatatgtgaaatgctgtgctccctgtcactttctctattactgggtgccaacagctcaacgcttaaccccaagtcataaaatgagggctttttttcacaacataatttgaggaaattatctggggagtatggtcccagagaaaagctgttttatggctagaaagagggagaatgccagaaacagaaagacatatgataaataaaatggtgtgcctaatccagagatgtctcanaacacacaattgaaaggacgacatacgggtttcagaagagatatctctatgggtgtgaggaaaagaggaaagacttcnctacaatagttattatgagtgaaagagagaccaaatttantgctatgatcaagattcagaacctccagagaaaacaaaaaatatatataggaaacgcataacccaaacataaactagatcagtgtagcacaactttaagcaatagaaaagagaatctatttgaccttcatcataaatcattcccctctgagtggcccaggggttgtgacattgggtccttggagaagaagatatgatttcagtatcctacatcaccctgtactaaataaaatgtatagagtcacagtaacattaatggtgcactgtgattttcaacttttactattagctaacgaacaaatgcagatgacttcattatggttgcatatcagaattaaaatgttaacaaccttggtcaggcttggtggctcatgcctgtaatcccaacactttgggaggccgaggcaggtggatcacctgaggtcaggagttcgagaccagcctggccaacatggtgaaaccccatctctactaaaaatacaaaaattggccgggcatggcggtgggtgcctgtagtcccagcttgtcagaaggctgaggcacgagaatagcttgaacccaggaggcagaggttgtggtgagcagagatcgcaccactgcactccagcctgggcgacagtgggagactccgtctcaaaaaaaaaaaaaaaaaaaaa

SEQ ID NO: 11767 - DNA, 57 bp, Homo sapiens; identical to SEQ ID NO: 10936

SEQ ID NO: 11768 - DNA, 1330 bp, Homo sapiens
ttcagtgacagagcagctaaggggccacaccacgcacaaaaagagttgtgcaccttgactagctggccctgacggcatttattcagcatagatttaatgacagaggctttgagtcaacacacctgtgggtaattaaatttgccgaccaccgagtagagagcaatcatgcacccgtggataatcaaaggttggtcttaggaccacatgagtaaacaagctattcaataaactcccccacgttcccatgttatttgctctattgctatcaactcaaggtaaaggggattacgctgctttcagccaaatcctttattgaagctatgcagactttctggccttccaggaaggtttgtgtctatatcctataacttcatcttacaatttttccaactacactgactgatcccttacaaccagccttaaatctcacacccttcctcccaccatttaaactaggccacagactgatggaaaagcagagggagccaaccaccatctgctaactgtgctacatgcctaatgctttccacgtattatctcatttaatcctcagcacctccaagaggaaggtgctaacttcccttttaagttaaagaaaccgagacttagagatgaaaagtaggtgaccagtggagccaaggccggaatctagtttgactctaaggaacctcttataccaccatctctttccctatgtttgggaggctccatgactccagctgggatgatgatgtccagacctaggaagaacgaacccaccactaaatgtcagagggcgggaagcaagaaacagtcacaggactgccctggagggtgctggggtcacctgtcccccaggctggagctgcctctggcttcacacctcccctccccagaggctggtgcccgccttccagctcttcttggatggggcagggttaccatgtcctttagcttgcccagcttctttcccagctccctctttacgtgctattccaactgcagtgcactggtgatctccatgttctcattagtctggacagagagaagcaattggcggccacccactgcagctggagaccccagaacttggtgtctgcctcccgtggcacctggaagggtggaggcaggttagaaaaatcattccctcttccccacagccatcagagcagggctctggttcacaggtaccttcagaattaccatctcacattaggggtacactgcctcattttatgggtgggaaaacaaaggccgggagtgctagggaggagagcaggctttccagatggggtcacgcaccagctttatgaatccgttctgcagcggagacagctgctctttgagcttg

SEQ ID NO: 11769 - DNA, 101 bp, Homo sapiens
acaaaggagaaagtcaaaatattttaccccaaaacatgtttctttgccatattttgaaatggtcctgcaaagccattctttgtgggggaaaatttgcatct

SEQ ID NO: 11770 - DNA, 5775 bp, Homo sapiens; identical to SEQ ID NO: 6656

SEQ ID NO: 11771 - DNA, 738 bp, Homo sapiens; identical to SEQ ID NO: 6657

SEQ ID NO: 11772 - DNA, 1344 bp, Homo sapiens
ccagtgcttacacatagacggtgcattctctggaattcaccctgggtcagagccttctcacctcccagcacaagccagtagcttaagcctcagtgtcccagcttcggtgcactgggcaggagatgggtctcccaagaccactcagccatgtggttccttcagctctcagcacagccgagtccaggctgcaggctctccatcacaagccaactacagagtgacacatgttctctacacatgccgtgactgaatatgttgtgttctgaaaatatttgggagttaatttgtgttttgtgcctagtgcttcatggaccggtgctcattgcatccttacagccatctacaagggtgtcaccattatttgtattttattagacttagagaggtgaagtgacttgctcaaaataatacggttagcaaatgactgaaccccgacccaacagggagaatgtgggaagaaatcaacaaagcttatttaacaggtatctgccaagggttggaaaaaataagatttattgttgctccactgagcagaacacagcccatcagaggttactgcaccttcaacgacatgtgcttttgactgacccatcaaaacactggtggcaagagcactaaataagttgcctatcatacttaatctttccaggattcaaagaggagtgtagagtgaaatgacctataagacccctgagcctaaaatataatctaatggactcagctttaaagcgctcattgagaggatggccaaaaaccagccgccacagtgcgaagcacgattcctccaccatccgcagtccactcgcacaaataccctcagtgaaacacttctttctctccacccacttttgagtaggatgaaatggcacattccattttcaaagtgggcagcttgcacgtatcagcagtgccaggaatttggaaaacgataacgtggaacccacagtaacttgctggctgaatttactcacccaggtgacccaggtcgatgagggcttcagagccacggggattttaaatgccgcttcaaagccaacaaggagcagaaccagtgctgattcgtgtttatgataatgacatttgaaaggctaaaaattacaaagttgtttacagagatggacttagaaaataattgtatctaatgtctcataaacataaaagaaagttattttgtagtagatgattgaaaagaaaaaatctcctttaaaaaggaaataaatatactagtttcagacagaaacaacttcaaaggcaatcagaaaattcagtggaattttaaagagggaatctcactcaaagaattctctaaaattgcctaaacttaaaagcattatttttctcgag

SEQ ID NO: 11773 - DNA, 1344 bp, Homo sapiens
  misc_feature (777)..(777): n equals a,t,g, or c
  misc_feature (779)..(780): n equals a,t,g, or c
ccagtgcttacacatagacggtgcattctctggaattcaccctgggtcagagccttctcacctcccagcacaagccagtagcttaagcctcagtgtcccagcttcggtgcactgggcaggagatgggtctcccaagaccactcagccatgtggttccttcagctctcagcacagccgagtccaggctgcaggctctccatcacaagccaactacagagtgacacatgttctctacacatgccgtgactgaatatgttgtgttctgaaaatatttgggagttaatttgtgttttgtgcctagtgcttcatggaccggtgctcattgcatccttacagccatctacaagggtgtcaccattatttgtattttattagacttagagaggtgaagtgacttgctcaaaataatacggttagcaaatgactgaaccccgacccaacagggagaatgtgggaagaaatcaacaaagcttatttaacaggtatctgccaagggttggaaaaaataagatttattgttgctccactgagcagaacacagcccatcagaggttactgcaccttcaacgacatgtgcttttgactgacccatcaaaacactggtggcaagagcactaaataagttgcctatcatacttaatctttccaggattcaaagaggagtgtagagtgaaatgacctataagacccctgagcctaaaatataatctaatggactcagctttaaagcgctcattgagaggatggccaaaaaccagccgccacagtgcgaacgantnntcctccaccatccgcagtccactcgcacaaataccctcagtgaaacacttctttctctccacccacttttgagtaggatgaaatggcacattccattttcaaagtgggcagcttgcacgtatcagcagtgccaggaatttggaaaacgataacgtggaacccacagtaacttgctggctgaatttactcacccaggtgacccaggtcgatgagggcttcagagccacggggattttaaatgccgcttcaaagccaacaaggagcagaaccagtgctgattcgtgtttatgataatgacatttgaaaggctaaaaattacaaagttgtttacagagatggacttagaaaataattgtatctaatgtctcataaacataaaagaaagttattttgtagtagatgattgaaaagaaaaaatctcctttaaaaaggaaataaatatactagtttcagacagaaacaacttcaaaggcaatcagaaaattcagtggaattttaaagagggaatctcactcaaagaattctctaaaattgcctaaacttaaaagcattatttttctcgag

SEQ ID NO: 11774 - DNA, 1344 bp, Homo sapiens; identical to SEQ ID NO: 11772

SEQ ID NO: 11775 - DNA, 438 bp, Homo sapiens
tatatcataaaatttacatgattggtctttattaaacaatccttcactctcttctcctctgaacatgatgaacctccctaaggaataaagtcaggacattttaagggtttgagcaaatgaatcatttcatcttcaatttcagaaaataggtcttcatgaaagcaaaaggaaatctgattttccaagtgatatgacacatcaggagaaacacgggcttctaaagaatatacacacttaaaaatggattatttacaatttttaagcataaaacacacatcaggagaaacacaggcttctagagaatacacacacttaaaaatggattattcacaatttttaagcataaaacaagacacagtgtgtgcacacacgtgcactgctgatttctgttgctggaggcacggcgctgtcttcggggttgtcgtcattgctagctgg

SEQ ID NO: 11776 - DNA, 438 bp, Homo sapiens; identical to SEQ ID NO: 11775

SEQ ID NO: 11777 - DNA, 840 bp, Homo sapiens
gcacgtgtttgcctgtgttcatgtttgcctgagtgcatgtgtgtttgcctgtgtgcctgtttgcctgcgtgcgtatgtacacgtttgcctgtgtgcacgtctgcacgtgtgtttgcctgtgtgcatatttgtctgtgtgtgtgcacatctgcatgtacatgggtcctgtcattgctgcccgtctcctcccgagagctttctctgcacgttggccctgcctttgcagcttctgccagccccgtggcgccgagtggccttcttcccagccccagtgggcgcagtggggtgggccgtcctctgagggcacccgagctgctgcatctcccgtcttcccgcatgcagtcctcagggcacctgtccatgagccccattcacaggagcagtccccaaggcacctgtcccacctgggccacccttggccctgcgtccgtagccagagcttggagggctttgtccaccaggcctgggaccctgggatccttcctcagagtcccccggcgtgggggcagtgtggagggtggcgcgggtggagggtggcccgggtggcggggtgaattcctggggagagcctgccccctggcggccacctgggagaatgcagggaacatggctgagcagcgtcggctgtggagggagggcaggggcaggggtcagggctgcaggcgtgtccctggggctgatagcggtgggatggggtctggccagtggagggtccatggggtctcctagcaaacgcagtggcgctccttaaatgacggtgccaggcggggctgttctccttggttggcctctgtgtcccttcaggctcccaaggcccctcctcacatcctccctcgaggg

SEQ ID NO: 11778 - DNA, 840 bp, Homo sapiens; identical to SEQ ID NO: 11777

SEQ ID NO: 11779 - DNA, 2585 bp, Homo sapiens
agctggctggagggagcgggacagagcagaggggagggggatcccactggtagcatggatggggcctatcgcccccgacacaaaccagggtctgcccagggacaggtgtgggctgtgtggaggcagaggctggagtcctcagtcctgcatgaggccccactgtttgctgtccttgccgggcggccgggcagcatgttctgtggctcagcctggctgcaacgcctgcccggctctgagtccctgaaacctcgggcagagcctgggctctcggccctggtgagggagaggggttatggaccccaccaccacctcgggcagtggatgggacactctgaggctggcctggctcacaccgtgttggtaggaagcctgacccccactctgttcccacccccacctagggcctgttttttcaaaagtaaccgttttactgagatgtgattcatatactgtacaattcagcctttaaagtgtgcagtaaatgacttttagtacatatgcagagttgtgcagccgtcacctctaattccagaacattgcatcagctcaaatagcaactctgtccctgttagcagtcacccccatcccgactcccagccctggcacccacatccctttcctgcgtctgtggatcagcctgtcctggacgtgtcatagaagtggaatcacacactgtgtggctttctgtgtctggcgtctctcactgagtgtagcgtcctcagggttcattcgcactggggcccgtgtcagagccttgctcctgttcatggctgagtcgtgttctggtgcgtggggcgcccgtgctgcacttgtcctttgctgcgtcatggacgctcgggtgcttcacactcctggccattgtgaattgtgctgctgaggacacgtgtgtgtgagtctgtgtggatacatgtgttcgtttgtctcgggcagacacccaggagtggaattgccaagtcacgtgtaactcggtgtcatcttttgagaaactcgcaaactgttctccatagcagcggtaccgttttcacacccagcaacagtgaatgaggcccagcgtccccgtgtcctcaccagcactcgtgattgttgtctctgattctggcgtcctcatgggtgtgaggtggtgtctcttcgaggtgtctttttgtttgttttggtagagacaggggtttcaccatgttgcccaggctggtcttgaactcccaggctcaggggatcctcccaccccggcctcccgactggccgggattccaggtgcgtggcccccctgtggtttgatgtgctttcccttggtgcccagtggcatggagcgtctttgcgggcttcagggccgtttgtatgttatctttgggcacatgtctgttctgtccgtggcatctcggggaggtgaacatacaggccagaccccccaccacccagagtgtggcttaggagggagacaggccgaaactgggcagtggcagaaaccaactcccaactcccgacctccctccctgccacctcgcacctgcgacaggagcactggagaccggaattagagagcggaggtatgagccggcttcccagggctaaagtgaacatggcgcgagagcacacagtgagaataatgcaaacgatgccaatggcaaaaataacagcagccggccgggcgcggaggctcactcctggaatcctagcactttgggaggccgaggcgggaggatcaccagaggtcaggagttggagaccagcctgggcaacatggcgcaaccttgtctgtactaaaaatacaaaaaaataattagccgggtgtgctggtgcgtgcctgtaatcccagctcttgggaggctgaggcgggagaatagcttgaacccaggaggcggaggttgcagtgatccaagatcgcaccactgcattccagcctgggcagtagagcaagactctgtctcaaaaaataataacggggccggcgtgctggctcacacgtgcaatcgcagcattttgggaggcccaggcaggtggattagctgaggtcaggagttcgagaccagcctggccaacatggtgaaaccccgtctctactaaaaatacaaaaattagccaggcgtgacggcgcgcacctataatcccagctactcaggaagctgaggcaggagaatcacttgaacctgggaggtggaggttgcagtgagctgagattgcgccactgcactccagcctgggcgacagagcaagactctgtctcaaaaaataaacaaataaaaataataacagcagctgacaccacgtccgcaagagggccagaaccattgtgcccatccctgtctacaggcagggaaactgaggcacatagcggccatgtgggttgcccagtgtgaccacgtgcgttacatagaaagcagctaacgggaacctgcgtctgcagatgtgaaagtgatctgggcatctcgctgtaaatggtaccccctaaaaacaaactcttgacagtgaatcgacccttttgctaagttggagctgtttcaaaatgggagaacctttagaacctagctagccaacaggactgggagggctgagtgacgtggtgcggcagttgcagccgagccctgtcc

SEQ ID NO: 11780 - DNA, 814 bp, Homo sapiens
agctggctggagggagcgggacagagcagaggggagggggatcccactggtagcatggatggggcctatcgcccccgacacaaaccagggtctgcccagggacaggtgtgggctgtgtggaggcagaggctggagtcctcagtcctgcatgaggccccactgtttgctgtccttgccgggcggccgggcagcatgttctgtggctcagcctggctgcaacgcctgcccggctctgagtccctgaaacctcgggcagagcctgggctctcggccctggtgagggagaggggttatggaccccaccaccacctcgggcagtggatgggacactctgaggctggcctggctcacaccgtgttggtaggaagcctgacccccactctgttcccacccccacctagggcctgttttttcaaaagtaaccgttttactgagatgtgattcatatactgtacaattcagcctttaaagtgtgcagtaaatgacttttagtacatatgcagagttgtgcagccgtcacctctaattccagaacattgcatcagctcaaatagcaactctgtccctgttagcagtcacccccatcccgactcccagccctggcacccacatccctttcctgcgtctgtggatcagcctgtcctggacgtgtcatagaagtggaatcacacactgtgtggctttctgtgtctggcgtctctcactgagtgtagcgtcctcagggttcattcgcactggggcccgtgtcagagccttgctcctgttcatggctgagtcgtgttctggtgcgtggggcgcccgtgctgcacttgtc

SEQ ID NO: 11781 - DNA, 1595 bp, Homo sapiens
atttttgtttgtttgtctcttttgaccacctctataactcttatggatattcatcaaattctgtatcaaagaatttaagatttagtcagtaaaatatagctatgatatgacacagcacgattctgtgtaaagccagcaaactaaccagcagcctcagaaattttatggttctttctattgacagtctaaggtcctccctggttaccatttccccaaaagaacaatgaggaatttggaggttatgcattctcgcagtctggggatctgtgatagtcactctgttaggtgtttttgagccaccaggttcctcatagcagctttcaaatctttgttcctcgggctgtagatgatggggttgagaatgggggtcaccactccatagaaaatggagatgagtttgtctgcaaggtcctgtttgtctgctcccattgggtccttagacttgggcttcccatacatgaagaggatcatcccatagaagacgatcacgacagtgaggtgggcagagcaggtggagaaggcctttttcctcccctcagctgaggggattctcaggatggtggcaatgatgaagacatatgagacaaaaataaacaggactgggagtgcaaggaagatcatgttggtcacaaccatgctgatcacgttgatgcagatgtcagcacaggccaactttagaactgccaggatctcacaggtgaagtgattgatgacattgtccccacagaagggcagtcacattgctagggatatctgtactacagagttggtgataccagctgcccaggagccaacagccatgggcatgtaggcagccttgctcatgaccacagggtacctaagggggttgcacatgtccaggtagtgatcaaaagccatcatgctcaggagaacacactctgtggctcccatggcaaaggagaggaacatctgtactgcacaggctgagaaggagatggttttcctgggggtcaggaagctgtcaaggatgaggaggttgtatagcagatgtccaggaaggagaggttccccaggaagaagtacatgggtgtgtgcaggcgggagtcaaggatggtcaccaggatgaggaccccgttgcccagcaggatcaccaggtacaccagcaggatgaacacaaagaatgtcttctccagctatgggtgggcagagaggcccaggagaacgaaccccaacacaggggaggcctcattggacctgttcatggtgcatctgctctgtcacctggaggaactcagaggtcaacctcagcatcctcttactccaaaagtacctggaaggccaggcacaaatccttgccctgctgagcaactggagaatagcgctgatgatttgttcatctctatggggttctaggaacaatgtagtacaggtcaatatttaacttctgcttctggtaagaacaaacaggctaatttggactaactgtcttgcagatgaccattagacaaactggaaaaaatacataaaacattggagaagtaataagacaatgaggaacatagggttatgactctggggaaaaacaaggacctagagatgtaagtctagcacttgtggctgtgattcaactcgag

SEQ ID NO: 11782 - DNA, 467 bp, Homo sapiens
cacctcagcctctcaaggagctgggactacaggtgtgtgccaccatgaccagctaatttttgtagaaatggggtttccccacgttacccaagctggtctcgaactcctgagttcaagagatccaccggccacagcctcccaaagtgttgggattacaggtgtgagctaccgtggctgactgaagtttaccaatttacatgttaatctcatccaaaaccactctccaagctgacacataaaattaagcatcatactacctcctaggtctgctgtgtttgcctgacacatagtgtgggctgtgtacatgtttgtgccatttttatgactgggaaaatgacagtgatgatgaggattcctagttctattgttactaataccgctatggagtctgaagtgccaggttttaaaacccaggtgtatcgctcattagctgtgtgaccttgagcaagatcttcaacctcctcgag

SEQ ID NO: 11783 - DNA, 467 bp, Homo sapiens; identical to SEQ ID NO: 11782

SEQ ID NO: 11784 - DNA, 461 bp, Homo sapiens
cacctcagcctctcaaggagctgggactacaggtgtgtgccaccatgaccagctaatttttgtagaaatggggtttccccacgttacccaagctggtctcgaactcctgagttcaagagatccaccggccacagcctcccaaagtgttgggattacaggtgtgagctaccgtggctgactgaagtttaccaatttacatgttaatctcatccaaaaccactctccaagctgacacataaaattaagcatcatactacctcctaggtctgctgtgtttgcctgacacatagtgtgggctgtgtacatgtttgtgccatttttatgactgggaaaatgacagtgatgatgaggattcctagttctattgttactaataccgctatggagtctgaagtgccaggttttaaaacccaggtgtatcgctgcattagctgtgtgaccttgagcaagatcttcaacct

SEQ ID NO: 11785 - DNA, 1262 bp, Homo sapiens
aaaaatcagaaaagaaaattaaaattccccaccaatgataacagccattggtatttttacatgcatccttctgagttttattagtcccatgtatatataaagaaaagttggaatgtactttacagccagctttatatgctgcttttttctctagctcttataaatgcttatttataagcattttctcaacataaattacttttgaaggtttcatttgatggccacgatatgccatcacaattatttttcagtcataatttatgtagctgatcttcattgttacacacatggatgttccccaccatgtggctgccataaatgattctccgatgaccaactctacacatagatccttgtcttcatctctgattatttccttatgatagatttctggtctcatcaggtcaaaggatatgggcatttttaaggctttgatatgtgttatgaaattgccctcctgcaaaggtggcctgggttccactccccatgaaggctcaacaggtttctgaggcctccctcacacctccttcagcatcttctctctcactttcctgcctcagcctcttctccctgggttcccttgtgaaacacaatagtaaaggattatattatcaaatatttaattatgtatgtatctgaaaatattttaaaagtcaacataattactctatttccattagtttgatttgcagcaaattatgcatttagtgtgaagttggaggtgccttgctggttggagtgcagatagcgtttggctgtctacaatgggcgggcgctggtgacaacagctcaggctggtaaagccgtatcaggtccttgcagaggcagggcttcctcccagctggggagcctcagtaccttggagctctgaaatcacaccaacaccacaaatgaccctggggactgggtgtcttagttatctattcttgcataacaaacaaccccaaaacttgtggttgctgaaaacaataaatatttactgtctcacagcttctgtgggagctctccatccgtggccagcagctcaggctcaggatctcccaagaagctgcaatcaaggtggccccatggccgcagtcaactcaggcttgactcagggagaaagtatctgcctccaaccttactcacacgatctctccaaagggctgcttcaggacgtgacagctggcttctccctgagcagacaattccagagaagcactcaggtcggcacgcaaggttttcccatccttttggcatagaagttagagcccagctcgagg

SEQ ID NO: 11786 - DNA, 183 bp, Homo sapiens
aacttttacattaagtctatgatccacttcaaaataatattttgaatattatatttggtgttaggtaggggattgggtgtgctatttttctatatggataatcagttgattcagcatcatttgttgaaaacactatcctttttaatgttgaaaatattgaattatgtcagggtatgtttcagt

SEQ ID NO: 11787 - DNA, 1107 bp, Homo sapiens
attacataaaaacaaacaattctcccaccatattttcagtacagctccgctaatgaacatcctcaaatcataccagacactctgtatttatttttctgatgtacttccctataatctgtttcagattatttttatttacagaaatgattttttccaagattgggaccaccaagaaactacagatgcagacatacgtcatatcactcctctagtcctgaatttataatattatttaactcagtttttctttttacctgagaacaaataaacaaaaataacaaacaccatctcccaccaaaataatacaaacagcaatgaaaaacttttctaagtagctgtgagtcaaaaaggtgaaatttcattgagctgcaaaactaatccagcagttttaggatatgttcacgttttggtaatttagatgactatttctacatttccctatgatccaggataccaagggacctgctgcctgagacgttgagatttagagggctttgtctctgttacaatgactcagagcaaatggagagagtgtccatttttcatggatgatgatgcttgtaaattttcattcatatctttgataactgatgtacttagcaacttccagataacattggttagagttagctctgcttattttggttctaatttagaaggaagacagagaaaatactcattctaagtacctactttttgtcagtaactatggtagctactttatgcactttgtgtccatcagggttttccagagaaacagaaataataggatacacacacaaacacacacacacacacacacacaggtttcacatccatagattcaactaacaggctctaaaaaaattcaaaaaaaaaaattctacaaatttccaaaaggcaaaacttgaatttgtcatgtgctaaatatcacacaaaagaaataacatgtaggcatggtattcaattgaataattaatctggatgggtgtggtacgtcacgcttataatcccagtacttagggagtccaggcagaaggactgcctgagcccaggagtttgagagcagcctgggcaacagggagagactgggtctctgaaaaaaaaaaaaaaaaaaaaaatctagag

SEQ ID NO: 11788 - DNA, 1249 bp, Homo sapiens
gaactcaaacacattacgtggaatgaggggggagtgtatgaaggaatcattagcaacagattagagtccccaccaaagaaaaagaaacaagactcaagggctttttgagctgccacctctccccagagagggctcagaaaaaagatggcctggactctgctgggcagggtggtgggtcatcacccatgaatcaaggacatgaactaacctatatacacctatgccagcattgcagctttggcatttctgggtttgagggatgcaggagcagcaagcttgatgcaaggggacttaggaacgggcctctaaacaaagcttctctggtaagcacaggatctttccttaaattacgtgcctattaaggggtttaggatgccccgcccaagctgtggcttggttcttcttctatacacacacatacattcttaaattctcacatatttatagccctcacatataaacacagtgtctgaaacacaacataagcctttgcaaaaatatgcactagatagggaaggcctgtttgatgcccaggcatgaaagtgtctacttctcagaggaacatggctttgggtcactgtcatttgcacctgcactgcattttcctttctctcatctacatgcagaatgcttcatattcaagggaggtgccacacccagtcagctgagctgtttacacgtagtgggctagcttgctcatgcttacctgctgtgtcttctgttcatcagttctttctactctgttttacagtccattcgtggaactctagctctcaattattgtttcataaatacaggcaggtaggacaaaaatgtggctgaatcattgcaaaatcaaaatattttctgggagaaaaaaatcatagcacttcttctactgacaagtcagaaacttcatgctctcatctatgtgcccatctgtgcatattcctccattttgtacctgtccatgcattcttcttacctctgacaggaaatttccacattctactcttgaatcctccttaatttagtacctgcagaatgtgcctaacagatgcttgataccctaaattacagtcagataaggcaggatgttaggggtccatgattctttggggagattttttgcaagtacatcttccttcctacaaaaggtaaaaaaaaaaaaaaagcacccacagcgttcaagttgaaataactccagcccaatttttatgactccttctctgtacttccaatactcccttcctacaaaaggaaaaaaaaa

SEQ ID NO: 11789 - DNA, 1248 bp, Homo sapiens
gaactcaaacacattacgtggaatgaggggggagtgtatgaaggaatcattagcaacagattagagtccccaccaaagaaaaagaaacaagactcaagggctttttgagctgccacctctccccagagagggctcagaaaaaagatggcctggactctgctgggcagggtggtgggtcatcacccatgaatcaaggacatgaactaacctatatacacctatgccagcattgcagctttggcatttctgggtatgagggatgcaggagcagcaagcttgatgcaaggggacttaggaacgggcctctaaacaaagcttctctggtaagcacaggatctttccttaaattacgtgcctattaaggggtttaggatgccccgcccaagctgtggcttggttcttcttctatacacacacatacattcttaaattctcacatatttatagccctcacatataaacacagtgtctgaaacacaacataagcctttgcaaaaatatgcactagatagggaaggcctggaggatgcccaggcatgaaagtgtccacttctcagaggaacatggctttgggtcactgtcatttgcacctgcactgcattttcctttctctcatctacatgcagaatgcttcatattcaagggaggtgccacacccagtcagctgagctgtttacacgtagtgggctagcttgctcatgcttacctgctgtgtcttctgttcatcagttctttctactctgttttacagtccattcgtggaactctagctctcaattattgtttcataaatacaggcaggtaggacaaaaatgtggctgaatcattgcaaaatcaaaatattttctgggagaaaaaaatcatagcacttcttctactgacaagtcagaaacttcatgctctcatctatgtgcccatctgtgcatattcctccattttgtacctgtccatgcattcttcttacctctgacaggaaatttccacattctactcttgaatcctccttaatttagtacctgcagaatgtgcctaacagatgcttgataccctaaattacagtcagataaggcaggatgttaggggtccatgattctttggggagattttttgcaagtacatcttccttcctacaaaaggtaaaaaaaaaaaaaagcacccacagcgttcaagttgaaataactccagcccaatttttatgactccttctctgtacttccaatactcccttcctacaaaaggaaaaaaaaa

SEQ ID NO: 11790 - DNA, 1249 bp, Homo sapiens
gaactcaaacacattacgtggaatgaggggggagtgtatgaaggaatcattagcaacagattagagtccccaccaaagaaaaagaaacaagactcaagggctttttgagctgccacctctccccagagagggctcagaaaaaagatggcctggactctgctgggcagggtggtgggtcatcacccatgaatcaaggacatgaactaacctatatacacctatgccagcattgcagctttggcatttctgggtttgagggatgcaggagcagcaagcttgatgcaaggggacttaggaacgggcctctaaacaaagcttctctggtaagcacaggatctttccttaaattacgtgcctattaaggggtttaggatgccccgcccaagctgtggcttggttcttcttctatacacacacatacattcttaaattctcacatatttatagccctcacatataaacacagtgtctgaaacacaacataagcctttgcaaaaatatgcactagatagggaaggcctggaggatgcccaggcatgaaagtgtctacttctcagaggaacatggctttgggtcactgtcatttgcacctgcactgcattttcctttctctcatctacatgcagaatgcttcatattcaagggaggtgccacacccagtcagctgagctgtttacacgtagtgggctagcttgctcatgcttacctgctgtgtcttctgttcatcagttctttctactctgttttacagtccattcgtggaactctagctctcaattattgtttcataaatacaggcaggtaggacaaaaatgtggctgaatcattgcaaaatcaaaatattttctgggagaaaaaaatcatagcacttcttctactgacaagtcagaaacttcatgctctcatctatgtgcccatctgtgcatattcctccattttgtacctgtccatgcattcttcttacctctgacaggaaatttccacattctactcttgaatcctccttaatttagtacctgcagaatgtgcctaacagatgcttgataccctaaattacagtcagataaggcaggatgttaggggtccatgattctttggggagattttttgcaagtacatcttccttcctacaaaaggtaaaaaaaaaaaaaaagcacccacagcgttcaagttgaaataactccagcccaatttttatgactccttctctgtacttccaatactcccttcctacaaaaggaaaaaaaaa

SEQ ID NO: 11791 - DNA, 745 bp, Homo sapiens
ggcggcggtggctgcggcggggcgcccgggtgctcggtggcctccgagtacttggtgaaaaccagcggcacagcgatgtccgctttgtccaactggttccagaagcgggcgatgcagcaggccctcgtgatgcacggccacgccatgatgctagctgaaaagccggcctcctctttcttcttgtggttctaaagcaagtctctataatcttccttcagcctccgatcctgaccggccaatgtggttcccaccgttttctacccccgatcagccggagctagttcgccctcctccctcagcgagcacccggggagagctgtcctaggagagtctgtagagtccctcgattaccggtcgcaaacgcctttgggagcgcagtctgctgcgagcgccgaagggtgagacgcacggcgttcccgagtccccggcgagggtgtctgggacgcgcccctccctgcggctgcggcggcgcacagacctcggtcgagcgaggcgacgtgaggagaggtggctacaggcttaagccatggcgcagaggaggggccgggcggtgtggccgcagggtccgcggaccgggctcgagtctccttcctgccggcgtcctagtgcagccggccacctagcagggctgggaggccatcacctccagcggagaccgagcattgctgcctccgccgctgcccgcgaggatgccgcagccgccgccgccaccgcctcttctcctgggaagcgaccccaccctttt

SEQ ID NO: 11792 - DNA, 223 bp, Homo sapiens
gctgggagcttgccttccctccccaccaccctccgccctggcagctcctccctcctctactcccgggcaacagcagaatctggggacgtagtgggttcaagtcccaagctcgtgaggactttctgtccttgtgcttgtcgcttcatccccaggagtcggaggctcctcttttgtaaaatagggccaatggggggggggtgctattaaattttaaaacatggag

SEQ ID NO: 11793 - DNA, 118 bp, Homo sapiens
cgctccgccgggggccgcatcctgctcccgggcctcagcggcggcctgcactggccagcgctcctggctctgcggccggcgcttgggcgccccgagaatgggcgccgacgcctgggag

SEQ ID NO: 11794 - DNA, 1217 bp, Homo sapiens
catgaagatgcaaaactatgagctgatttcatattttaaatgcaagttagcaaaatttaccttctacaattatttgacaagaatttaaagtgcaattgacaaacctttcagaaaaaagctgggaattgggcctttggggtaaggttgccatatttagctaattaaacatacaagtttcccagttaaatttgaatttcagataaatgatgtacaatatttgggacacacttatacaaaaaatgctcattgtttatctgaaattccaatttaactgtgcatctgtattttgcctgggcatcctactttggggtacttcgaggtccctggctagctcctggtctatgtcttagtccatgctcagaagtcccatgtattcaaccagctgcttcttcctccattccagtggttcttttacaggtaggtgaggtcttaaagaatcttttgaaacttttgagccattccccaggagaatatctacatacaaaatttggcatctccagggtatgtgggtcccacgtgagccccaccccacaatggtcggacccaaggactcctcccacagtccatggcactgtgcagatggccagctacgaggaagtgagcatgttggactttgaggagttcaaccagactatgaaacagcaaaatcacaagaccttttttgccttctttgccagttccaaggacattggaggtaacagatatagccccaatggcatgcgggccaaaccagttgtagagacgggctgaagcatgttcgggaagaatgtgcattcatctactgccaagtaggagaaaagccttattggaaagatccaaataatgtcttcaggaaaaatttgaaaggagctgcagtgcttaaccatggaacccaggaaaaactgatagaatctgagtgtcttcaggccagcataatggaaatgttctctgaagattaagatttgatgatggcagtcatgccttgatttcctgctctgttctggtaaactgcatacttggtttgaattcttgttagcaataaataaataaatgatgatgggctgggcacagtggctcccgcctgtaatcccagcactttgggaggtcaaggcgggaggatcacttgagcccaggaggtcgagaacagcctgggcaatgtggtgaaaccttgcctctacaaaaatatttaaaaattagccaagcgtggtggtgcatgcctatagtcccagctactcgag

SEQ ID NO: 11795 - DNA, 294 bp, Homo sapiens
ggtggctcacgcctgtaatcccagcactttgggaggccgaggcaggcggatcacgaggtcaggagatcgagaccaccctggctaacacggtgaaaccccatctctattaaaaacacaaaaaattagccgggcgtggtggcgggcgcctgtagtcccagctactcgggaggctgaggcaggagaacggtgtgaacacgggaggtagagcttgcagtgagctgagaccgtgccactgcactccagcctgggggacacagcgagactccgcctcaaaaaaaaaaaaaaaaaaaagaa

SEQ ID NO: 11796 - DNA, 1532 bp, Homo sapiens
tgtaactgtataatattgacaatcgaacaaacagcttcaatcatgtctattcatatctccaggcaaagttttgttcttcttcctttattttacaaatgtaagcttcaaaggacacatacttttgtggataaacaatttccactagaagaagaacagcaaaggtagctatttaatatatgcagttagagccatgaggtatggatcatagtaaataatattttgcaatgatactagcactaataaagatgatgacatttgcatgattagctatgtttttagtaaagcaaaattaacggataggaatatttagcttgaaggatacatacaacatgctgacaaacaaaactgagtttcagcataaaaatggatatattacacagagagtatacataggctcctaatgtctctgtgtgcatttgtatgcatattattcatctagtattttctttttacttccaagttggaatgcatttacttcatatcttattataagcccatttggtaacacttctgtcagatttcagttgcatattcactgttgaataaatcagtggttaataaatgtccttggaaatgtgtttagagataaataatgaactgctgtatctgatcattaagtgtacatcaagctcacatttttactctcagaatcctaaaaggaagatagcatgacctactatatatgtacatggaaaaaagggaaataattatagagaaaacatgtaaaaggagcctggtttattactcttaaatgggtacatgatagatcaaaataaatgttattacaactgatcaaaaaatcctactgcaaaggaaataataaataaagatggagagtcaacctgtccatcataagtgctttttgttacaaagccaaggacttggagtgtggacccaaccccacagcatgcaaaaccgtggggctctcaggattccaagcctagcatccccaccctctcataggcgcttcggagctgaccgcaggcacacttttaatttgtggcaagatggtctgacaaacagcttgggaggacagcagaggtgaaaatacagatcaagtgcagataaaaatatgttcaccttgaaaaatacaaacaagacttttaggtaataatgcacagggaaatacctatcaaaaaatgagaagaatagaaccactgctttctcattaacagttttcacaatcccttttagcttgtattccaacttctgtccataatccaatatctgcatactccttacatctatacttaaataatatagatttttgtcccctgtacatatcttataaatgtcaatccatcccacctcaaagtttcttggtattcagcaagttttttaaaaagtcaatcatgtaggagatcctttagcaatacttcaaggtattatccctataaaaagtgaagagggatctgaggtcctaaaaagaaaaataatgacagagaatggctgtaatttcatatgttcctgatggaaatctcactgctcagaaaaaaaaagaacacatatgccaaaataaaagaaaaaaaaaa

SEQ ID NO: 11797 - DNA, 1000 bp, Homo sapiens
cttctaggcctgcggaatgcacctctgctgggctggggctctgagttttgtgttttgggccaacctgatcctcatatatctatttggaaccagcgagtctccccagaatattttatcaagttattttgagttaggagtttaatagacatagaagcctttaaggagagtgagtaaatgaagttggcaagggggagtaggcaggggagagaggaggaaatcccaggctaagttttggaagagggcttgattatgttggtgacagcaggctgcatcttccaggacaggaatccccccgtggtttacaaaacacttccccttacataatcctatttaattcacacgacaagcctaagagttagggagggttcatttgccttattagcccgtgtttacagatggtgaaactgaggctcagagaggtgctgagatcacacagcaggatcatgcagcagaccacgggcagggctgggattccggaccaagcttggcattcttttcctggcaccacagtatttggctttcacaattttaatctggaaacactttaactacgaattttcattttgaagtcatgtctcagatggattcataacagtatagtgatccataaactataagaatactaggatttttattgctcaggactttagtaatactctaattactaaaaacggaaactaaagtggtgacattactactgcaagccctctgtgttttccactcctgagttagatgtcactggtggtgctgtagagggggctgctggagcactgtccttcatgtgaaagggggttccctttgccctttttgggtgcccacccacaagcttctctgtgctctgcttcccttcgctctccaagatgctaccttagagctactggagccactttgttcaggcagagggctgtacgtgccctagggctgatgtgcccctggaaaggtttgcagctaaggactgcctggagcagggatatgaaagcccagctttctcggctcgagg

SEQ ID NO: 11798 - DNA, 1000 bp, Homo sapiens
cttctaggcctgcggaatgcacctctgctgggctggggctctgagttttgtgttttgggccaacctgatcctcatatatctatttggaaccagcgagtctccccagaatattttatcaagttattttgagttaggagtttaatagacatagaagcttttaaggagagtgagtaaatgaagttggcaagggggagtaggcaggggagagaggaggaaatcccaggctaagttttggaagagggcttgattatgttggtgacagcaggctgcatcttccaggacaggaatccccccatggtttacaaaacacttccccttacataatcctatttaattcacatgacaagcctaagagttagggagggttcatttgccttattagcccgtgtttacagatggtgaaactgaggctcagagaggtgctgagatcacacagcaggatcatgcagcagaccacgggcagggctgggattccggaccaagcttggcattcttttcctggcaccacagtatttggctttcacaattttaatctggaaacactttaactacgaattttcattttgaagtcatgtctcagatggattcataacagtatagtgatccataaactataagaatactaggatttttattgcccaggactttagtaatactctaattactaaaaacggaaactaaagtggtgacattactactgcaagccctctgtgttttccactcctgagttagatgtcactggtggtgctgtagagggggctgctggagcactgtccttcatgtgaaagggggttccctttgccctttttgggtgcccacccacaagcttctctgtgctctgcttcccttcgctctccaagatgctaccttagagctactggagccactttgttcaggcagagggctgtacgtgccctagggctgatgtgcccctggaaaggtttgcagctaaggactgcctggagcagggatatgaaagcccagctttctcggctcgagg

SEQ ID NO: 11799 - DNA, 818 bp, Homo sapiens
cttctaggcctgcggaatgcacctctgctgggctggggctctgagttttgtgttttgggccaacctgatcctcatatatctatttggaaccagcgagtctccccagaatattttatcaagttattttgagttaggagtttaatagacatagaagcctttaaggagagtgagtaaatgaagttggcaaggggagtaggcaggggagagaggaggaaatcccaggctaagttttggaagagggcttgattatgttggtgacagcaggctgcatcttccaggacaggaatccccccgtggtttacaaaacacttccccttacataatcctatttaattcacacgacaagcccaagagttagggagggttcatttgccttattagcctgtgtttacagatggtgaaactgaggctcagagaggtgctgagatcacacagcaggaacatgcagcagaccacgggcagggctgggattccggaccaagcttggcatctttttcctggcaccacagtattccctgcaagccctctgtgttttccactcctgagttagatgtcactggtggtgctgtaaagggggctgctgaagcactgtccttcatgtgaaagggggttccctttgccctttttgggtgcccacccacaagcttctctgtgctctgcttcccttcgctctccaagatgctaccttagagctactggagccactttgttcaggcagagggctgtacgtgccctagggctgatgtgcccctggaaaggtttgcagctaaggactgcctggagcagggatatgaaagcccagctttcttggctcgagg

SEQ ID NO: 11800 - DNA, 973 bp, Homo sapiens
agaaggcaggggccttgaatgaacaaacgaacctgactaggggctacatgaaagccatactgtgcttcctcctccttctcatgaatccctttcctcccttctcttttccatcccccatagatcagaaatgtgaaggcggttaggaaatgtccagactccaaacagaaaaaactgtgatcctcagcagacacaagacataatattggattatctgcagcttcatcctgggaaaaatataggagactgaagggaaacaggaaaataagtaaacacccatagaaaaataaaatgtaagataaaaactgaaatgtaagaactatcacatggtgagtgtctatattcactcataatagagtaactacaaaatcataagtttgatatttaatcctaatgggggtgaataatttttttaaatgttgctactgtcgtgataaaacaaattagctacatactgacaaagtaaaagcgtgttttctaaaattgaaataattctcaaaataacagtttagaaaggctgcacattttacaggaaatgggttgaacatcacatgatttactcattaaggagataattattgagcgcctaaatgaggaaaaaagatttatagattttaaacaagcatccaattaactaaatattactgagtaaaagaaaaacaagttaatgatacttttgtaccaattttattataaaatgtatgtgaagaaaggctattttgtcaaactgtttttccgtatcatgtcatattttatatttacagcaacatcctgaaataggaatttctgaggatatgcttcccatttgagagatgaaaacctcgaggcacagaaataccataaaattgtctaaattacacatgcaaattaatcttggggctagaacttgatggaatatctatgttcttagacaatgctaattgattataggaactgcctttaggaccagaacaagaatctaatgtctaaatggtaa

SEQ ID NO: 11801 - DNA, 973 bp, Homo sapiens
agaaggcaggggccttgaatgaacaaacgaacctgactaggggctacatgaaagccatactgtgcttcctcctccttctcatgaatccctttcctcccttctcttttccatcccccatagatcagaaatgtgaaggcggttaggaaatgtccagactccaaacagaaaaaactgtgatcctcagcagacacaagacataatattggattatctccagcttcatcctgggaaaaatataggagactgaagggaaacaggaaaataagtaaacacccatagaaaaataaaatgtaagataaaaactgaaatgtaagaactatcacatggtgagtgtctatattcactcataatagagtaactacaaaatcataagtttgatatttaatcctaatgggggtgaataatttttttaaatgttgctactgtcgtgataaaacaaattagctacatactgacaaagtaaaagcgtgttttctaaaattgaaataattctcaaaataacagtttagaaaggctgcacattttacaggaaatgggttgaacatcacatgatttactcattaaggagataattattgagcgcctaaatgaggaaaaaagatttatagattttaaacaagcatccaattaactaaatattactgagtaaaagaaaaacaagttaatgatacttttgtaccaattttattataaaatgtatgtgaagaaaggctattttgtcaaactgtttttccgtatcatgtcatattttatatttacagcaacatcctgaaataggaatttctgaggatatgcttcccatttgagagatgaaaacctcgaggcacagaaataccataaaattgtctaaattacacatgcaaattaatcttggggctagaacttgatggaatatctatgttcttagacaatgctaattgattataggaactgcctttaggaccagaacaagaatctaatgtctaaatggtaa

SEQ ID NO: 11802 - DNA, 212 bp, Homo sapiens
atcccagcactttgggaggctgagcggggtggatcacaaggtcaggagatcgagaccatcctggctaacatggtgaaactccgtctctactaaaaatacaagaaaaaaagaaattagccgggcgtggtggcaggcacctgtagtcccagctactagggaggctgaggcaggagaatggcatgaacctgggaggcggaggcttgcagtgagcc

SEQ ID NO: 11803 - DNA, 577 bp, Homo sapiens
ctcataacaaaggccagaactgttacaaacacacatacctccccacacacccaaaacctgaacatgtcatcttcctacttacaacccttccatggcttcctactgtggttggattaagaccaagacccttgcgtggcttataaggtctgcaggttttggctctgccaacctgtctagcctcctggccctctcaatcagcttgctgtttccctcatttgttacacaagtttcatttttaaaaatgcatcatgggctgtttcctcctcctggaacattcttccctccctttcccctgacctgtcaatttctattatccttcatttccctgcttaaatgtcactgtttttgaggaagccttcaaatccccagattaggtcagaatcccctaacacactcactcttttcgcaccccatacttaatttttgtattatttttctccaagtgaacttaaataaccatataactgattaaaattgttctcccctgccagaacaagacccatgaggacaggagacccttttgtcatggcttctgtagcacccggcatagtgcttggaatagaggagacactcgaga

SEQ ID NO: 11804 - DNA, 2045 bp, Homo sapiens
ttcttcgtggctaactgaagaatgaccaatttattttgaatagaaaacatgcagacagaaaaactatcatgaaaatttaaacatgtgaacagagggtaggaattttaaaacggtaatttttcttagaactttaaagttcaagaaaaataccttaaaaccaacataaagaatagcaggcactgtactaagcagttcacccacagtatcatgttttaatctcaccacagccataaggcggtaatagcatgcatagatatcattccaatttttcctgttgcaagtaacagaaaaccagaccccatctggctgaagccagtaagagaaaagactaacaggagggccagcctcaggactcaaatacgtcaccaggacatgggttgcgtcccagtctcagctctgccagttcctgtagaaccctccttccaaggttcacagggtggctaccatagcttcaggccctcacctcatgataagacagcaatacaactgccatttcatgtctgttgctgtttctacattcagttagaattaaataaattttccagtagcacccacaaaaatactgagtccacctggttggcctacctagatatatcgccagccctgatcaagtcactggtcacgggcctggattttctggttcgcttaggctaatcatacgtcccatcccaggactgaagaagtaccagggctgttgctggagagtggctaatgtcccctttacaaataaggagctcatggtttaggaagatgagcttgccaaaaatcacacacttgtaaaataagtcaaaatttgaacttaagtctacttatctgagcccaaagtcttacaaccatttatggctgttatcctaacacctacgtcgcggaacggaagagtcctaagactgcaaagacccttccttttcttctagatccagtctaagttggttggtaatttctttagaccctgctttcagggaagtttaaaaaaaattacttgcatttgtatattttccttgtattttcggccaaatttcttctaattaaagtacaacataagttgaaccaacacaataattgtcatattaagaaaagataaaacaaactttactcatttctgcttctgggcatggagtgtgagggaccagacttaagttctcaaacaactacaaaatcagaccaaaaaatacaatggtttccaggcaccggacgacaggcagtgcagggctgtgatccttaagagaagggaagcagcgagccagagtatccaggccacaacccaaatggaggccaagagaggaacagcagaggatacagagggagggttccaggggccaagacgcaatccgaggggaagcccttccggggagagctggagtcctggggtggccttctcgagtcttcccgagcaggtctgtgcagcgaggaaacatccgaggctggagtgagccacgcggaggaggaagaacagcccgagctcacaggggcggggaagagttctagctcgcgacagcccctgggaggaaccctgcactatttgtggcgtcgagtaaagcaccggaaggctctgctcaggagcgtgaacgacaccgcccgctgcaagcctggaaaggaacgcgttgcctcaattcactccgatgtgtcacacacgcggctcagtcacctagggagcaggaaaaggccagcgggccacgcagggctcacccgggcctgcatccaaacgcaaacggccaggcccacgaagcaggaaacacaacccgcaacgagaagcaaagggatccacagagaagggccaggagtcacggacgacgccaggcagtcggcgcctgcgcttccgcgagccaagacgcctgagcggcgcggggggatcgggggatcccccagaaaactgccctcgactaacagcgcagcgaaggggcggtgcgctcgagaccctggaacgggaacgaccacagccaccgcagggaaacaaccggggcccaggcccaggtgggcgggcggctgaggagcgtggctgcgcccacaaagccgccgggggctgcggactacagcgaagccggcgc

SEQ ID NO: 11805 - DNA, 18671 bp, Homo sapiens
gggaaaaggggcagacgtccctgggttccggtgttcgcggaggagtcgaggcacggagaggcttcgggggagggacggaaagaagggtggcccgccaggcgggcggggtccatggattcggggtgagggccgtccgcggcctcgctttcgcctcctccgagccgggccggcgatggccgcagctgtgaggcgaggtcgggtcccgtagcggcgcgcagcctccttgggggactcggggtcctggttagtttccacagctccttctatctgaggggtacgaatttacggctgcctaaagccttagaacagtgatcccacgtcggtaattttagaacccggtaggaccggctgccatcaggggccccaggtgcagggtggtgtcagctttgagaggaattggagcctcgtcaccgcgcgcttcctgcatgagtggaacctcagaaaacggtcagcggggttcagaaggcaggagataacaccaagaccctacgtaggattgcatctttacgtcgtaggcttggtctcgtgtatttttattgagcgtgtttaattagctgaggttactcgctttggcaccccagtgatcgtttttgccaccaagctctgcctcttgagcgtttaatactgggatttacaaagcaacgggttcctgttaatcttagctttcaatactgggcaagggttacgtttctaaccctaccagtgccgcaggctcattatatattgaaggactcacctggtatttggttttctcatttataaagtggagttggagtaggtacttgaagggttttcaatacctttaaattctgaattttaaactctaaaacttaatgataccgtaggactttaagagagtataggttttaaaagctcttaccttgatattaatgacagtggtctactgtgtagaaacttgagattaaattgcagactgcagctatgaccggaccatttttagtgtgatgcaaactgtatcttctgcaggttataggcattttggaagcaggaactgagaaaattctggcagtgatctttcagtattttaaattccaccatttctccaagttcagttgtcttgatgagatacagggtggaacttatttcaaacatctcttgatgccagaattgaacgggaacagaaaagggctgtagtaagaaccatcatcaaagcctccaggacttgagcagcgactgacgtttttacttctaaccctggatatctcagagatttggttccactgtgcttttctatctctccactcacgccttagtgagtttgttctttcggttggagtaatttaatacaagtgttagtccttagaaatacattttggattaatttctttctatttttagagttaggccctcaacacagtaagtcttcacttaacatcatccataggttcttagaaactggagctttaagccatgcagtgtacaaggaaaccagtttcaccataggttaattgatataaataagaggaaagttcccacagcacattcctggtcacaaaaacatcgccaaacttctaaataaagaccaaagcacttctaatatgaaacactgaagtacatatgagctctacatttaagaaatatcattacccaatttctggtgaatccatgagtgaccgggttgtggaggggctgtgttaaagataatgttggccaagccaaagctctgaagcacctccccctaccatgcagtttcaaaacaaacaggagccacttctcagcccgctgggcctttcttactgcatcgggtattgtcctgcatctctgtgtgaataccgtatgctttacgagtttttatttgacaataatttgtatcctttcattttccaacctgcttattccagttcagggtggcagggggctgagcccatccaggcagctcaggaccaaggcgggcaacagtcctggagaggacggcatcccatggcagggcacactcacactcactcagacggggacgccccagtgagcctcacgtgcacagctttgggatgtgggaggaacccggggtacctggaggaaacccacagcacatggggaggacgtgcaaactccaaacagacagtggcccctgctggggatcaattttttttctcatcagcgttatagggaaacaacattagaagaaatatgttcaagggccttctgtgccagttcctagattacttgaataactttctatttctcctcatcacagtatattttgaatacatctgtcttcataaaatacaccatgtccaaaatctaaaagggccaattccaaattattccaccagctttgaagggaattgaagcaagaataacaagagtaagttctgtgtgaaaagacctactttagatacttcaaaggttgtctcattaatccttgcggcaaccctgcaaagccagcgttattatacctgctttatagatgaggagcctggggctcagctgtgtccagtatcttgcgcagcaaagcggtagagttcaattggaactcaagttggtctgtccccatattctgtacttctgtgttctggacagactgaagttagccagtgttcctcttgcgttccagtttcttcattgttccctttctccccaaaataagcatatcatgctgatttccagcctgccagttctttcctcctacctgtaatgtgccatcttcatttccctctgtgtatctttcaaatgccagtttaactggtttttccaagtctccagtgttagcctgaagttttgtagtacttatgtatcatgttatatttagcaatggattaattcatagtaattaaccatttgtattaatgtgtcctcaggagctcaggggtgaactatttgaggacagggatgagtcgaagcataactgacttgagttcacccccttcctccagaaccagaatgtgtagcttagtgccaccctgtagcaggcattcctgctgcttcaggatctgttagactcttacagagcatcctcacaaacttcatggtttttctgtgcactgtaactttgactttctgttgaccacgtctttgcagcagaagaatagaaggaaggtgataggatgtgatgatagaatttgtgatagccaagcaacaacttttcctaattcggcatgttaaaaaataaggtacgctattcttttcttaaacatacacgttatttgactcatgaaatgtattttaattcagccatttgagagtataaaaactagtttgcaaaccctgcttgaactaggaattgtcagcaggaatgggcgatgccaagtgtcgcatggggcagtggacaagccaatggaaaaacaatctctggcgatatttactgcaagcatctcttagctgtttggtgatttttattctgcacaggaaattattaagttttcacaaaaaggcataagctgaaatggcaggagtctccttagtagttgcctggagtctaatttaattatagtgaagcagcgtgggtttgtttaggcatgcacaggtttatgggtcataatgaatttattcatattataattaaggctttcataattaaatgaaaagatattcctgtattgttaacataaatgctgagacaagggtctgctcctacttaggtaacaatgagtcaagcattccttactatttgatttggttgtatgtgccatcaaggttgagtattgaagcctcagttctcttctaaatgatatattacataatactcctctaaatatgacttttttcctactttttagggtcactcatctaagaaagataacttggcagtcaatgcagttgctttacaagatcacattttacatgatcttcaacttcgaaatctttcagttgcagatcattctaagacacaagtacaaaagaaagagaacaaatctctaaaaagagatacaaaggcaataatagatactggacttaaaaaaactacacagtgccccaaactagaagactcagaaaaagaatatgttcttgatcccaaaccgccgccgttgactttgggtaagctgacgtagtcattcatcttttggcttattagggctaaaaaaatctattgagattaatagtataattttttatgttacagaaataacttatttataattatacagagaggtgtgtatgtattgaaggtatgtatgtattgaagtttaaaaatgataggggaccattagagcaagaaggtaaagatagtaatggtaagtagaataagtaaaaatgggagaacaaaagaaatatctattgattcacattgataaaaataaataattgagtaaataaatgatggaaaagaaaaatcccttatagtagaatgaatataactcataaggatagtagacggggatagaaaatcacctttggcaaacaccacagtaatgatcatcaatactgaaattaggaatgagaaaaatttacgtacagacacagaatattgaggtagtttctccagagatgcaagtacatggcagggagaaaaacaataacttcacaattacttcagctgtacagttgtaacgcttggcaagcagcacctgaaccaagtaatcctagttaggtcagcagtaacgcacgggccagcatcatgtgtctcctgctgaaaggtacaacatcacttctgtggcattcttaccaaaatgtatatctgaatttaatcatgaggaaacctcagaccagtccaagtgaaagacattccacacagttcctggctagtactcttcaaaagtatcaagtcaacagaagcaaatgaagacctagcaactgttccagattacaggagacccaggggacatagctgcaagtgcaatctgtgatcctggatcagatcctagttcagaaaaaagacatcagtgtgacagagaaccagatctgcagaaggcatgtaggctaattgatagattatagcaacattaattttgtggttttgatctttgtaccagggttatataaaaggttaacatttggggttaagaacatacgataatattttctttttgcaagtgtgaatatgtatttagagtaagaccaaaacttgcaacaaatcaggaatttcaaaacaacatgaaatgtatcccaaacaaaaatcaataaaaatagcataatattttgtattagttagctgcctgaaatatctctgtaatactttttccatctcttttgattgctagatactctttgatcatattttcatgtgacaataattctgtaatgtcattctctatagaaataagtcagccttacctccgtcatggctgattgaaattctttatgataggtgggatgcatatagcatgcaacttcacacacattcttactgtgtatggtattgctacaagtttgtgcctgtaaataaaggcatgcaaatcaattccatttcttctaattaataaaaggagatgtattatgcacttataattgtaaatgctgtttttaaggatattcgtttcccagtgctgccacaagcaattagtacaaactgggtgggttaaaacaaaagaaatgtattctctcagtgtcctggaggccagaagtccaaaatggcgctgttggcagggttctacagaagaatcctaacttacctttccctggtggttcctggcattgcttagcttgtggcagcgtcactccaatctctgcctctgacttcacaaaaccttcttctctaggtgtgattgtactctccctttcctcttcttataaggataccattcataggatgtacagccaactttaaaccagtatgacctcatcttaactacatctgcaaagaccctatttccaaataaggtcaacatccagaggttccaggtgaataagaattttgagatgacacaattcaacccagtacatcaagtatgtccctgataggggagaacttccatttagattaggcatcaatgagaacggaatccttcacttacatttgttgtctggaagactttttcacagcatcaagctaagtacttttcatactttgttccttatccactactcacatatattactatgttgataggtaccagaggtcttttgatagctcacagtggctaggctatggtttgaatgtttgtcccctccaaaactcatgttgaaatttcattttgttttgttttttttgagatggagtcttgctctgttgcccaggctggagtgcagtggtgcgatcttggcccactgcaacctctgccttccgggttcaagtgattctcgtgcctcagcctcccaagtagctggaattacaggtgtgtgccaccacacccagctaatttttgtagttttagtagagatggggttttgccatgttggccaggctggtcttaaactcctgacctcaggtaatccacccgcctcagcctcccaaagtgttgggattaaaggcgtgagtcaccatgcctggcctgtttttttttaattttttgtttgttttttgtgtgtgtttcttcttttttatttatttttatttcaatagcttttgtggtacaagtggtttttggttacatggatgaattatatagtggtgaattctgagattttagtgccaccaccagagtagcctaccctgtacctaacgtgcagtctttttatcccacaccctcccaccctccgcctcctgagtctccaatgtccattataccactgtgtatgcctttgcatactcgtatcttagcttccacttataagtgagaacatacaacatgagttacttcacttggaataatgacctccagttccatccaagctgctgcaaaggacattttttcattcttttttgtggctgagtagtattccatggtgtatatataccacattttctttatccactcattggttcatgggcacttaggttggttccgtatctttgcagttgtgaattgggctgcaataaacatacgtatgcatgcatctttttcatataatgacttcttttcctttgggtagacacccagtagtgggattgctggatcgagggatagatccacttttagttattcaaggagtcttcatactgttctccatagaggttgtactaatttacattcccaccagcagtgtataagcattctccttgcaccacatcaacgccaacatctgttgttttgtgactttttagtaatggtcattcttgcaggaataaggtggtatctcactgtggttttaatttgcatttccctgatgacgagtgacgaccattttttcatgtttgttggccatctgcatatcttcttttgggaaatatctgttcgtatcatttgccctctttttgatgggattatttgttttttttttttcttgctgatttgtttgagttcctcgtaggttctggatactagtcctttgctgagaattcttcatactgtttttacaaccttttgtaaatctgaaattattttaaaccgaaaagttagaaatatgattttttattgataggcatggaaaataggtttggttgaggatggcgtgtcttggcgcaggtcagatggatctggaggtgctggaagatctgtgtgttggagtcacacaaggtggaggggacctgtttccacagcgacgccaggggagatatttgatgctgtcttcctctgaacttctgctaacaagctcgatgtcttctagaaaacagcatggctcatgaacgtgttgagacttggaataatgtcgtacagtagtttagtgaagatcttctgttgtacctgtatggtttatgtagatgaccaaatagtttcatcataatcaatcttaagagttttatcaggaaaaatttaaattagatataaagaggaacgtcccaatttggaaaataagtaaagttattaaggaaaatagatgagaccttttttcaggacctctttatggaaaaaatcttgattgtgcgtattagttactaatgacattgaaccatatgctctttactgtctatacataatattccacttggatttctgtcttttcttgctgatttactggagttctttgcatattctacatagtaatctcttgttgatttagccactgaaaatatcttctgttcttttaccatcttttaaattatatctattgttttatattgaatacaattttcattctgattaatgttaaatccattgttttgttttgttttgtttttttcactttattgctgtttgggagagactttagatatacttcaccattctgagagtgcaaagattttcctacattttctttatttacctttaaccttttacctttcacatttagatgtcaccacagtttgttttgcttatgatactgggaaaatcgacgagattaaagcgtgttttgttctctccttccaaggcttctgcttctatgtcagtattgcactgttttgattaatagagtcttgcaatatgtcttaatagctgctaggaaaagacgtttcctctttttttttttcctaaaactgcctcattttctacataaaattctgctggagattttttttgaattggatttatagatcggggaaatactgtatttacagtgttatcatctgatccacaaatatggtagcatctcacaccatttaggtctttttgtctctgattcctaggggttttctgagtaagttgatctctgcagtgattcttattgtctgtgcctctctacttttatgccccttcttttttttccctgctttttttttaatctggccaggatctcctgagctgtggtgaatacgagtagtaatacctagcatttctgtctcgttccttagcctaacacgtttcatttacttacttatgtgatgtttgccctttgtttattgttgttttgtgttgtttgttggcctttatctaattataaaatttcccttttagccagttgctacaggtttttaaactcattaataggtgtacttttttaaatgctttttttcctgcaactttttagatgagcgtgtttgttgtgggttttctccttgagtttgtttgtgccgtaaattacagtgacagactctgatgttgaatcttcgtgcatagcttgaataaaccctacttgcccacggtgtttttcacattcactgttgcattctgataactaattctcgtttacgatgtttgacgtttaaccatggattaccctggactatgattgtccttgtctggttttattatcaaagccatataagcttcaccaaataagttgggcagtgttccctctttttcaggattctggaataacagaaaatagggatgatatgttccttaaaagtttggggaaactcacttgtaaaatcatctgggcctgaggctttttttcctttaagcggggtgaggagaggtgatgggttaggatgcatttggctgcaaatatacaagcaacacactgaaagtgatgtaaagcttaatggtgtgtgtcattgttcacagcagttctggtttggtggcttattgatgtttgccgggaccagcctccttccggtgctgccgtcgggaggtgctgccccgtgcatggacacaagagggtgcacagccccagggtcagtcctcaacaacaagggaggagccagaaaggcaggggagaaagctcccaacagaccttccttccgcttcacctgagacggtcacatgcccattgatagtctaaaaattggcaaagggtagcaagacttccacgacatgcttagatccatcaagagacctctgtgaggctgagcccatttccactgacgcgcagtggggttctaaaggcaagatgggtgctggacgtgctattgattttaaacattattacattgtggccagagagcacagcagtttgctgaaatctgtcaatacaatttacctattctccctcccgttctaaggtcttgattagtttataaatataaggccaggtttgcatgatggggagatgtggatgtttgaagttgaggcagttgacattgaccatagcagagtctggattgtacagcaagtgcccacccaagtctaagaggaagggtggtgctgggggccctgtctctccctgctcccacaccttgagccaaaggcaaagagctgccctgaggcagcgcccctcctccgcaacctcagtctcagcctcttcagtcttactgttcatttgtttctctgcaggccaggtgctctctcactaatggccatctgcacatccttttcctccatctagaaaacctcccccttcacctgctgctgttactcttaaccctgcgggtctccatttaatgccactttggtcaagtaaccttctctggggtcacagccccatgcatcctgcacaccattctccatagcgttcatcacacttgtagctgcttgattcttatcagaagatccatgggcatagttttagaagtaaaattgttctatgaggattataacagaaagtgtagcattcccctgacccattttgggcattactctaaggcagccattttcaaatcctttggttcattcttctggtattatttttaatatttcttttttttttttttttgacacacagtcttgctctgatgcccaggctggagtgcggtggcacaatctcggctcactgcaacctccacctcccgggttcaagcgattctcgtgcctgagcctcctgagtagctgggattacaggtgtgtgccaccacacctggctaatttttgtatttttagtagagacggggtttcaccatgttggccaggctggtctcgaactcctgacttcaggtgatccacccacctcggcctcccaaagtgctgagattacaggcgtgagccaccatgcccagccatatttttaataattctaaataacatgtctacgctgctgttttgttaattttcagttctggatatctcttcttactgcagaagatcgagatttagcatattgttttcataacttgtggttagactaataacattcagtgtttactctgttacaattccgtgacttcactcacagctgagcaatgtggtgttctatattacagtttccttctcagacatttttctattctacctgaagttctgtctcattttttcacattttagtttcctctatcatcactcatcactgattcatccctaaaatctcctccagaaatacattatctcaatacattaaaatataccagggcactttatcaatggggacgttgcttctggaatcctccgtggtcccctcccccggcccctccccgggctccctcttgagcagcatcccgggaccctgggctctctccttggattctgtctccctggacctcatggcggcctcctccttggtttcttccctcgtagtggcgacgcttctctgtcagtagctccctggaggagtgcggaggagacccacacagaagctcacatgtgtaacaatgtctttgctcttttctcacatttgattgatagctaataaggaatcttgatatggaaatctttccttcctccgaattttgaaggaattgtcttctcctgtctgttgtgctgtggatgagtctgatgcagttctgattcctgatccttttttgaggcctgtttttttgagtctgctttctgtctccgagattctcacagtgacgggattcgatgttctgagtacttactgggccctctcaaaccagaagctcatgtcctttgcttctgggagatgttttggactattttctttaaaatttttactccccattttccatgttttctttctaaaatgccagtttttcagatgtcacaacaacacctagaccggtcccttgattttcttattttctgtctcctgatatatgtttttctgtgagattacagtcacgtgccacatagcaatgtttcaatcaacaataaaccacagtgctcccataaaattataatggagttgaaaaattcctaccacttcatgacgtcttgatgactctgaccctgtgttggcctaggctaatatgtgtgtttgtgtcttagtttttaacaaaaaagttaaaaaaaaaagatttgagaaatagaaaaagcttatagaataaggataagaaagaaaatattttgtattaactgaaaaattagctgagcatggtattgtgtgcctttggtcccagcttctcaggaggctgaggtgggaggatagcttgagcccaggagacacagcctgcagtgagccatgaccacatcactacgtgctagcctggacaacatactgttttaagctaaatgttattgtaaaaaatttaaaagtttagagagtaaaaaagttataggaagctaactttaatttattattaaagaaaatatatttttataaatttagtgtagcgtaagtgtagactgtttatgatgtctacagtggtgtacagtcatgtcctaggccttcacactcactcagcactcactcactgactcacccagagcaacttccaggcctgcaagctccattcatggtgagtgccctacacaggtacaccatttttaatcttttatacatatttttactataccttttccatgtttggaagcacagatccttaccattgtgttacagttacctgcagtattcagtacagtaacatgctgtgcaggtgtgtagtctaatcagctgtaccgtgtagctttggtgtgtggtgggctgtaccagctaagcatgtatacatatgctgtgatgttagcaagatgacgaaatcgcctaacagcacatttcttaacaacaatcgcctgttgttaagcatctcaggactgtatcttagctttctcttccagcctttcagtggacgttcacatttctactctaaaagcccaagagctctttctgtactcgaaagtgtcccttcatagttttctgtcatgttttgtcgatgtaacattttgtcttccatttctgaagatatccttgtaagtcgatgcttttttatgcattgacccgtctttggggtgcggggaggtggtggaaggtgaacttcgcttcctgcattttgcctgaggatgttgcagttgctttttcaaagtgagtgtttcccaccgcactatcagctcgatgccgagacagcacatggtgggtacccacgtgttattgaaataagaactttattctgaccgtgatgatacgtcatagaaagtttttagcaggggaggtgcagattgatgtagaggccactggtggcagagcaaggtgagctgggagaggcagtgctgaaggctgagggctgaggcaggtgagaactgggagaaacttgggccaatacgtgtgaacaatgagtattcctcagtttttctttcataaacttggatatcactcctgcttgccttattgagttattgggaaatgaaataagatatgggaaatgctttgtaaataaaaaataaacgtattgaaaatgtcaggtattattaccactgacttttgcgccctcatagaaaaacggcatcctatatacagtccaccatttgtatccgtgggtttggcatccacagattcaaccagccacagatcaaaattttaataaatgaataaaaaataacaatacaacaatataataaaaataatacagattaaaaacaatatagtataacagctatttacatagcacttgcattaggaattattggtaatcgagatgactggcagtatacaggaggatatgcatgggttgtatgcaaatactccaccatcttctatcagggacttgagcatccttggaatgtcctggaacacattccctgtggataccaatggacagcttctattgtgaaataaagtatgtgatctatatgtagttctttaatctttgtttgcaaatggtgtcattaaagttataggtgggtgccatatgctaaaagacactctaactcctgtcctgtgctgtcttactttagcacagaagttgggcctcattgggcctccaccacctccactgtcatcagatgaatgggagaaggtgaaacagcgctctctcctgcaaggggactccgtgcaaccatgccccatctgtaaagaagaattcgagcttcgtcctcaggtgtttagcatacgagggtgagctagagagctcctgggctgtttcctagggacgaggcccagagctggagcctaagattccaagcttcctttttccagtttcatcctcctgtgtgagcctcacacacttccattttgttttccattaattaaagtgtgtgaagagctaaacaccctcattaaatagttttgtttgtttactaactggtattctcaagtactaaagtttgtacaaaaggaatgtttctgttcaacaggccccatgcggctgtgcagacaactggggggcttcccaggagcagctgtgtcccagcgcgggaaggatgaaagcagagggactcttaagtggttttgtgatttgagtcagaaaagaaaaaaaaaactgtgcttgaatgtctccaaagaatttgtgagagaatctttaagaaaagtaaaatcttttaatgatttttattcatgaaactttaccatagtaagactgatgatactactctgggttaacagataatatacacgcgcgcgcacacacacacacacacacacacagagagagagagagaatgcatatatatatatagagagagagagagagaatgcatatagggttttttctatacatattttgtctgcctaactaaactattgtcccctgaagttggggacacttagatttatcagaagtgtgtgtgtgcgtgcacgtgcgtgcgtggttgccctgtaacaatttcccacgtggtgtggcattacgcttcctgcatagcaggccctcagagatttgctgagaaaacacagcaaatacagttaaaatcagccttggagtttgtagcctaggaacccaggcttattacaatctgggcaaatgaactctgagtcttcattgaatttgagtaggtttcatcagcaagaaagctcacaacagttacacttctattcactaatttgaattcataagttactttagacatacttattatattccagttctctatcaggacctaatcttacatatgtgaaagttgggtattttggacagattttagccctgaaaccacaaattgtctaggataatttagtaatttaatgtagcaaaactgtgaataaagccagagggtgtctttctggctaagcaccctctttcttacttatactaaaatatccaacccgagtgtctgtatgaagaatgaaaagtgaaagttactatcttatggggatcagggtgtaccctgcccaacatttctttctgatttttataaatttctcactaaattccattatttttacttggttttgatataagacccatcctgtatattttgcatttccagtgatcatttccatgttcagatttttccttagttataaacaatagttggcatttttataacatttagtgatttcagagggccttcaattaattccgtatagtaggcattctgcccatttagcagatgagggaataaaaacaattcaaatgactcatagtaggccgacgcagaaagtatcagagtcctgctggaatccaatcctaacttctaggccatttttagtgtgttttccactacttaatccttgatttttgttacatcagagaatgtttgccaataacaaatatttggggacacttaaaaagataacactttaatatactgacgtctaatgttgctccatatagatagaatatatgttgataaaacactgaaaagtattctataaagaatgaattaagtatagaaaagattgctattaaatggtggtaatgaaaaaggaccctattactgagtttattcaattcagacttactcttggcaataagtttcaagaaaaggttttacaactttctgagttctagttatttctgtatttcttccatttaagaagaaaagcatacattgagtgaaggcaggtgggattcactttaaaaactgttaagttttccccacagcaggcatcctgggccggctgagattgaaacctcacccaggagtgccccagactgtggtcacccaagtcagattcttgacaaaaagggaaaacccttcgcctgaccccaccgctttgctcagtctcacaagtttcccctgctttcctccccgttgctgaaagcagcccctcccaagggaagcaggagcctggcctttgtgtggcagcccgcagggcctggcgctggtgggctggcggctgtcccttctactaagtacccactgccttcttcttcatttggtctaagcttcagtcttttgtcacagcccagtatatcactgtttagtggggaatttgggtcacagaaaggtgaagttttcttgtgagcacactttccctgcatttaaaaaagaaaaaagactccatgatttgttgctatttaaatttaagactgtcagaattatatctcagtagagctatgatttcacaaaaattggggggcataactgagctgaacaaagacctaaatggtatttacttagcgtttccctggccccactggacaggcccccctcctcacccctccagtttgcagtcactgcccgcatctaagggaaactttcattttgtcattgtttcgctcttaagtatacactcattttaatagttaaatatcaaacttcatgtgtttatttgatatttcagatcatgaatttttgttatttagagtatatacttgtgctgtgctaaacaaacaataaatagtataaatatcaaagttattaatttgcttttttaaagaaataatacagcttaccttctaagcattcaggattttaactgttggatacatgctgcttctcttttgtaaacttcaacgtcgttctgtttcctcatgaacaggtgctgctttcatgctcccatgtgttccacaaagtaagtccacccctcacgcctgcccaggtgctgcacatgtcgctctcacagtgcagagaaaccatagtcattttcaaggctcctaaggagagccatttattttattcatcaccaccatctatagttaaagaaacatgactgtaggctgcagtacaattcatcctattttgaaaatcatgagttttgtgacaaaagaaccacaaatgtttatgtaacagattgttgtcagtaatgcatgtcaaagtgacagctaaattcacatgatcgatctgcatgtggccccatacacacgcgtgactcacctttgtgctagtggatttcagaagtttttgatgtctctgcatgtatattcttgtaagaaatcatttttggaacaggttttgtgaggaaggtggtagcacctgatgaagcctcctcactttataacctaaattgggctaagtctcatagttatgggagaaaagaacactataattagaacactaacattggaagtaaaaacgttgtttataagtaattacttgtaaaattttaagtgaaatgtttttcttcaggcatgtcttcaggcttttgaaaagttcacaaataagaaaacctgtcctctctgtagaaagaaccagtatcaaacccgagtgatacacgatggggcccgcctgttcagaatcaagtgtgtgaccaggtgaggacgccaggcccgtttggcgctaagcagacacagatcaggctatgacaactaacttgttttttgaatagtgggattttatctctcttcttggccaccataatttccccagggccttgtacagcacagggcttataacaactactgaagtattggttgacatagagtcatcataaattagtcattttcaaatatctgtgttttagaatccaagcctactggagaggatgtgttgttagaaagtggtacagaaacctgaggaaaacagtacctcccacagatgccaagttaagaaaaaaattctttgaaaaaaaggtaggtaaagatcattatgttctccagatatggtctccgtgcgggtggttcacttggggtcaggaaggctaacagaggtggtaaaactttgagacttacttcactttgagggctttttaaaaatgggtgagatgctgctaaaaatcctgtttaactttagttggctttccaacctagatgttcaaatacttctagactttcttttctagttaaatcataaaattaggttaaatcaaagcaacttctgtttggccattttgtgctaattgtttaaataaacttatctcttcagacacaagactggaaaccagcttaatttttcccatctcctgggctatatgtaaatgaagacatctgctgcacatctcatagtaatgaaaatagaagctgcctataaaaataaagcccccacatgctaccattgtattgagtacctcgtggggtcatcacaatgagctttagagctaacttccatgtctacccttcctcttaaccactatttatgctttagttttacttttgggggacttatttaacaatttcccattccttgtccccatatgaaaaggacagtcctaccccatcagcctgtggcttcaggcaaacagcagcagctccgaggctgtcatatgaaagccatcacttcttcctggcagtgttggcctgagaagagctgtagcatttataatggcccagcacacagtaggtgctggaaattctgtatttattatcactattaactcctttcctagaatatggagatgagttactgtgtgttctgttcctgagagcagtgtctctgatcttcagagatcattcgtctcgggtgttcattctcaatttggtaaaggaccgccatgca

SEQ ID NO: 11806 - DNA, 513 bp, Homo sapiens
gatagcattgggagatatacctcatgccagatgacgtgttagtgggtgcagcgcaccagcatggcacatgtatacatatgtaactaacctgcacattgtgcacatgtaccctaaaacttaaagaataataataaagaaagaaaaaataaataaataaataaatatacaagtgtgagtagaaagttaaaggtaatacagaagattaagaaaaataaatggagagatggttttggtgaaggttaaaattgagaactaaattaaagatgaaccccatgccaccaatttctgctccttaggtttgttttagatgtcaaggactgtgttaagagagacaagagtcaaataggcactgagtaggctttgagaatattttgtacataacaaaggagaaatgtgagagcattaagatactaaaatgtgagaaggatattgaactaagaaccattctgaccctgcctaggctttcattagtgcagtgtttagagactaggcaggtgggcaaattcaaatatt

SEQ ID NO: 11807 - DNA, 2472 bp, Homo sapiens
tgacctttcaaaagttgatgaataataaaaaacaattcatatgttctctctgtctcttatactgtactttgtttcacaaatatttccacagttttcctggctcaatcattttaattgcaaaggcaagatttatatatcataaattattacattaagcagtagaaatcagaaatactgaggtgggaaatatgaactatccttgcataggaacagctggaataacctggtccaaaaatgtaataataaaaacaacaaccaaacatactgctctactgataattcagatttttttaagaaatctaatttttaagaaaaatcttgttcaacttgccagaagacaaaaatgatttgaaggttttaaaaagtgttcggttcattactggatttgagctggactcaatgtatctctactattattgttaaagcagaattatgtttaccacaaaactaaacagtttgcatgaccaataatgatttttaaaaaatgtttagctatgaaactcttatgtggttgtctcttgatatctagagaaagagaagggaaaaaattatatttatcaatgttgagacattagtttcattttacctaaaaaaaatttaaaagaaaaacagttacataggaattgttaaggagtttgtagaacactcactcccttcatatgcattgtagttgggtatcacttaaacatctcaactaagctggatttctactacagcggtctcctaagtcaatcaggaaaatgttagtttttttggttgctttaaatgaatgaatttctcctagcaaatagaagcaatatgattttaataaacagtgatgaagactctgggaaacccttacaatgtagggtaataacatctttctattaaaaacaataatgttataaacatttcaacatccaaatgatgggacatttcacatactcatgccttttgattattttcaaagatgcttcattacctaactcattcttgtcacagaattcttgtagctaaaagcaaaaatagactcaaattgaaagatttttaaaagataactacttggcagcaattataggtgtatatacccttgaagatacaaagacttaataataacacctgaagaatatttccctgccccctcccacacacacacacacacacacacacacacacacacacaaatactagggaagtgtgctcctcctcagatcctccagctgtgggcttcctaattaaaaaggctgagctgtttcctgctcaaaacacttcaaaagacctttttgttgttctccacttgacatatagttcgcagcacttgttcctcttacctgtccattcttatttatagagagctttcttgaatcagaaaccaagaagtgatgcagagaccattttattttataaagttgaaggacaataatatttatgttaaaaaaaaatccaagtagctgaattagcaactcagtaattttgctagactggcaaaaaggaacaatgcatgtggcatagtttttaaaacataaatttttatagcataatttaaaaacagtatttattactggctgatttttaaaataaatgggtattttcacttgctgtaaatgtgacatgttaaaatctatttttaaaaaaatactgagtttgatattcatgtttaaagttggagactgttgtaaaagtctgcctctgaatttgatatcttagacaaggaatatttaccttggtacaaatcaaatggatgagagatctaaacataaaatagtcaacagaatcgtcttttgtggattcaaaatagaaacggtacaagtagcaaacactgacaaatagccctttttaaaagcccaatctaaaaatcgacgtccacaaaagctttcttttccaagtatttgcctataaagttatttcaacacggctctgacaaatgcctgtgtgtcctgtcccatagggaaaggtgtgaacgcataacgttttgctctttgcaaaaaagggtcgttaattgtccgagagcagccaccgtttagggatgaagggagattaagtgatttttggccaatgcatctgccaattcccttcagggtagtcaagaatgggggccggcagccctgctgcagttggaaggtctgtccaaaaaaggccgttttggagaaagagggagagactgcgagtggccgactgcgcccccctcccagccctccggcccgggcgcctgagccgccgctcacctcggtgtcattgttgaggttccagaggtccaagcgccccatcccgtccacgcaggcaaaaagcgcaggatgcacgggggaccacatgacatcgtacacatagtctgcattgtcttcaaaggagtagagcggcttgttgtgctgtaaagcagagagaccgtgaagactttgtggcgctgctgctgcctcgggctgtctagagagcctaattaaaaactttgcacattcacaaagtgtcataaaacttcccgagatgaaagtcctcgag

SEQ ID NO: 11808 - DNA, 325 bp, Homo sapiens
gaaacttttttttttttttttttttttttgagacggagtctcgctctgtcgcccaggctggagtgcagtggcgcgatctcggctcattgcaagctccgcctcccgggttcacgccattctcctacctcagcctcccgagtagctgggactacaggtgcccgccaccaggcccgactacttttttttgtatttttagtagagatggggtttcaccgtgttagccaggatggtctcgatctcctgacctcgtgatccgcccgtcttggcctcccaaagtgctgggattacaggcgtgagccaccgcgcccggcctgaacaaactttt

SEQ ID NO: 11809 - DNA, 627 bp, Homo sapiens
  misc_feature (412)..(412): n equals a,t,g, or c
  misc_feature (591)..(591): n equals a,t,g, or c
gggctgcatttcatctggaggctctactggggaaaactccccttgcaaactcactcaggctgttggcagaattcatatctttgtgactgaatggctcagggccacagttttttttgcttgctggtggctgaaagctacctgaatttcctgactctgggggcttttttaatgagcccagtcacttctttagcgaggataatatctctaggtcatgccaacaagacagtgtcatgtatatacatgtgtgtgtgtctgtacatgggtatgtgtgcctgtctgtgtgtgaggaatcctagccacctttgccatcttttcttggttagaagtcagaggtgcttcacacactcaaaggcaagagttgatgcatgtgtgaattccggtgccaccgttggtctgtctgaacaccagcttncatgcttggatcacacctcggatgcacacgcttgaagatcatgtgccacagaagctcattagccaaccctttcaccaactctagtccatgcactacgcagccttcaagccacccttgaagggtccacaaagccacacagacaaggggagtcctgaaagtaaaaataccttatggaccanacaccccccaaaacaaaggcaaagcactggcttgag

SEQ ID NO: 11810 - DNA, 629 bp, Homo sapiens
gggctgcatttcatctggaggctctactggggaaaactccccttgcaaactcactcaggctgttggcagaattcatctctttgtggctgcatggctcagggccacagttttttttgctggctggtggctgaaagctacctgaatttcctgactctgtgggcttttttaatgtgcccagtagcttcttcagtgaggagaatttctctagttcatgccagcaagacagtgtcatgtatatacatgtatgtgtgtctgtacatgggtatgtgtgcctgtgtgtgtgtgtggtatcctagtcacctttgccatcttttcttggttagaagtcagaggtccttcacacactcaaaggcaagagttgatgcaggtgtgaatcccggtgccaccgttggtctgtctgcaacaccagcttccatgcttggatcacacctcggatgcacacgcttgaagatcatgtgccacagaagctcatttgccaaccctttcaccaactctggtccatgcactcggcagccttcaggccacccttgaaggttccacagagcctccacagacaggggagtccctgaaagtaaaaatacctcatggaccagacaccccccaaaacaaagcaaagccactgcctcgag

SEQ ID NO: 11811 - DNA, 209 bp, Homo sapiens
gggcgcagtggcgggcgcctgtagtcccagctacttggaaggctgaggcaggagaatggcgtgaacctgggaggcagagattgcagagcttgcagtgagccgaaatcgtgccactgcactccagcccaggcaacagagcaagactccgtctcaaaaaaaaacaaaaaaagacaaaaaaaaaaaaacagtgcgggatcagtagggcatgg

SEQ ID NO: 11812 - DNA, 107 bp, Homo sapiens
gtgtggacatagacaatagactggactggtgtggacgatggacagggttctgccgtctcctggggccctgagaggcacctactcatccagcccttgcagaccagcag

SEQ ID NO: 11813 - DNA, 2523 bp, Homo sapiens
agcttgcccaaggttatgtgtctattaaatggctgcgtctgtaaaattaaaatgctaactgtggccaccctgcttctctcactccccctagggctgctgtgatgagagcaaacacacccacaatgctggccacacagtaggatgtaataaatcgtggctattattactactttttaatacacacaatagccacagccagtctggaaggctgtagtggcaatggcccgagggcaaaaatccttggggccccttcttgcttggtctctcacttcaaaggctatgcacagtcagtcacaggaaacagaatcagagaaggactcacaacatcctggaggacgtgatgcctccaggacacaacagaggaccgtgcaccccagaatcaactactttgcctcatctgaccttccaaatagtcccaaacagaagggagcaggagatgatggccattggagagaagcctccagggctgaatggccccatgaatgggatgttgattctggaccagaatcaggccttgtttctgtgctcccattgggccccagtggcacagaccagcccttgtaggctctccacggctgggctggaataggcttttgatttcttcccactcctggctggaggacttgccggttaagctctgtggagtgtttactttttcaacaatggcagcaggctgaagaataggaaaaaacctggcccctttttctaacttagcaggccagggtccccttagtaaccaaaatgccccgagcaccaggctccaggcaggagctgggacggcacagtttcctcttgaaggacaatgctgccctcctggtggcaaggcctcttccaaaagggctggcgtggactcaagggccttcctgaagctcactgttcccaaggaaagaattggagcccagctcgctggacagtgcccggtcccccaaaggatcaaggcaactaggggaatgaagaaaggcaagaaaaactcaaactgggggtggggacaggaagcgcggatgagaagaaagccagaccgtcgccaggtgccggtgcctctcatcttaaccatgccatcagtcagggacactagcatctctgcatgggaaccaagtgggggcgcagagaggtcaaacaagctgcccaaagtcagagctaggaagcagcagtcaacttttgaacacagtcttattgcgggatctggccagcagcccgcaatgcaacggggctctctctttgttcccaggtggatcggcaggttgagaaataatagacacacacgagatagtgaaagctgggtccaggggggtcaccagcttctggtcctgcggtgccaacaatgcactggatataccagcatttattattaagtttagtgaaggcgggggtaggttagtgagggatttagggtcatttgattatgcggtgagatggtcacatggggatgaagtaattctttaacatagcatttgtatgtagaagtacagagcataactgagtggctcagtatatagagtacacagagataagaatttacaatatagtgtgtgcgtcagtaatttctaacagagccttaaaacagaaacacaatctttccgtaacctatgattagcaagctattaatcagcagtaacaattgcaacaaaagctggttacaaacaatccatggaaacaggacgtgaagctagacaaccagttagaccagaaattctcagaagggagtatgccctaaccctaaagaggcctagaagagccgtggcaagatgagggcatttatagccctatcttatccatatggacaggcgtccccccatgcgtccgtttataggctctccacaagggtcgtattccattcccagagctatgaacatcttggtgatgtgaaacctccctgactgcacgtccattcataggttctctgcatggggaagcacatcacacactgttggctcattttggcagtccaacctggcattgtctttacacaatcctgcatgcaattttgtatttacaataatcaggagcatttcatcttttattctgtagcaatagtttcagggggtctccctaaacagtctgaccccaaagctgactttcttctgaagatacccctaatccgatcgctcagacatcagaatgagtacctaactgttcaggacacacagttatatcaacatgctcagagactgctttctcttacataaaatactactttcctttttatcataaaaaataggatgggcatggtggctcacacctgtaatcccagcactttgggaggccgaagtgagcagatcaccagaggtcaggagttcgagaccagcctgaccaatggagaaaccccatctctactaaaaatacaaaattagccaggcatggtggtacatgcctgtaatcccagctactcgggaggctgaggtaggagaattacttgaacctgggaggtggaggttgcagtgagccgagattcagccattgcactccagcactccagcttggacaataagagtgaaactctgtctcaaaaaaaaaaaaaaaaaa

SEQ ID NO: 11814 - DNA, 2523 bp, Homo sapiens; identical to SEQ ID NO: 11813

SEQ ID NO: 11815 - DNA, 1454 bp, Homo sapiens
attgacttcaactctgctttgcaggaatgccttgagaaataagagggtaaatccatttgctgaaggatatcaccaaatacgtgaaatttctatctctccaacacactcctagttaatccactggattcttaattgagaaaaatgaccattcccaaagatagcttgattttatttagactattggctttcatagtatatgttttatggttttctacgaatattcactaccctcaataatctccacctacaataagctgcattgccaaagggtcctgccactgccaagtcatttgtttgtcctaaacttctttgttatattatttttacaaattcttaaaagaaataattgtcaataatcagttcttgagcatttactatgtgttttacataatagagatgatattaaatcagcatattttccattcccctgcaaatctctttgccttgaaaatcacatactctaacagtctcctaccattcatgctaagtaagaaaaatcaacccaggaaagaaagcacaaactacaacaaatcaatcttttgtcaactcaaagctgactctcttgagtccttagcaaatctaagtaaatagttttaaaagccaggatttgtgaaaacaaaatagtttttctgaattgtaatagctccctttacacatgttaaaatacaggcttatctagaccatggaaaatattatttgttctttttttttttttttttgagacagagtctcactctgtcgcccagcctggagtgcagtggcacgatcttggctcactgcaagctctgcctcccaggttcacaccattctcctgcctcagcctcccgagtagctgggactacaggcacctgccaccaggcccggctaattttttgtatttttagttgagacgatgtttcaccgtgttagccaggatggtctcgatctcctgacctcgtgattcccccacctcggcctcccaaggtgctggaattacaggcgtgagccaccacgcccggccaatttgttcattttcaagataatacctccattgattgctctattatgacaagcactgattgatataagtgttttgcatgtattcactcctttctaccttacaacaatctccatctcatttgttcactcgtgtgtcccaagctcctataacatggactgatagacagtggacaaaataaatatgtgctatgtgaataagcaactttatgaaatatatactggacagtatatatttctatgtacattttgcagataaataaacagaggcacagagcagttatgcttcatttccaagattttatactcagtagtaataactaagattcaggatagggaaagtgattctcctaaacttcaagtgaggtggtcaacgtcattagagccaaaacaactctagattctctaacttcaaacctatacataatttataggattttctgccaaataaaaataaa

SEQ ID NO: 11816 - DNA, 1454 bp, Homo sapiens; identical to SEQ ID NO: 11815

SEQ ID NO: 11817 - DNA, 1454 bp, Homo sapiens; identical to SEQ ID NO: 11815

SEQ ID NO: 11818 - DNA, 1733 bp, Homo sapiens
agtgcattggttgccatgtaaacagccagcttctggcaggaaagcagctggaccaggtgacctggctgtgacagagaacacagatattgaatccatgaaaccaagagtaatcagtacaacgattttttttcttttactttttaaaagtgtttgtcaatcctttaagttctttttgtctgactgctgtcattaagtaagaaaaatatgaaataaataagtctttgggtatgcaaaattgggaagatggacaggaattagtccctctatgcaatttcctctgaatctttcataatttctgtatcctcatcccttcaccctcaaccctccaacaccctctgttaccctgcaggcaactaggacagcatagagagcgtctcttgaacttgactttctcttccagtgcttgcctgccaatcccgtgacccatcctggagaacttttatagtcttcgacaatgcaatgcatagcaaccagttaataagataagacagtgactgtatagtgctccccaaagtgccatcacctaaaatagccctttggaaagtgctcatatagaactgagaattttagtgtagtggcaggctggatttgggtagggtgcccttcggtgggcctccaaatcctatggggagcttaattacttcatctttctgtaaggccaacagttctcaaaatttgtggtctcaggacaattttacactcttaaaaactgagggagatttctggtctggacatgtagtacagacctgtttttcattgttcctccctgctaagcacaagtataaaccctggaaataatgcaagagacaaccagggtagaactctggaaggttgtaaggagaaggcaaactggtttgagacccagggaaaaacaaagagcaagggtatcctatgtttcccacccagcagaagaaagaaacctagtcctggccattcctgatacccaactgaacaacagagggcagcccaggtaagcttactcctccctcagagtccctctgacaacatcaggtaggcccaacaccacaggtaaggggggatcttcagaaaccccaccaacaacagtggacaaaagaagcatttgccttctccccaggcctgagatgtcccactttcacctagagatatcgaggtgggagggtagaacagacacgaggcataaagtgatggcaagcggcccagtctgggaaggctctgtctcagtgggtgtatgactgtcctctcctacccatagagacaccaacagtgcagggcgccagtagaagtgtcccaccatacctaccccaactgagaggcacctggaagcctgacctagggaaacctttctgctccttcaggcgatatgatctgggacaaatgtcagcctcagtgatatccgataaaccaaacagagcaaaacaatactgaaaattaaactgctgttagaacaacagaccacaaaagtaagccaacacctgcttgcatgtgaagcataaataatgtgactgactgcaaaaataaaaaatgtaaatatgagtttcctaacatagtagacaaaatgttcaatcaaaaatcatctgtcataccaagaatcaagtaaatcacaacttgactgagaaaaggcaactactgccaacattaagatgagttcgatgttggaattatctgacaaggatttcaaagtagccatcataaaaatgcctcaacaatcaattaacattatcttaaaacaaataaagaaaaaaaaggaaact

SEQ ID NO: 11819 - DNA, 1734 bp, Homo sapiens
agtgcattggttgccatgtaaacagccagcttctggcaggaaagcagctggaccaggtgacctggctgtgacagagaacacagatattgaatccatgaaaccaagagtaatcagtacaacgattttttttcttttactttttaaaagtgtttgtcaatcctttaagttctttttgtctgactgctgtcattaagtaagaaaaatatgaaataaataagtctttgggtatgcaaaattgggaagatggacaggaattagtccctctatgcaatttcctctgaatctttcataatttctgtatcctcatcccttcaccctcaaccctccaacaccctctgttaccctgcaggcaactaggacagcatagagagcgtctcttgaacttgactttctcttccagtgcttgcctgccaatcccgtgacccatcctggagaacttttatagtcttcgacaatgcaatgcatagcaaccagttaataagataagacagtgactgtatagtgctccccaaagtgccatcacctaaaatagccctttggaaagtgctcatatagaactgagaattttagtgtagtggcaggctggatttgggtagggtgcccttcggtgggcctccaaatcctatggggagcttaattacttcatctttctgtaaggccaacagttctcaaaatttgtggtctcaggacaattttacactcttaaaaactgagggagatttctggtctggacatgtagtacagacctgtttttcattgttcctccctgctaagcacaagtataaaccctggaaataatgcaagagacaaccagggtagaactctggaaggttgtaaggagaaggcaaactggtttgagaccccagggaaaaacaaagagcaagggtatcctatgtttcccacccagcagaagaaagaaacctagtcctggccattcctgatacccaactgaacaacagagggcagcccaggtaagcttactcctccctcagagtccctctgacaacatcaggtaggcccaacaccacaggtaaggggggatcttcagaaaccccaccaacaacagtggacaaaagaagcatttgccttctccccaggcctgagatgtcccactttcacctagagatatcgaggtgggagggtagaacagacacgaggcataaagtgatggcaagcggcccagtctgggaaggctctgtctcagtgggtgtatgactgtcctctcctacccatagagacaccaacagtgcagggcgccagtagaagtgtcccaccatacctaccccaactgagaggcacctggaagcctgacctagggaaacctttctgctccttcaggcgatatgatctgggacaaatgtcagcctcagtgatatccgataaaccaaacagagcaaaacaatactgaaaattaaactgctgttagaacaacagaccacaaaagtaagccaacacctgcttgcatgtgaagcataaataatgtgactgactgcaaaaataaaaaatgtaaatatgagtttcctaacatagtagacaaaatgttcaatcaaaaatcatctgtcataccaagaatcaagtaaatcacaacttgactgagaaaaggcaactactgccaacattaagatgagttcgatgttggaattatctgacaaggatttcaaagtagccatcataaaaatgcctcaacaatcaattaacattatcttaaagcaaataaagaaaaaaaaggaaact

SEQ ID NO: 11820 - DNA, 118 bp, Homo sapiens
cctcagcctcctgagtagctgggattacaggcatgcaccaccacgcccggctaattttgtatttttggtagagacagggtttctccatgttggtcaggctggtcttgaactcccaacc

SEQ ID NO: 11821 - DNA, 433 bp, Homo sapiens
tatgctaagtgaagcaagccagacacagaaagacaaacaccacataatctcacttatatgtgagatctaaaagagttgaactcagaattagagtagaatggttaccagggactgtggcttggagggagtgggaaatggggagaagttgaccaaagggtacaaagttccagttagacaagaggaataagtttttaagacctattttgcagcatgctcaccatagttgataataatgtatgtgcatttcaaaactgctaaaagcataagattttagtctacacattgggtacagtgtacactgttcgggtaatgggggcaccaaaatctcagaaatcaccactaatgaacttatccacgtaaccaaacatcacctgttccccaaaaaagtattcaaaaaaataatagattttaaatgttcctgctatgaaaaaaa

SEQ ID NO: 11822 - DNA, 434 bp, Homo sapiens
tatgctaagtgaagcaaggccagacacagaaagacaaacaccacataatctcacttatatgtgagatctaaaagagttgaactcagaattagagtagaatggttaccagggactgtggcttggagggagtgggaaatggggagaagttgaccaaagggtacaaagttccagttagacaagaggaataagtttttaagacctattttgcagcatgctcaccatagttgataataatgtatgtgcatttcaaaactgctaaaagcataagattttagtctacacattgggtacagtgtacactgttcgggtaatgggggcaccaaaatctcagaaatcaccactaatgaacttatccacgtaaccaaacatcacctgttccccaaaaaagtattcaaaaaaataatagattttaaatgttcctgctatgaaaaaaa

SEQ ID NO: 11823 - DNA, 1240 bp, Homo sapiens
caattttgttccacagttgtttgaatcggtggatgcagaacccatgaatatggagagtcaatttcatttcataatgcccaaaggtaaatgcgtaactttttccgcacagctaatcttctagcaaccccattgctgtccatggcaagcaggcttagttaatctcgccctttccagtttcaggttcattaaaaaactcttgtcaaactctctttcatcccaccttattcttcattctcacttccatcagcatatcagtccaggccctagtaacattaatgttactaatggcactgttagtaatattacttaccagcattcaagtgggtctccctgatgccattgtctcccatcctgaaatcactgctctttatatagaacttgtatgatgtcattcattggctcaaaaacttttaaagccttcctttttctactaccccaatctaaatttctatgcctggcttttattaaaacccgtaatttggccccaccctagctatttaactttattttccactattcgccagtctcctccctcatcaacgagaagacataccataatcaacctcaccactaacccttggaatatctaaacttaaaaatggtccttcttttcccctttacttgtatttaaagaacctgacgaattattcctcctctgctaaacttttcacaatttcttcaacctcatttacttttcaagttttcagaacatatcttgccgtttattaggaatctcacaattaggcactctactgtagatagatttacaatcatgtatgttgtcatcttctattaaattccatactccttgaaggcaggagtcatgccttattctgtccctcagagtactcagaatgatgcagagcacacagaaagtactcaaatcttgttgactgatccagtgagaaattaccaacttcagttccagcctctctttaacatgtacatagtaatttgggtaagtcaagctccatcctgaaggacataataagggactctttaagcacattattatgaaggcccttcagggataacaccagagtgatgaggtgccctataccagggacaatggagacagagtacttgggattcatcactggagtcctcaaagcatcttccaagggcataataaggaaggactcaaacacctttgaatctccgtgagaccaggcatgaggtcttttgaaagagttctttaactggagtgaatgtcaaagagaagtataataaaataaaagac

SEQ ID NO: 11824 - DNA, 1195 bp, Homo sapiens
atatggagagtcaattgcatttcattatgcccaaaggtaaatgcataactttttccgcacagctaatcttctagcaaccccgttgctgtccatggcaagcaggttagttactctcgccctttcccgtttcaggttcattaaaaaactcttgtcaaaatctctttcatcccatcttattcttcattctcacttccatcagcatatcagtccaggccctagtaacattaatgttactaatggcactgttagtaacattacttaccagcattcaagtgggtcttcctgatgccattctctcccatcctgaaatcactgctgtttatatagaacttgtatgatgtcattcattggctcaaaaacttttaaagccttcctttttctaccaccccaatctaaatttcaatgcctggcttttattaaaacccataatttggccccaccctagctatttaactttattttccactattcgccagtctcctccctcatcaacgagaagacataccataatcaacctcaccactaacccttggaatatctaaacttaaaaatggtccttcctttcccctttacttgtatttaaagaacctgatgaattattcctcctctgctaaacttttcacaatttcttcaacctcatttatgtttcacattttcagaacatatcttgccgtttattaggaatctcacaattaggcactctcatgtagatagatttatgatcatgtatgttgtcatcttctattaaattccatactccttgaaggcaggagccatgccttattctgtcccccagagtactcagaatgatgcagagcacacagaaagtactcaaatcttgttgactgatccagtgagaaatgaccaacttcagttccagcctctctttaacatgtacatagcaatttgggcaagtcaagctccatcctgaaggacataataggggactctttaagcacattattatgaaggcccttcagggataacaccagagtgatgaggtgccctataccagggataatggagacagagtacttgggattcatcactggggtcctcaaagcatcttccaagggcataataaggaaggactcaaacacctttgaatctctgtgagaccagtcatgaggtcttttgaaagagttctttaactggagtgaatgtcaaagagaagtataataaaataaaagacctg

SEQ ID NO: 11825 - DNA, 43258 bp, Homo sapiens
tttcactttttttttttttttgagacggagtctagctctgtcgcccaggctggagtgcagtggcgcgatctcggctccctgcaagctccgcctcccgggttcacaccattctcctgcctcagcctccggagcagctgggactacaggcgctcgccaccacgcccggctaattttttgtatttttagtagagacggggtttcaccgtgttagctaggatggtctcgatctcccgacctcgtgatccacccgccttggcctcccaaagtgctgggattacaggcgtgagccaccgcgcccggccagtttaacttttaaagaaactgacaaagtggctgtatttccagcagcagtgtatgagcattcctgttcctttgtgttctcaccagtgtttagtatggtcagtcttttaaattttagctattctaataggcatgtagcagtatctcattgtggttttaatttacatttccctaatgaagaatgatgttgaacatctttcaatgtgcttacgtatcatccatctgtattctatggtgaaatgtctgttcagatctctacatttgtgttagactatttgttttcctattattgagtcctgagagttctttgtatgttttggatgacaaatgtatcttcaccagatatagttttgtaaatttttactcccagtctgtgatttgtctttttattctctcgatagtgtttttctttttctttctttctttttttttttttttttttttgacagagtctggctctgtcacccaggctggattgcagtggcaagatctcggctcactgcaatctccgcctcccgggttcacgccattctcctgcctcagcctctcccagtggctgggactacaggcgcccgccactactcccggctaatttttggtatttttggtagagaggggtttcatcgtggcctagatcgcctgacctcgtgatccacccgcctcggcctcccaaagtgctgggattacaagcgttagccaccgtgcctggcctctggatagtgtttttcacaggtcagattaatttgtatataaatcatttattttatttttattatgtaaaattttataatttttaattttatttttaatttcctttttaaaaggtaaataaaatattaagtgtaatgatgcaaaattgtgtttaaaagtaaatgtatatgaaagtgttgatatagactaaaacattgaataagtaagaaggtagttagttgtcacagtaggagtgaagtgcaaagcttcccctttcaccctctgaagattacccgaaatgaactgaccagacacagattcataaaagaaagggtatacaaacttacttcacctgcaaaaacatgagagctatacacaaagtataagacttgaagatggctcagatcttaaacgctctcctcataggcgatagatatatagacccaggatgcagacagtattttgtaaataatttcctttggaagctggatgggacagacaaattacgggaaggcgagagatggaactgcacaggaaaaaagtttgtctttgtcactttaatcttatcattactagagaatatttatgaatattttagaataatatatttttaagcccaaacctcaccaaatgttttttctaaaacaaatactttttgttgttgtttgtttgtttttgatactgtgtctcactctgtcacccaggtatggagtgcagtggtgcaaccatggctcactgcagccttgacctcctgggctcaagtgattctcctacctcagcctccaagtagctgggctacaagcatgcaccatcatgccctggtaattaaagaaaaaaaaatttttgttagagaccaagtctcattatgtcaccctggctagtcttgaactcctggaatgaactgatcctcatgccttggcttcccaaattattgggattataggtgtgagccacagtgcctgaccacatatttctatacttcactgaggaaaggaaggtgctaggaaaattggttaagaactattttttaaaaagctattagtagtgttttattttattttattttttaatgattgagttttgagattgggatctcactatgttgcccaggctggtttcacattcccaagtttaagcaatatccctgcctcagtctcccaagtagctgggatgacagatgtgtgtcaccatacccagctccattagtagcatttttaacaattgtgggccactgagaaagaataattttttttaaattaaaggttattttttaaaaagcacatttgtagaaaattactagcataatctgcctaaaataaatatacatattgaaaaaatgtttcctctgaacaaaaagaaatatattcaccacacatacacacatacacacacacgcacacatgcacacacgcacacacacacacattgtggaagatttcaagaccaggcaataatttccactcaatccaaaaacaatgcaatcccagagctgaatatttaggtgaaaaatatatcaggaatgggaggcattcaggtttaattttcatgttttgttagagttaggatgtgagttttcatttaaaaatattctttattttttttgctactattgtggtttctatattgttactatacaatctgtaaactaaatagtaaaggagagaaaagtgattttcaaagaagctggcttgggaacaggtactattctgggaagatgaaaggtttcacttaatgactggtacctgtgccactctggttattttaactgttaaccttttagcaagaggtttttcttttaaaagacatcctttaatatttgggaagctagtgcaatagtacacattgaggcccacataccacatgccaaatatttaaaaggcatatttctagctaaccactgtacatgcatatattttttctctcttattttcttattttagtttttttccttgtcaacaatttaattttaagtccacacatatcttctatcatcccactttgacaaataatattataccttcaaaatgatgtggaagactagaatggaatttagaaccgtagaaccttgtaattgtacaggcaagtttcttcctgggaaaaaataaaacaggaagaaaaggctgggcagcctctggttcaggaaggaaattcgggagtcccttatagcagcatctctagtacttgggaaccgaacagacttctcggcctgtgaggctggaatgggcccttctggagaacacgacagagaagttatctactgcctttgcccccagggcccaggcaacacttttaccctccattgcttgtttccgaagttaaggggaggagacaatgttttgtttagtgacctcgacagaaagggtgtcctcctgcaaccactcatttgttactttccttcttcctgaattgcctggacccactcctcctccatttgactggctccgtgcactgatgttatagtcaggagatttttgggaattgtggcttctaaaaatgtacactcaactctacccacagctggccctgtgaacctacacagctgttccactgtgtctccttctcaaagagacactcttcctgctgagtctctgccctctgctcctagatccaaatggcatctcctaccctatccctgtatggcttaacctagggaaactctttcccaaaggagtcaggtaaggagacggtggctgagcttcttacagacttaaaggagacatcctggaatttaggagtctgtccttcctttctgtctccctggcagctcctgctgctgctcaaagtttagctttgtctctcatccagctcagactgttgctggtcctgatggcctctgcttagctgtattagtatgttcttgcattgctataaagaaatacatgagaagtacctttagttggctcacggttccataggctatacaggaagcatggtggtttctgcttccggggaggcctcaggaaacttttactcaaggtgcagggcaaaaaaaaaaaaaaaaaaaaaaaaaaaaaaaagctaccagcactgcactgtgaggccctgatccctgagctaacttcatattattacctctacagtaagtgtccgtgagaacatagatatatttcttatgtgagtacacaatttacagaagaggaactaccctcccaaaccaaaacaaaatgtcataattttaatttaccagcaaacctaggttgcttctgtgaaatgatctcatttgctgagttttaaaattgactaaatttcccaatttccaaatgaaaatatttagttatcttgtcttgctatgtgtttttggttaatatgatgattaatttttggtctattacttaatatattccataattattgatatggattataaggactcaccaaatagttttcagatgtctttaatttttgtacttagtgcagatcctataaatggattaggagtattctattaactcccatgtattcagaaatcgaattggagtggtaaattctgtttgaggtaacaagggatatcaaaggaaaaaagtaattttgtgactatgtcttctatacatacatttttcaggcatctttatcaatggcttatactaaagacattttccggatcatgggtgacagacagaagacatgcggataagtggcattgtgtacactactgcattttatcatctggcttatttttcaacttttatttctcttaaggatgtttcattaaccggtgcatcaccaggttaacagtctctggaacactaaacttaccagaaaatacttgttgattgaattaacaagaaaacaacattagaaaacagtggtggctcgtttttatctgttgcagtatcttggagagtaaagcctaactctttaattttggccaaagatataaagaaatacctgagaaacacctttagttggctcacggttccgtaggctatacaggaagcatggtggtttctgcttctggggagtcctccaacacttactggcagggtaattttgaagaagtcatgataagatggttgttacaattaaatgaaataatcaaagtggaagagcttagttagctgtcttccctaaatgaatcactggcaagtaagagtgtgattgattttcctaccagtcaggactcaccccttgaagctataggagggtaaacctctgaagaccatacaatttagggaacactaacacctcaaaaaactctgtaaacttccttccttccttttcttccttccttccttccttccttccttccttccttccttccttcctccttccctccctctctctctctctctttctttcttttctttctttgttcatttttgagacagagtcttgctctgtcattcaggctagagtgtagtggctggattatggctcactgccgccttgaccttctgggctcaagcaatcctctcacctcagcctccctagtagctgggactattggcatgctcagctaattttttcctccttttctttttgtagagacagggtctcatcatcttgcccaggctggtcttggactccttggatcaagcaatcctgctgcctcagcctcccaaagtgctggattacaagcatgagccactgagcccagccttaagtttttttcatacaggaggaaagaatttgggaaagtagatgtgtgtgtgtgttggttagggagccaacacatttttctgcaaagcttgaattctgtgcctcagtttttcatttttgttatgtgcaaaataaaatcatatcctgctatagatttaaacctgtgagcagatcctactcaaaacctgattcaaactttgcgtagatctttgtctctctatggcataagaataaattcttctgatttccttccctcagaaaaatggacttagacttcccacaagccttccagaaagaactcgcctgcctcatctgcctgaattacctcatagaccccatcactataggctgcgggcacagtttctgtaggccctgcctctgcctttgctgggaagaagcacatattcctgccctgcatgcagggaactgtcacagcaggaagatttcaaccaatattcctctgaagaatctagtgtccattgccagaaaagccagtctctggcaattcctgagctctaatgaacaaatgtgtgggatccacagggagacaaagatgttctgtgatgtggacaagagcttgctctgttttctgtgttctaactctcaggaacactggggcacagaaacactggcccactgaaggggcagctaaggaacacagtgtaagtggtgactcagagcactttgaaagctggagggcagcacaggtaaagagattaggaggaagatgaagagcatgaggattaatctattctttaccgagtgtcatgtactgcctaggtatcagtgatataactgttatcctgctatcaaatctactgataagtggctcatttaacttatatgcactcatcacaatgcaagaaatcctctgactgctcctaccatcatgacccctagccatgatatgacttgtctccacactagcagaaactaatcgagtccctatattagggataagtggcctttatatatatatatatatatatataaaatttttatatgacatttaaaatataaataaatatttatacaatatatattatatacatatatatacatacatatatacatatatatctcacaatgccaaaaatgttttgtcttcgaaataatcacaatgcatctacaaccaggcgacaacactgaaaataaaattgtagcagtttgaataggggtaatgagttaattttttcctggggttcaaaaaaagaaacagcagcaaaaaatggtacttaagactgaaagttggccgggtgcagctgctcatgcctgtaatctcaacactttgggaggccaaggtggtggataacctgaggtcaggatttcgagaccagcctggccaacatggagaaacaacgtcattactaaaaatacaaaaattagctgggcatggtggcaggtgcctgtaatcccagctactcgggaggctgaggcaggagaatcacttgaacccaggaggcaaaggttgcagtgagccaagatcacgccattgcactgcagcctgggtgacaaaagcaaaactccatctcaaaaaaaaaaaaaaaaaagaaagttctgggttatgacacagaacatacgcaacatgaatatgtcatggttatgaatatatagactactcaagattgtgtatttttaaaataatagaatactaggttaaaaaattagcatcacagaatgaaaaataagccacaaactagcagaagataattgttaacacataaaaacaaaggattaaatacaatggtaatataatgatagctactcttacaaagttgtttctatgtctcaggtactattctgaacaacatacgtgcatcttgaatgcatgaagaattcctatataagaaaaacacaaacaacaacatttaaaatgagcaaaaaacccgaataggaatttcacagaagagaaaacataaatggcccataaacataataaaagatgctcgactacaattctaatcagggaaataaacattaaaaccccaaagagataccacttcatactctaggaaaaacctaaaaggctgtgaatatctagtttcattgaggaagaacaatgggaagactattcactgctggtgagggtgtagattggtacaactgctttggagaacagtttgatgccactcaatagagctgaacacacacatgcccaatgaccaagcaattccactccaggtacatactgtaaaaatactcctgcacatgtagaataggagacactgcataacaaagttcactagaacatgaggctgaggtgggaagatggcttgagaccaggagttcgaggctacaccagtagctgggactataagcatgtgccaccgtgcctggctaattttttgctgctgtggttgttgttagagatgaggtcttcctttattgaacaagctggtctccaactcctggcttcaagtgatattcccacttctgcctcccaaagtgctgggattacaggtgtgagccaccatgcccggccaagttctgcttcttaacctgaggtagatactttgatgtttcattttcctttattgtacagatatactttatattctcatatgtgacacaagtcaaaatttaaaaaaacaatttaacgtttattccctttagatgaatgatgggcaaatttacataatgaattcattactgaaacaatgtatagatttcagactaggaaagtaactatttataaaagaaaagcttaaaacgtgaaacagaaacaaaatcctgaaactgtaaaattgagtcaaactaaaatttaaaaaacaaagcaatgatataaagtatcatttgtccaaatgtgttctacaaaacgcttttttctgaaatatgtctgaggaaaaacaggttctaggagtaaaatatgtttgaaaaatgctgggttaaacaactgaacctatgaaggaaggaatagaacttctcaagctcttgactctggaattttttttacacggcaattaacaccatgcttcttcttggatttgtatttcagataaacacaatctgggaaacattttataatacagagggccacaccagattgaatattgcccccaggaatgaaatgaaaacaggaatggattctccagtaagaggtacccagatatcctaatcttcagtagctgacctaaaccctggacaagtgggatcaaaccccataaccaaatacaactttttaggaactaagtggataatcactctgtgttgtatgaacatgtgggcagtgtgtttcctacacagcttaaaagtgcaacaaaaaaagatctgggtgtcatataaagaatttctaccactgttagggtaatggtggactgacaggcagagggtcttagatgtgacttaagtaaagttcaatagaagcttccagcacagatattcatgttttgaattggaccgctcagttaaaaagtttttccattagacttcccctaatcaaattagaaattatctaattttctaataaagttttccccaggcacaaggaatctgtgaactggacctaaaaaattcttcataatgtgcttttattaccataaaagatgcacatttattttaaaaacttctctacaccactatcataaacatttgcacacacttatttcttttggaagctaacttctgagtggtaatgaaatatattcttaagaaaaaagtccgacacaatgcctttgcgtcttaaaacatgttaaaatattatttgaaaagagtaaaacatctgtcttttcagggtatcacagggcatcaaactggaaaatgtggcactgccaggagtttctacctggtgaaggttggcagacttttctcttcagagggctcttgacagggtagcatccattatcttgccaatttaccaaaacctaggcccaatcctcagtcttataggctcagaaatttatttttatcatcatcaatagggtagctacattgcttagaagcaaacaaaaataaccatgcttcaatagaaatcaggatatagatgtattagtacagaatgacaaatataactgtgacagaaataggaatgcctgtttatggtcatatactttcactacagccaaactcatacatgcagccaaataagaggcccctggatacacagggaatcggaataaaaaaagaagaactgaacatttaatagtcttctttcattcaatcaataattttttttaattaagcaactactatgtccaggtaaccttctaggtcctggggatacagaggtctctgcttacagaagtcatatgtaagtagcaggtgaagagtatgtgtttcacagaagtttattacaatatattaacaagagcaaaaaattttggaagcaatctaaatgttcaataatagagctccaattaaataacaataaatccaaataatgaaaaataatgcagccctttaagaataagcacttgcaagccgtaattcatgacatgggaaaattatcatgatggaaaaagaagcaagctatatatagtgcatgatcctatacacacacatacatacatacatatttcctatccctttatatgcataagaaaacaagcgggaggaaagtcatatctttagtcaaatcttgtttgctaacgtactattaatgattatcttttctttttctttatacctttttgcatttttcaatttcctaaaatagccttacatgccttttatcaccaggagaaaaattacttctaaagtaatttcagtcaacatgcatactaagaactcttcagatttatctgttagaagctgtgcatgaatgccagtccttgtatctgccttggaactcacagaagctcttttcccatggctttaagcaatactcaaatagactagcatacctgaatttcctagtcctatgtttttttcatccaacagccagtcttgtatttctagctgttttctaaacatttcaaccaaaccattttacagataactcatacagtcatcctttgatatgcatggggaattggttccaggatcccccttgtataccaaaatccatagatgctcaagttactggtataaaatagtgtagtatttgcatgtaacctacacacatcctcctatatactttaaatcatctctagattacttaataacacttaatacgatgtaaatgctatgtaaatagttggtataccatgttgttttttatttgtatcattttttatcattgtattattttttctgacaattttgttccacagttgtttgaatcagtggatgcagaacccatgaatatggagagtcaattgcatttcattatgcccaaaggtaaatgcataactttttccgcacagctaatcttctagcaaccccgttgctgtccatggcaagcaggttagttactctcgccctttcccgtttcaggttcattaaaaaactcttgtcaaaatctctttcatcccatcttattcttcattctcacttccatcagcatatcagtccaggccctagtaacattaatgttactaatggcactgttagtaacattacttaccagcattcaagtgggtcttcctgatgccattctctcccatcctgaaatcactgctgtttatatagaacttgtatgatgtcattcattggctcaaaaacttttaaagccttcctttttctaccaccccaatctaaatttcaatgcctggcttttattaaaacccataatttggccccaccctagctatttaactttattttccactattcgccagtctcctccctcatcaacgagaagacataccataatcaacctcaccactaacccttggaatatctaaacttaaaaatggtccttcctttcccctttacttgtatttaaagaacctgatgaattattcctcctctgctaaacttttcacaatttcttcaacctcatttatgtttcacattttcagaacatatcttgccgtttattaggaatctcacaattaggcactctcatgtagatagatttatgatcatgtatgttgtcatcttctattaaattccatactccttgaaggcaggagccatgccttattctgtcccccagagtactcagaatgatgcagagcacacagaaagtactcaaatcttgttgactgatccagtgagaaatgaccaacttcagttccagcctctctttaacatgtacatagcaatttgggcaagtcaagctccatcctgaaggacataataggggactctttaagcacattattatgaaggcccttcagggataacaccagagtgatgaggtgccctataccagggataatggagacagagtacttgggattcatcactggggtcctcaaagcatcttccaagggcataataaggaaggactcaaacacctttgaatctctgtgagaccagtcatgaggtcttttgaaagagttctttaactggagtgaatgtcaaagagaagtataataaaataaaagacctgagtagggtcctccttgttcataaaatgacactacctaaatcaccaaatctcactgagccttggtttaactcaagaggttccatgccactataagaggtggtaactgccaactgacaggaaatattttcatatgcatagtcatagtgccccatatttatgaacttcttaagagtcttcaaaaagctttctatatacattatcctttactttctaactttcctaaatacaaggtgagagagacacaagtgttctatcaaaacagaatcttggccgggcacagtgactcatgcctataatcccagcactttgggaggcagaagtgggtggctcacttgaggtcaggagttggagaccaacatggccaacatggcaaaactccatctctactacaaatacaaaaaattagccaggtgtggtggcaggtgcctgtaattccagctacttgggaggctgaggtaggagaattgcttgaacccaggaggcagaggttgcagtgagcagagatcacaccactgcactccagtctgggcaacaagagcaaaacttcatctcaaaagaaaaaaaataaataaagacttttgcaaggaccatgtcccacccagaatggtgcctgcctttctacagttttcaggaagaggaaacattttctgctgctcttgctgaggttttttttaaccacccattaggaacgtatagatttcagaatcgaacactgggattccctcagcactaaaggaggaaaattgcaaacagagctgaaagtgcaatgtggaaaggtcaggctgaggaaggttcttagccagtagaccaagggcagaaaggacactgcctcctcagtctcccactagggaacttgctattcttgtcccctgacctcagaattccttgtcatgtttgttttgtctccaagggaacggtttgaattacacaatttaaggctagagtgggcctcctgcagttaacattaacactctctctccttcgctggccaaggtgaagtctgggaccatgaagttctgacgtccactctctcgggggatcaccagttcacccacctcacccggcaagctgggccctagtttggcgacaggcatcttccacccacctgggaggcagggttcaatactctgcctctgaccttgtttccttcttctgccacctgcttaggcagccagaaggggttgtccagccagcacctgggctttggtgctcctcaagaaggtggaggaagtttcaggcacctggctcctcaggtgtctgccatccagctgctcttcaggcctgcccagcagagctctcttgatccagctagaactggccagaactgactcactcaggaatgtgtagactttggcatcaggggctgctttaatttgcacaatttccaaatacctcttttttcttctttttctgatgagtcatctccctagacttgcattttaaagagatagatagttatcaggttccagagaagacatggtagaacatttatatctcaaagacacagagctgagacttcaggtttagatactataattgcctaaaccaaaaaggaaggtgtaggtaaagttctagtcaagacaggatggccaggaaaaacaccttaaaccaagggatggcttgctttgcagatttaagccaatggcttctttatcataagacttcccagtgatttagtcctccctctcttccagtgcacagagacatacccctccttacaaataaaaatgttctttatagatgtaaacttattttacaaaaatgtttcaaaataaccagatgaaaatcatccttatgccagaaagacttcttttttttttcattactagaaatgaaacagtaagtattggttgtattgacatacttaggcttagacctatgtttaacaagaaagcctaataatagcactgtggttagactgtagcctatttttccaaaccatcattttattattaaggaaagaaaggatcaaatacctttcattcatctgatatgatcctttaaaacacattccactaataagtcccatttggaacagctgaaaatcttttaataaaactttttaaagatgagctcatggcttagtgtatatttcacaagcttaattaggtcaaatggaaggaactcagatgagtagttgcccaatcagagcccattagttgtaagtcatcagcccccttcatgaccttaaaactccactctgacctaattattgcaaacctatatacaacaaagtgaaaggattaattttcattcatcaacctctcaaacccagattttcaaagaaaaaacctatgtaaggaatacttaccgaaaccagacaggaaaattagagcctgcatacttaagagtcaaacttgttccactacagccaggtggcatacaattacaccatttggttcttcatacactctggaactgaccaggacagagtttagcatagaaaaactgtaagaaataggttccaaaacatagaaattgcaaagtccaaaaggctatgaaaaaaactaatgtaaatgagagactcccctccctttgttttaaagaaatagacccatcagagaaatgcaaatcaaaaccacaatgagataccatctcacaccagttagaatggcgatcattaaaaagtcaggaaacaacaggtgctggagaggatgtggagaaataggaacactttcacactgttggtgggactgtaaactagttcaaccattgtggaagtcagtgtggcgattcctcagggatctagaactagaaataccatttgacccagccatcccactactgggtatatacccaaaggactataaatcatgctgctataaagacacatgcacacgtatgtttattgtggcactattcacaatagcaaagacttggaaccaacccaaatgtccaaaaatgatagactggatgaagaaaatgtggcacatatacaccatggaatactatgcatccataaaaaatgatgagttcatgtcctttgtagggacatggatgaagctggaaaccatcattctcagcaaactatcgcaaggacaaaaaaccaaacaccacatgttctcactcgtaggtgggaattgaacaatgagaacacttggactcaggaagaggaacatcacacaccggggccagttgtggggtggggggaggggggagcgatagcattaggagatatgcctaatatgaatgatgagttaatgggtgcagaacaccaacatggcacatgtatacatatgcaacaaacctgcacattgtgcatgtgtaccctagaacttaaagtataataaaaaaatatatatataaaaatttaaaaaagaaagaaatagatgttctgtaaaaatatacacaatttttacagacaaatacatttataagttgtttttatcttaaaaattggggatatttcatatttataactaattattgagccttaagttttcttggccatttctaggctaataaactaagaattatgtaaactaagccaaagtagaatagacataaaagtcctgaacacttcaacttcctattcttcaagaagtatacccggcaaagctcatttgagagaggaaaagctttcctccaccctctgttttacagcgctgaggcttctcatcacagttctatgacttgtagcttaaatccgtgttacatggtcactggcgttgttagtgcttctcttttaacactgtaggaattaatcaattcggtagcatatttaattaattctatcactagcctggctactggccacccttctcttctcaaccaggaaattaagtcagaaaggcttattttcccttagtaagactttggggacatagcaaagttcatgacaataagaaagaagtggcagcaagcgtttgaaaagagtggtttcagtcaactgaggggttcccatgggagaagcaggatcaaagagagagagagagaaagaacagggagggctaattagattagttcatagttgtcccaagagcgacgcctttgggggcttcccttaggggggaaagagtccaggccaaagggatgacccgtgagatggctgctgtaaaagtggactattctttttccagtggcctggctatttgcaaaaaaggcagacatcttagggcacaggggtgtttagtttgcatgcacaagtagaagtactcccaatccctgcagttgttgtaactgggaggacatgcacctgtttacctttgtaagtgtttccccactgtcaccactgtaattctaggttatctttagggaggccaaacttatctatctactgaacccagtccagttgccatctgatcatcagactgagtgacctcttacgtcgatccaatacagttcaccaatcaaatccaatttgatgctggactgagtcaagtttttaccaatgactcatcagctacccaaacctcaaaaggccatatgtcatctcacagcacaaactggccactggcacccaccccaaggttatttgccctctcatagcacaaaaccctggattcgaaacccaaaaggatcaaggttcaatgcaaaaacagcagagtctggcctaagaggaatgtacaacctcagaaggagggcaaaggggccagcagtgtctttcctgaattcctcaaggggtcttgggaggtggatcccatccagcttgccagaactctcaaaagacaaaattacaacaaatttactttaaactaaataaattaaataaaataaataaatgaaacttagcttttatttattatttcagaatcaacttcgaaacccagtctggataaaaaaataaaaataaaaacccttacaaaggtaaacaaatgcatagctcaaaacacaaatccttggagcttcaaaatttgagagagaacttgcccaggacccctgctgctgtgagagatctgtgtgcacaatggacctggtgggtcgctgtgcttgggcactccatgcttctggggtttgatggacgttctacttcagattgcatttcctacactaatctgttaaaaaaaaccctttacatacgctaaatttagcagagtttatttgagcaaagaaaccgtttaggaatcaggcagcagtttgcaccaaaaatggctcagaacactccatgccaccatttgtgcaggttacatttacagctagagaaaaagaagtgcacagaaacagcctgattggctgctgttggcatttacctcatatagtcatgttttggcagctttcagcctctgattggctgaagcctcagctgttttcattggctaagacatagttacatgttataagactatagtcttgggttaagttacagttatttttacacattaagttaggttacaactagctatgtatacagaactcattaggccaaacttaaaataagtatggaggctgctttaggacacctgtatgagcgaagtatgccagagtggcagagtgctacatacatatgtgtaaatttctatattaaatatatttatgtatgttacctatatatttatatgctcataaatatatatttccttgaatagtcagctatgttctctatttctaaatttataaatatgcatatttatgtgtgtgtgtatatgtatatatatatgtatatttaatttttatgtgtttgcttctgccttatttgtaaggtagcccaaaatggcagagagattacatatgtatgctataaatgtttatagtatatatttatgtttatgtatatatttaaatgttgcatagttttttttttcaagaatttgaaaaagtttctaaattgaggaaaaatttatgtaagattaagctctttaaagtgtatcattcactgacatttaggacattcttaacactctctagttccagaattttttttcttttttgagtggggtctcattctgtcccttaggctggagtgcagtggtgagattttgactcactgcaatctccacctcccaggctcaaacaatcttcccacctcagccttctgaatagctgggaccacaggcacatgtgccacaacgcccagctaattcttcgtattttttttggtaaacacggagtttcaccatgttgcccaggctggtcttgaactcctgagctcaggcgatccacctgccttggtctcccaaagtgccgggagtttttatagttcgaggtcttacatttaagtctttaatccctcttgagttactttttgtatatggtgataagtaggggtccagtttcattctggcatctacatagccagttatcctagaatcatttattgaataggaagtccttttcctattgcttatttttgtcacctttgccaaagatcagttagctgtagatgtgtggctttatttctgggttctttatcctgttctaatggtctatgtgtctgtttttgtacaaacaccatgctgttttggttactgtagccttatagtatagtttgaagtgaggtagtgtgatgcctcctgctttgttctttttgcttaggattgctttggtgatttgtgctctttttgagttctttataaattttagaataggtttttttttctaattctgtgaaaaatgacattggtagtttgataggaataacactgaatctggggattgcttttgatagtatatggcaattttaacaatattgattcttcctattcttgagcatggaatgtttttccatttgtttgggtcagctctgatttctttcagcagtgctttgtaattattgttttcttgttgtagagatctttcacctccctggttcccttcattccttggtatttttgtgtgtgtatgtgtctattgtgaattaaattgcattcttgatttggcactcagcttggatattgttggtgtatagaaatactgctgatttatgtaccttgatgttgtatcctgaaactttgctgaagttgtttattagatctaggagcttttaggcagagactatggggttttctaggtataaaatcatgttatctgcaaacagagatagtttgacttcctgtcttcctatttggatgctttaacttctttctcttgcctgattgctctggctaggatttctagtactgtgttgaataggagtgatggcagtgggtatccttgtcttgttccagttctcaagtggaatgagcccagcttctgcctgttcagtgtgatgttggctgtgggtttgtcataaatggctcttattattttgaggtatgttccttcaatacctagtttattaagggtttttaacataaagggatgttgaattttatcaaaagtcttttctgtatctattgagatgatcatgtggtttttgtttttagttctgtttatgtgataagtcacatttattgatttgcatatgttgaaccaaccttgcttgtttatcccagggataaaccctgcttgattaaggtggattagctttttgatgtgctggtagattcagtttgctagtattttgttaaggatttttgcatctgtgttcatcaaggatattggcctgtagttttttctttgttgtgtctctgccaggctttggtatcagaatgatgcttgcctcatagaatgagttagtgaggagtctctgctcctcaattgtttggaatagtttcaagtagggatagcagcagctcttctttatacgtctggtagaatttggctgtgaattcatctgatcctgggctttttcttgctcaaaatcataaaattagatggaaactattttattactgattcaatttcagaactcattattagtctgttcagggtttcagtttcttcctggttcaattttgggcagctgtgttttcaggaatttttccacattttgtaggttttccagtttgtgtgtctagaggtgttcataatggtctcagagtcttttgtatttctgtagggtcattgataatgtttcctttgtcaattttgattgtgtttatttggatattctctctttcttctgctgtttgtctagttagtgttctatctatcttatttagtctttaaaaaacttgtggtttattgatcttctgtatgttttttcatgcctcactttatttcagttcagctctgattttggttatttcttgccttcttctagttttatggttggtttgatcttgttttcctagttcttcttctaggtgtgatgctatgttgttaattggagatctttctaactttttgatgtgagcttttaatgctataaactttccccttaacactgctttagctgtgtcacagagattctggtatgtcttatctttttttctttggttttgaagcttatttctgccttaatttcattatttacctagcagtcattcaagagcaggttgttcaatttccatgtaattttatggttttgagcaatcttcttcgtattcccttctatttttattgtgctgtggtttgagagcataattggtatgatttcaatttttaaaaatttgttgagaattgttttttgtctgattatgtggtcggttttagagtatgcaccatgtggtgatgagaagaatatatattctgttgttttggggtggagaattttgtagatgtctgttagttccatttggtcaagtgttgagttcaggtcccacttatattttttagttttctgcctcgatgatctgtctaatactgtcagtggagtgttgaagtctcccactatgattgtgtgggaatttaagtctcctcacaggtctctaagaatttgtttttatgaatctgggtgctccctggtgctccctgggtacacacataattcttgtgttggatgcatatatatttagaagagttaagtcttcttgttgaattgaacactttacccttatgtaatgcccttctttgtagttttttgattgttgttgacttaaagtctgttttgtttgaaattagaataacagcccctgctatttttttgtttgttttgtttttgttttctgtttgcttggtaagttttcctccatcctattactttgagcctatctgtgtcattgcatttgtgagatgggtctcttgaagatggcatacagttgggtcttgtttgtttgtttgttttaattttttgagactgatctgtctctttcacccatgctggaatgcagtggcacaattatggcttcctgcagcctcaacctcttgagttcaggtgatctttacacttcaaattctggagtagctgggactacaagcgcatgccaccatgtctgactaattttacattttttatagagatgaggttttcccatgttgcccaggctggtctcgaacacctgggcttaagcgatctgcccaccttggtctcacaaagtgctgggattacagacatgagccactgcacccaagtgggtcttgcttctttattcaatgtgccactctgtgcatttcaattgggacatttagcccatttactttcaaagttaaaaattctatgtacagaattgatcctgtccttatatttttttcagctggttattatgcagactagatttgattttgtagttgctttatagtgttaatggtctatgtacttaagtgtgtttttatggtggttggtaatggtcttttgttctcatatttattttattttattttgagacaggatctcactctgctgcccaggcagagtacagtggtatgatgtgggctgattgcaacctctgcttcctggactcaagccatcctcctgccttggtctcctgagtgggtgggaccacaggcgcataacaccattcctagctaatttttatattttttgtagagacggggtttcaccatgttgcccagtctggttttgaactcctgggctcaagtgatccacctgcctcagcctcccgaagtgctgggattacaggcgtgagccactgcgcctggcttgtttctatatttaacactcccttagagacctcttttaaggcaggtctggtggtgataaattcccttaacatttgcttgtctgaaaagtatcttctcctttgcttatgaagtttgtttgaccgtgtatgaaattcttggcctcctcggcattgcaccatcaagacaaagttgtcctccaacttctcatcctgcattgctgccattgcagctctcagaactaaaaaggcggcttcagactcctccaaagaacaagtggccaattcgagggaatcctccccgtcaccaaaagaagtaaacgacagtccgagagccgccaccaagtctcctgaatcccagaatctcatcgatgggacaaaaaaaccatccctaaagcaaccagacagtcccagaaacatctcaagtgacaacagcagcaagggaaccccgtcctctcctgcaggatccacaacagcaatccccaaagtccgcataaaaaccattaagacatcttctggggaaatcaagagaacagagaccagggtattgccagaagtggatcttgactctgggaagaaaccttccgagcagatggtgtctgtgatggcctctgtgacatcccttctgtcatctccagcatcagccgctgccctttcctctccccccagggtgcctctccagtctgcagtggtgaccaatgcagttttccctgcagagcccacccctaaacaggtcacaatcaagcctgtggctactgctttcctcccagtgtctgctgtgaagacagcaggatcccaagtcattaatttgaagcttgctaacaacaccacggtgaaagccacggtcatacctgctgcctctgtccagagtgccagcggcatcatcattaaagctgccaatgctatacaggagcaagctgtcatgatgccagcatccagcctggccaatgccaaacttgtgccaaagactgtgcaccttgccaaccttaaccttctggcttagggtgcccaggccacctctgaactccaccaagtgctaaccaaaactcagcaacaaataaagaaggcactaatcaatgcagcagcctcacaaccccccaaaaaggtgtctcgagtccaggtggtgtcgtccttgcagaattctgtggtggaaactttcaacaaggtgctgagcagtgtcaatccagtccctgtttacatcctaaacctcagtcctcctgccaatgcagggatcacattactgatgcatgggtacaagtgcttggagtgtagggactcctttgcacttgaagagtctgacccagcactacaacagatggagcatgtgcatcgaagtaacgtgcaaccattgtacaaagaacctcattgtttacaacaaatgcaacctcctttcccaagcccgtgggcataaggagaagggggtggtaatgcaatgttcctactcaattttaaagccagtctcagcaggtcatatcatagtttctccatcgagcaatagttcttcttcatcttccactcttcagagccctgtgggaactggcatacacactgtcacaaaaattcagtctggcataactgggacagtcatatcggctccttcaagcactcccagcaccacagccatgcccctagatgaagacccctccaaactgtgtagacataatctaaaatgtttgaagtgtaatgaaatcttccaggacaagagatccctggctacacatttccagcaggctgcagatatgagtggacaaaagacttgtactatctgccagatgctgcttcctaaccagtgcagagaatccatcagcacaaatctccctacacctgccctgagtgcagggccatctgcaggttggtgcacttccagacccatgtcaccaagaactgtctacactacacaaggagagttggtttttgacgtgtacattgcaatgttgtgtactctgatgtggctgctctgaagtctcgcattcaaggttctcactgtgaagtcttctacaagtgtcctatttgtccaatggtgtttaagtccgccccaagcacttaacacagcatcctggcatcaagataggagaaccaaaaataatatataagtgttccatgtgcaacgctgtgttcaccctgcaagccttgctgtatcgccactttgactaacatattgaaaaccagaagatatctgttttcaagtgtctggactgttctcttttatacgtacagaagcaacttatgatggaccatatcaagtctatgcatgggacattgaaaagtattgaagggccaacttgggtgtaaacttgcttttgagctttaagcctgcaacttataattcagcatatcagaaaaaagaggacagcaaatccatgagtgggaaagagaaactggaaaagaaatctccatctcctttgaaaaaaaatcaatggaaaccaagaaagtggccagtcctgggtggacgtgttgggagtgtgaccacctgttcatgcagagagatgtgtacatatcccacctgaggaaggagcatgggaagcaaatgaagaaacacccctgccgccagtgtgacaagcctttcagctcatcccacagactgtgctggcacaaccggatcaagcacaaaggcatcaggaaagtgtatgcctgctcacactgcccagactccacaggtacttttaccaaagggttgatgctggagaagcatgtccagctgatgcatggcatcaaggaccttgacctgaaagaaatgacagacgccaccaatgaggaggaaacagaaataaaagtagacgtcaaggtccgcagtcccaagtggaagttgaaagaaccggttctggagtacaggcctcccagaggagcaataactcaaccactgaaaaagctgaaaatcaatgtttttaaggttcacaagtgtgccttgtgttgcttcaccaccgaaaacctgctgcagttccacgaacacatccctcagcacaaataggatggttcttcctaccagtgccgggagtgtggcctctgctacatgtctcacgtctctctgtccaggcacctctttgttgtacacaagttaaaggaacctcagccagtgcccaagcaaaatggggctggcgaagataaccaacaggagaacaaacccagccacgaggacgaatctcccaatggcgtcatgtcagacagaaagtgcaaagtgtgtgcaaaaacttttgaaactaaagctgccttaaacactcacatgcagacacatggtatggccttcatcaaatccaaaaggatgagctcagacgagaaatagtcacagacgctccatgaggaaaatccctgtccacattgggataaaaaagacacttttgttacactaagtttgcagtataatagagttaacagtactgtctaggctgttgctatatattctctttcaatgtgccttccttcttcatcttgtcatatatatcctcattaagtattaaaacagaatttgagtttaaaagagtttgtatatatttaagtgaataactttttatactctttgttacatgtttgtatcagtattcagtggaaaacgttttgagttgttttgggttagaatttttctttttgtcctgtttctttaaaacagagttcttaggaacaggggcagttcctgaattcaaataaatcattttgtatgtttcaaatttgaatggcttaactaattacaggctaaaataatgccttttttagtgtttttaatttttaaaattcactacataaattggaagtaattgtgggtctcaaaaacactaggaacttctaaatgtcttagcaccttctggatgtgcctgccccgagggagtgagtgcacgtttgagacaactgcactccagcgtgggcgcgcctttgtcttcaggccacgccgaagggtgtttaaagcagccttgcaggtcgctcctttcccagccgcggataaaaactgaagccaggaatctaataaggaatgctgatttcctcaattccattttgaggaatggggaaggttattctaaagaaaaaaagaatgggactggttttctgggcagatctgcaaggctggctttaggagcacaaggagggaaagtaacaaaacggctggactactataaaagttacaaatacgtagttagaccaatagatctacatagtcaggtttttgtcatgtaatttattaactattacagaaacacaactaagaatatcaagtatttctctggctcttgatagaaaaaaaaatcagctgacttaatcctttgttttcaaaagagttggcgtttcctgttctgggtgttactgccaaacgttctggtgcttagagttgggatgcacgacgtcaaccaccgacttatcaatgcagccggctgtgtatcgcaattggccgttaccttaagcactgagccacatgggattagttcagccatttcaagaggtatatttaatgttggtagttctgctttactaaaatgcagtagaggtactcttctgtcccttctgtttatagttctctgagagagttatattttttggtttcgtcttgtgttttcttttgcatcttatatcttgtatttatccctgaacatgttttgtacttttttttttaagaaaaggaattcttttgtgtatatatgtaggtacttgcatgatatactgtagtcaatgttcagttcctcgaaaggtcttgctgctgtcaggtgttatacactccatccatcataactgtatgaaacacatttcatatgtaaataaacgtgggacatttgaaaaaattttttgttctatgtagttgaaaatcattggctaagttcattataacctcctttctgcatcttaccctcatccacactcttacagcctttcattaattgtaaattcttatgtctatattttccatatctacttagtactactttttggaatgaatcttttatgccctgctctggtcaataatcttgggtgaaatgagaacacaaagccagagagaccaggtttctgtagttctctaacatcagattttaatacaaattctgctgtgcagtgcccaggcattgccacccctctggagagaattctatggctacatccctgaatgtcaaccgttccatttctaggcttgcagcaggctctggtgtcttagctatggatctcccaatacctgctggtcacagggccatagagactgggcttctaggaacagaagacacagagcagtgaacagtagccagtttcattctgcctatggataggcagttatcccagcactatttattgaatagagagttctttccctattgcttatttttgtcagcttcatggatgttcacttggttgtaggtgtgtgactttatttctaggttctctattctgtcccactggtctatgtatctgtttttgtaccagtactgtagtgttttggttatgtagccttgcaatatagtttaaagttggatagtgtgatgtctctggcttcttttttctttttctttttttttttttggcttaggattgctttggtgattcctgctcattttttcattccatatggattttagagtagttttttttcctaattctgtgaaaaacaacattggtaatttaataggaatagtgttaaatctagagattgctttgggtggtatggccattttaatgatactcattcttcccatccacgaacatggaatgtttttccatttgtttgtgtcatctgtgattttattcagcagaaatttttgttattcttgtggagttctttcacctccttggttagatatattcctaggtattttttttgtgtggtcattataaatgggatagcattcttgatttggctctcagcttggacgtttttggtgtatacaactgctactgacttttgtacattgattatatattctgaaattttactgaagttatgtattagttgttggaatttttggtagtcttttaagtttttctaggtattgagtaatatcatctatgaagagagataatttgacttattcttttcctatttgaatttcctctttttctttctcttgcataactgctatgctatgactaccagtactatgttgagccagaatagtgagaatgggcaaccttgtcttgttctgattcttaaggggaatgaatccagcttttgccagttcagtatgagcttggctgtgaatttgtcatagataactcattattttgaggtatactcctttgatgtctaatttgttgagggttttttatcatgaggagatgttgggtttcatttaaaactttttctgcatctattgatgatcatgaagtttttacttgtgtttgtgttttttgtaaattttgtttatttgttgaatcacatttatttatttgcatatgttgaaccaaccttgcctcccatgaataaagcctattcaatcatggtgaattaactttttgatgtgtcgctggattcagtttgctagtattttgttgaggatttttgtgtctgttcatcaggaatattggcctgtagtttcctttttttgttgtgcttgtgtcagattttggtatcaggatgatgctggttttatagaatgagttagggaggagttccttctcctcattttttggggaatgtttcagtgggattggcaccagctcttctttgcacgtctggcagaatttggctgtgaactaattggtctaggacatttcttggttagtaggttttttattactggtttatatttttcaaacttgctattggtctgttcaggatctcaatttcttcctaattcttccttggaaggttttgtgtttctaggaatttattcatttcctctagatttctagtttgtgtgcacagaggtgttcataatggtctctgaggctcttttgtattaccgtgggtatcagttctgattgtatttatttgaatcttctttctttgttagtttacctagcattctatcaatctcacgtattctttgaaagaaccaactttcaatttcattaatcttttatatggctttttgggtctcaattttatttctgctgtgatttttgttatttattttattctggtagctttgtattagtttgttcttgtttttttaggtcctttaggtgtgatgttagattgataatttggtatctttctagctttttgaggtaggcaaaccatttaagcactataaactttcttcttaatattgctttttctacattccagagattttggtaaattgtgtctctgttttcatttactttaaataattatttgatttctgctttaattttgttaactcaaaagttattaagaaacaagttctttagttttccattttattgtgtgattttgaagtatcttcttgatattgccttctatttttattcttcgtggcccaaaaatatgcttggtgttgtttcttcattaaaaaaagttattgagacttgctttatggccaaatatgtggttgatcttagagtatatgccatgtgcaaatgaaaagaatgtatcttatgtggttgttgggtggaacattttgtcaatttttattaggtccaattggtgaagtgttgaatttaagtcagcatttccttgttagttttctgcctcactcatctatttttctaattagtatgattcagttttttttttctgacattgcagttttcttcacctatcacaacacttcaagaagactattacaagaatactacaagttttacacataatatcatcaaaggagtgacacattggcgaaaaaccatgataaatattcaaaaaaactagaacatacatttgtatattctttcattaattgtattagctttttcctccttttgtgcccgtacttattagaatctttttcataaaaaagcagttttctttctttcttgttttttttttttgagacaggatcttgttctgcaacccaggctagtgtgcagtagtgtgattatggctcattgcagccttgaattcctaggctcaagcaaatcctcccacctcagcctcccaagtagctgggactacaagtttgtgccactagacccaattaattttatgttattttattttatttttgtagagtcagggtcttggtatattgcccaggctggtctcaaactcgtgggttcaagtgatcctcccaccttggccccgcaaagtgctgggattataggtgttagccaccacacatggcagcaatttttgactagagctgattgcaaatgtttgtagagaagaattgagaataataacactggatgaccaaaattcggtgtagctatggctaagatttgatgaaagttcccaatagacaaggaaattttgttatttctattatttgcagcattttaagataacaaccagaatcattatgacagtgtcatgttagagacatcaggctttcataaatgttatatcgtctttagaatattcacatgaataacatacccatacaaatataacttaagatttaacatagtaatcaaaattatgactgataacaaattagctttttgtaaatttatataagttttggaacatttatgtcaataatgtacccataattgtaacagaaagatctaatatcaattatcatttgataatactttacaaagaatctaccaaataagtttaattatttaatacaaaaagacttaatttacgattttcatcctgggggaacatgacaaagacgtcaaaagtttcaaaaaactagatcaaaataaaaccataggtcactggaaaataaaagttattcatatacgtagagtggtaatcaaaatactttgaaagaaatacagaaatttttatgaatgtaaaatccttaacccttttaaatttcagttttcctaagtaatatgaaacctaataagaataatgcagaaattgttttaataaaacataaaatctttgctttttagaccagctactataaaggtaaacaaacaaataaacaaaaatccctacaaaacctcctatagtgttaatttagtttggatgtgtgtcccctccaaatctcatgttgaaatgttaccttcagtgttggagatggcctagtgggaggtgtttgggccatagaggcagatactttatgaatgactcattgccatccccatggcaatgagtgagttcttgctctggtagtttatgcaagagctggttgtttaaaggagcttggcacctcctcctctctcttgctccctctcttgccatgtgacatgcctgctcctcattcaccttccaccataaatgtaattgtaatcttcctgaggccctcaccagaatcagatgctggcactgttcttcttgtacagtctgcagaactgtgagccaaaataaatgtctttataatttacccagtctcaggtatttctttatagcaatgcaaaatggagcaacacaagtatgactaattctccttatgggaagcccatttagatagcctggaagtcaagcctgataaaaagggtagtggaccttaatcagatgtaagaacagtgtgtccatgattatatgtgtacacgattgtataaaggaatgtaaacaggaaaactcataccttgagcacagaaacacatggctgtcagtaacagcatgagaattcccctctattgaagaaaagccaagagtacagaatcaaattattctagaggaaaacactgctattctagaccttcaagataagcattttagtgtccagccacaacatcagaggtagagtggaagaaaatagttacgggagttaataaaaagattgaagaagagagttatcatcccaggtaagcaaaaagatttaccttttaagggaataaagaacagaaggcaatgacatataaactgcaaatcacatttagtgagatagagcagaatttgaacttctgggacataaatttgagaaatttcaaaaagaaacagataaaacctcttgtaattttattaataacaaataaatactttcatgaaatcttattctaacataggggaccaatttttagttttgcattagtgtatttttaatatcaaaactccatatttagaaagataaatatttgtgttacagcaaacttaatcacatacaaacttcctttaataaatgtcttttcaactatcttattgtgacttacacagactacttaagacatcctgggactttttgctctttcttatatttcctttttcttaaatacccagtcatttcactgtaggaaaaaatttactatacaagattctttcttatacaaaattattctcttttctttttaacctctttttgtttttttacaaaaaagtacatttccatatccataacttctttcactttctcttccaattacttgtttctttctgtcttatttcataaataacctttaaataacctctgaattagacaaaattttcttttctcaataagaacacatttcatgcctttcttgtattttttcttatcaaaaatacaacttattttttggcatactttatatacaaaattatatgttagttagaaattttaactcttagtaaccttaaattttggtgtaaacttagtaagcaagatcttgacttgtctgccacatatcagtattttatagaaaagagccatttcatcattttttaaacgttttcttacaatattttcttaattgaaaatgacacttaatgagtttctattatttaatttatcataagtttaagatttcaaattacataaaaggtttatttataagcattttttatttacatttgcctaatttacttacttttaacagtataacaagattacttatgcaaactgagatattagacaaagctgataagtatttcaagttattttgttgttaacaacttttatagcctatgaatatcaaatgttcatttaaataagaacctgaaagttacatatatgggtattttgcctctaactcataagataggtctgttttcgtgaaaacaacattaaatcagccttacttatcaaaaaacacacaaagatcattctgtttttggcttgatttatagttttatagccttcataccaaaccccgacactttttttttttttttttgagacggagtcttgctctgtcgcccaggctggagtgcagtggcgcaatctcagctcactgcaagctccgcctcccgggttcacgccattctcctgcctcagcctcccgcgtagctgggactacaggcgcctgccatcacgcccggctaatttttttgtatttttagtagagacggggtttcaccgtgttagccaggatggtctcgatctcctgacctcgtgatccgcccgcctcggcctcccaaagtggtgggattacaggcgtgagccaccgcgcccagccccctgacactttaaaatatctagcagaaacaactataagacttttagataagtaaatgcaggcaaaaatgtgtgctgacatttctgaaaacatttctatgtatattttattaataattctaaaaccagcttacttattaaagatttaagtcatgtgaacttggaaaatatttgtacttcctaatgtatgcatgtttatttataagtcaatttgataccatatagacaaaacatgaaaaatacatgtacacctacataaacacatctaaacacatacacacacataaatatcttatagctttcattctataattttgtcatgagatggtaatataaactcactggtttaccaaagatggctggattcaaattgtattcctgacaaaactggaacctgttcagatggctaaatttcatttgccccagagggtaatgtaatgaaggctatgaaacaaagttttgaaaaaagcagtttccatggcaatttgatttaaaaaaacccacaaaactcttttcatatatttttttcaccttcagtttcaaatgagtttagggttaaattttcaatttttgcattttagctagaactggctgaattgtataagaaaaacaaaatacccaagtagttttggattagcaataccatgcatcagcagtgcattttatctcaacagcagcacaaaagtcagcaaattcaatgtaggggagagagagagagagagagaggaattagaagattctacataaatggattgaagtctccaataaaaaaacagagattggcagaatggataaaaacacatgatccaacacatgatcatagaaacacatgatcagctttgtagatttgctatctacaaagtctcactttacattcaaagacacaactagattgaaagtgaacagacaaagatattccatgaaaagagtaaccaaaagagagcagggatagttatattagtatcacacaaaataaactttaaataaaaaaagtttacaagagacaaagaagtacactatatattaatactaataaaaggttcaatgcagcaaggatatgcttgatatgtcaagatatgcatgacacactgaatgacagaccactaaaatatgcaacgtaaaaactgtcagaattgaagggagaaatagttctacaataatggttggagactgcaatatccacttatttatttatgtatttaattttactttaatttctgggatacatgtgtagaatgtgcaggcttgttacataggtatacatgtgccacggtggtttgcttcacctatcaactcatcatctaggttttaagccccgcaggcattaggtatttgtcctaatgctcttcctccccttgtccccccaccccctaacgggccctggtgtgtgatgttcccctccctgtgtccatgtgttctcattgttcaattcccacttttaagtgaaaacgtgtggtgtttggtcttctgtgcctgtgttagtttgctgagaatgatggcttccagcttcatccatgtccctgcaaaggacatgaattcattcttttttatgactgcatggtattccatggtgtatatatacccacttcttaataatagaacaaccagacagcatataagtaaggaaataggggacttaaacacacgataaaccaactagatctaacagacatatagaaaacattacccaacaaaaacagcatgcatatttttctaaagtgcttatgggatgttttccaggatagagcatatgttaggccacaaattaagtctcaataaatttaaaaagatggatatcataaaaagtatcttctttaaccacagtgggatgaagctagaaattagtaattgaagaaaaactaaaaaaatccaagaacttttggaaattaaacaacacatttttaaacaaccaatggatcaaagaagcaatcataggggaaattagaaaataatgagatgaatgaacataaaaaagcaccacctaccaacccaaggggtaaaatgtgtacctataaatatttgtatcaaaaaacaaaaaaatctctctatgaacaacctaactttacaacttaagcaactagaaaaagaggaacaaacttaactcaaagctagcagaaggaaggaaataacaaagattagagcagagataaacacaaaaaatagaaaaaaatagagaaaatcaaaagttgtttcttgggagagatgaacaaaattgacatatttttagctagatgaactaagaaaaaaagaaggagattcaaattactaaaatcagaagtgaaaatgcggacaagtctacaaaaataaaataggactataagagtactatgaacaattgtatgccaacgaattaagacaacctagatgaaatggacaagttcctggaaacacgaaacccaccatgactaaatcatgaagaaatagaaaatctgaatagacctataactggtaaaaggattgagagtccagaaataatctgttccagatacagtcaaatcacttttgacaaggaacccaagacccttcagggggaagaaggacagtcttttcaataaattgtgctgagagaactagatatccacatgcgaaagaatgaagttggattctttcctaacaccatacaaaaaaattaactaaaatggatcaaagacctaaatgtatgacctaaaacaataacattcttagaagaaaacacaggacaaaaacatcacagtattggatttggcaacgaatttttgaattcaacaccaaaggcacaggcaataaaagaaaaaatatgcaaactgaatttcatgacttaaaaaacatttcgtgcatcaaaaaccactataaacagagtaaaaaggcaacccacagaaccacagaaaatattgtcaaatcatgtatgtgataaatagagaactcttgaaagtcaacaacaacaaccacaaaaaccaaacaacttaattcaaaactggacaaagaacttcaatagatatttctcaaaagaagatatacaaatggccaataagcacataaaaagatgctcaataatgctcaatatgactaatcattagtgaagaatgcaaatcaaaactacaaaaagatatcaatgtatacgtccccagtaggatacctactatctagtaaagggaaaataacaagtattgttgaggaggggttggctgcacaccagcatggtacctgtgccccggctcatggccttcttggagtcagctccttccccagatccccaagggccaaggtcttcatagaacaggaggctgaaaggaagaaccaacctcagtgcctagacatgagcggcagtgctgaaccccacgtggagcccacatcacaggttaactctaaaggtcatctgtcccaagtccacagggacagggggagcttggccagtgcccgggctcctggggagtggccagacctgccacagcagtccccgggctggccagggctgggcctggtgtgtggagggcagggggaactcacctgtctctgaggatcacatactcagcaggcacctgaggctgtcctagccttctccactgagtcttccaagcctgcatggggcaggcgtggggcagggagggactcagcaggaggcccaggcccatcaacagcacagttgccaagccaacagccagcagcacccctggaaggtgggcgggagaggggaatggggctacatggtggccactcagagcccctccaggctgcctgggaacgtgagaaccgctgttttgcatttgcctcagtggccctggcctctgccctgctgcccttgcggttgaactcttcacagctcctttcctgtctctgggccattagtctccctctgggaggccctccccactaccctgtgcccttctgtgtgaggaccctcctgggacagccccacatgtgacctgtgttctgaatgtatgtgtgcatgcatgcatgtatgcgtgcatgtgtgcgtgtgtgtgtgtgtgtgtgtgtgtgtgtgaaagaaagagctgctgccctgtgcccagggctgagtcttagccgtcagagggctgtgtcctctctgcccactgggcaggccccagcctgaagagctcagtgcggattgctgacctctggagaaaagaaggaaggaagatgggaaacccacactgggggctagtctaggatgtctgtgatcctgtgactccactcagggaccctgtccactggggcagcttccaggaaaaatgagcatgagaagtggggaaggggaggtgagaaaggaggccccaaatggagaaaatttttgccttcaaatgaagtcccaggtcaaggacaagctgcaccatgccactgtcactgtcatcatatctggagtttggtggctacgcccagagcctcggacagggctgacacacactaggggcccaggaactcggacagggctgacagacactcagggccctgtggcatggcactcctccctgcctgctcaagtcctggctgctatgtcctgtcaatcagtacctgtgatcactgcccagtctgggcccaggtttggcagcctgtgcctgaggatgctttgcctgcccagctgatatggggatgagggctgcacagggcacaggccaggactacaggccaccccctcctccttcaccagcaccacggccaggctctctggctgcccattgtcttgaaacatgtatgtgcctggatctaggaactggtgggcaaacctgaggagcagagatcaggagtcagaatgtgaaggttcacctgcagtgggctactcacaccaagccaactctcaatgtctccccgcatatggaacaacgtggtccagggaagctgccatgacccctgctgggcaccaggaggccccgcctgccaagctcccctctgccccgtaaacaggaggcctctcctgcccctgggctctggcctggtcacctgcatggtctgcagtctcctgtgttctcctattggcccgtcgagggagaggctgtgagttgcacggaggaacctcacccctttccctcccacctcccaaactccagggagctcagctgtgttaccttgagaagttgaggtgagtctctcgcaccaggtggctgagtctgcggaaggccctggagtcccagtggaggttgctgttgaacagatgctgcttctggtacatggggttgtggctggccgagcggtctgggggatgaatgcagggctgggctaggttccagagctcatctcagccccactgctgagcaactcaggtccagggatggacccagtatctgtcctcagaagagtgaggggaactgaggtatgcttcccatgagatgacacgattcaccctgtcatgcctgtgatggtgcatttaatgatcttggtgccagggcaagccctcctccctctgcctacagaggtcactggcacacagagagcatgctctcagcagagccaccaggcaccacacctttcgtggtgatcatggtcaatgccctggccttctcctttgtttgtgtcctctcttattcccttgagcggtggcttgtagttctatttgaagaggttcttcacacccctcattagctgtattcctaggtattttattctctttgtaacaattgtgaatgggaggctttgtgcagggtctttatttgaagctgactttctagctttttctttttcatgaatttggagacatttatgagactttataatattgatttcaagttgagaatatttttaatatagtagctttctcttgaaattcctcactgtttgactttttgttcattcattgaacaggacaagttttctatggggcagatgaatatagtaaatattgtgtgttataacaatgcagggttattggttgttacaagagaatagaattgacagacacatcatggtgcctgatggcaactagcatcagctctaatatatgcagtttttgtctctctcgtcaggattgttttggtaggcacactttcagaactcttccattagatttcttcaaaattgtttagggttcctctcaagttttgttcagatgtttataagcttattgactttcccatggcagtttcttggaatgagaaatgtctcgaagtaaccacttctttctcttcccttctccatgttcttctcttctttcctctttcccctttttcctctctctttgcttttctcccctcttccccttctcccttctctctccttccttcttcctcctactccttttccttcttttttaagtaagatatgaggacatgtttcgctttgtctaggaaaatgtttgcattttctctttcacattagtttatgaatagagaggaggaaagtaaagtaatataaagcagattggacctaaaagacttgggtttaagctccagttctgccactatttgtgtttcttaatgcttcaggcttagttttttcatttgtaaaatgaggatccttataaatagccatcttaaccatgaaggattttgtaaggaacaaagagacactatgtgcaaaaatgatctgtttaactataaagtgctttctaagtgtaacctctgtgtgttttatgccttctgcttcttgggctccatcagagactcaaattattacttccagattattgttttccatcaccactattcagtagtactctactggtaaagccctgccatggaaattatttgaaattcaagtagtaacttccaatttttcttatccaaacaagtagtaatagcatgtttcttaatttaccatagtaaaaggaaaagcctaaatttctatgacacttcttctgtgtcctgatcatctagaaattgtgtagtcccttgtgatttctgtgggatgctggcttgagatattatttttccatcaaaatactttattcatagcttagtattaaataatgccttgaatcatgatgctatatgtttctgttagtgatatcaatttaaattataaactaattattaaaactattacatatgatcttactagaaattcctaaaccatagactgttgtctttttaagtaaacaacataataaatatactgtcttctaattagtgcagatcatagcagttctgtgctgcgtgcagtggcttgtgcctgtaaccccagctactcaggaggctgaagtgggaggatcacttgaggccaggagtttgggaccagcctaggcaacatagcaagaccccatatctaaaaaaaaatttttttttttaattagccatgtgtgatggtacacacctgtagttccagctacatgggaggctgaggaaggaggattgcttgagcccaggaatttgatgttgcagtgagccatgatcatgccactgcactcaaaaattttttcagttttggctgggcatggtggctcacacctgtaatcccagcactttgggaggctgagacagatggatcaggagattgagaccatcctggctaacatggtgaaaccccgtgtctactaaaaatccaaaaataattagccgagcctggtggcgagtgcctgtagtcccagctactcgggagtctgaggcaggagaatggcgtgaacccaggaggcagagcttgcagtgagccaagatcgcgccactgcactccagcctgggtgacagagcgagactctctctcaaaaaaaaaaaaaaaaaaaaattttttttttttagtttttttggaaaaaaatatttctaagcaaatcactggttttaacagttttgcttattttttacattatattacattaattttcacagctatactcaaatagctatatgccgaaaaggactttaacaacctaattctgtgtagcagtgaataagcataacttattgcattctatagggaaagctgaaagttatcctattaaaatgtcaagtagaacaagttttaaaaatgttattttattttatttcttttcctttttttttcttttttttttttttttgagacagagtttcactcttgttgcccaggctggagtgcaatggtgcaatctcagctgactgcaacctccgcctcccgggttcaagcaattctcctgtctcagcctcccgagtagctgggattacaagcatgcactgccacacccggctaatgttgtagttttaatagagacagggtttctccgtgttggtcaggctggtctcgaactcctgacctcaggtgatccgcctgccttggcctcccaaagtgcagggattacaggtgcgagtcactgcacttggcccttatttttctttgccatcattattatcagtattctcgtcatcaccagttaagtgtaataacaaccctgagattatacatgcatgtaaaaagtgatcagtttcaaactgtgtgaagcctaacttctgcagcagcatttagtctccacattcaggaactttaggaggaaaaagaatggaactaagagctattaactatttttttagccacagtataaagaatcccacgtccgtttgtgtcgtggccctcctaatggtttttgaagtgacagtttattcatttttctaatctacttaggcatcctatgcaacccataacttctttggttttctattaatttcttaaattgatttataagctcattgaaggtagaagtggagtggaaccttctatgtcaggaagaaaagtaatacatgcttattattacaaactctaccccttcctattctaatcctgttctccagtggtaacacaattcatttttcttctacacctaaacattaaaagcagaggacttttggtttatttatttaaagtaggatacttagtaaatagtaatctgcaatgacagtaataaatgtcatttatctttattctttgtaaggttatactgaggcgatgagtctagaaacaagtttttccccccaagagttgcttttattacttaataccatatttaatgttgaaaatacattcatacttgcaatttgaggttccacatgcttcttatggattttgcctgctctttttgtcaggcagtgagaacaaggactctgtctgtaagatgttggtgatggtccctctgaattacagctggcaactcatcagagtctagaagatggagggattaagcctctagggtaaaagaaggtagattaggcaatatatttatatgtggaactctgagaattggggtgtcctgttggcataactcttcagatacacctttttttttttttttttttttttttgagctggagtctcgcactgtcacccaggctggagcgcagtggcgcgatctcggctcactgcaagctccgcctcctgggttcacaccattctcctgcctcagcctcccgagtagctggtaaggtgccgccaccacgcctggctgattttttttgttttgttttgtttttgttttttttgtatttttagtagagacggggtttttaccatgttaggcaggatggtctccacctcctgacctcgtgatctgcccatctcggcctcccaaagtgctgggattacaggcgtgagccgccatgcctggcccagatacacctttctaccttagtctggctacctagggaaaattagaatagattattagaatatggtttgtatttataaaagaatacacattcagtacgggttttctgttcccagtctgccacactgatcttgctttttttgtttgtctaatagatttgctagatgttagagtgggaggtgctgtaagcatagaagtatttcttgattttaggaacatatcccaaatagttaaacaaattattgtagcatcattaaataatcctttgatttctcctatccagttgtgttttttgttttttgttttgttttgttttttttgagacagtctcactctgtcgcccaggctggagtgcagtggcgcaatctcggctcactgcaagctctgcctcccgggttcacgccattctcctgcgtcagcctcccgagtagctgggactacaggtgcccgccaccacgcctggctaattttttgtatttttagtagagacggggtttcaccgtgttagccaggatggtctcgatctcctgacctcgtgatccacccaccttggcctcccaaagtgctgggattacagccgtgagccaccgcgcccggccac

SEQ ID NO: 11826 - DNA, 1195 bp, Homo sapiens
atatggagagtcaattgcattttattatgcccaaaggtaaatgcataatttttccgcacagctaatcttctagcaaccccattgctgtccatggcaaacaggcttagttaatctcgccctttcccgtttcaggttcattaaaaaactcttgtcaaaatctctttcatcccaccttattcttcattctcacttccatcagcatatcagtccaggccctagtaacattaatgttactaatggcactgttagtaacattacttaccagcattcaagtgggtcttcctgatgccattctctcccatcctgaaatcactgctctttatatagaacttgtatgatgtcattcattggatcaaaaactattaaagccttcctttttctaccaccccaatctaaatttctatgcctggcttttattaaaacccagaatttggccccaccctagctatttaactttattttccactattcaccagtctcctccctcatcaacgagaagacataccataatcaacctcaccactaacgcttggaatatctaaacttaaaaatggtccttcctttcccctttacttgtgtttaaagaacctgacgaattattcctcctctgctaaacttttcacaatttcttcaacctcatttatgtttcagattttcagaacatatcttgccgtttattaggaatctcacaattaggcactctcatgtagatagatttacaatcatgtatgttgtcatcttctattaaattccatactccttgaaggcaggagccatgccttattctgtcccccagagtactcagaatgatgcagagcacacagaaagtactcaaatcttgttgactgatccagtgagaaatgaccaacttcagttccagcctctctttaacatgtacatagcaatttgggcaagtcaagctccatcctgaaggacataataggggactctttaagcacattattatgaaggcccttcagggataacaccagagtgatgaggtgccctataccagggataatggagacagagttcttgggattcatcactggggtcctcaaagcatcttccaagggcataataaggaaggactcaaacacctttgaatctccgtgagaccaggcatgaggtcttttgaaagagttctttaactggagtgaatgtcaaagagaagtataataaaataaaagacctg

SEQ ID NO: 11827 - DNA, 1195 bp, Homo sapiens
atatggagagtcaattgcattttattatgcccaaaggtaaatgcataatttttccgcacagctaatcttctagcaaccccattgctgtccatggcaaacaggcttagttaatctcgccctttcccgtttcaggttcattaaaaaactcttgtcaaaatctctttcatcccaccttattcttcattctcacttccatcagcatatcagtccaggccctagtaacattaatgttactaatggcactgttagtaacattacttaccagcattcaagtgggtcttcctgatgccattctctcccatcctgaaatcactgctctttatatagaacttgtatgatgtcattcattggatcaaaaactattaaagccttcctttttctaccaccccaatctaaatttctatgcctggcttttattaaaacccagaatttggccccaccctagctatttaactttattttccactattcaccagtctcctccctcatcaacgagaagacataccataatcaacctcaccactaacgcttggaatatctaaacttaaaaatggtccttcctttcccctttacttgtgtttaaagaacctgacgaattattcctcctctgctaaacttttcacaatttcttcaacctcatttatgtttcagattttcagaacatatcttgccgtttattaggaatctcacaattaggcactctcatgtagatagatttacaatcatgtatgttgtcatcttctattaaattccatactccttgaaggcaggagccatgccttattctgtcccccagagtactcagaatgatgcagagcacacagaaagtactcaaatcttgttgactgatccagtgagaaatgaccaacttcagttccagcctctctttaatatgtacatagcaatttgggcaagtcaagctccatcctgaaggacataataggggactctttaagcacattattatgaaggcccttcagggataacaccagagtgatgaggtgccctataccagggataatggagacagagttcttgggattcatcactggggtcctcaaagcatcttccaagggcataataaggaaggactcaaacacctttgaatctccgtgagaccaggcatgaggtcttttgaaagagttctttaactggagtgaatgtcaaagagaagtataataaaataaaagacctg

SEQ ID NO: 11828 - DNA, 1240 bp, Homo sapiens
caattttgttccacagttgtttgaatcggtggatgcagaacccatgaatatggagagtcaatttcatttcataatgcccaaaggtaaatgcgtaactttttccgcacagctaatcttctagcaaccccattgctgtccatggcaagcaggcttagttaatctcgccctttccagtttcaggttcattaaaaaactcttgtcaaactctctttcatcccatcttattcttcattctcacttccatcagcatatcagtccaggccctagtaacattaatgttactaatggcactgttagtaatattacttaccagcattcaagtgggtctccctgatgccattgtctcccatcctgaaatcactgctctttatatagaacttgtatgatgtcattcattggctcaaaaacttttaaagccttcctttttctactaccccaatctaaatttctatgcctggcttttattaaaacccgtaatttggccccaccctagctatttaactttattttccactattcgccagtctcctccctcatcaacgagaagacataccataatcaacctcaccactaacccttggaatatctaaacttaaaaatggtccttcttttcccctttacttgtatttaaagaacctgacgaattattcctcctctgctaaacttttcacaatttcttcaacctcatttacttttcaagttttcagaacatatcttgccgtttattaggaatctcacaattaggcactctactgtagatagatttacaatcatgtatgttgtcatcttctattaaattccatactccttgaaggcaggagtcatgccttattctgtccctcagagtactcagaatgatgcagagcacacagaaagtactcaaatcttgttgactgatccagtgagaaattaccaacttcagttccagcctctctttaacatgtacatagtaatttgggtaagtcaagctccatcctgaaggacataataagggactctttaagcacattattatgaaggcccttcagggataacaccagagtgatgaggtgccctataccagggacaatggagacagagtacttgggattcatcactggagtcctcaaagcatcttccaagggcataataaggaaggactcaaacacctttgaatctccgtgagaccaggcatgaggtcttttgaaagagttctttaactggagtgaatgtcaaagagaagtataataaaataaaagac

SEQ ID NO: 11829 - DNA, 1194 bp, Homo sapiens
atatggagagtcaattgcatttcattatgcccaaaggtaaatgcataactttttccgcacagctaatcttctagcaaccccattgttgtccatggcaagcaggcgtagttaatctcgccctttcccgtttcaggttcattaaaaaactcttgtcaaagtctctttcatcccaccttattcttcattctcacttccatcagcatatcagtccaggccctagtaacattaatgttactaatggcattgttagtaacattacttaccagcattcaagtgggtcttcctgatgccattctctctcagcctgaaatcactgctgtttatatagaacttgtatgatgtcattcattggctcaaaaacttttaaagccttcctttttctaccaccccaatctaaatttctatgcctggcttttattaaaacccgtaatttggcaccaccctagctatttaactttattttccactattcgccagtctcctccctcatcaatgagaagacataccataatcaacctcaccactaacccttggaatatctaaagttaaaaatggtccttcctttcccctttacttgtatttaaagaacctgacgaattattcctcctctgctaaacttttcacaatttcttcaacctcatttatgtttcacattttcagaacatatcttgccatttattaggaatctcacaattaggcactctcatgtagatagatttacaatcatgtatgttgtcatcttctattaaattccatactccttgaaggcaggagccatgccttattctgtcctccagagtactcagaatgatgcagagcacacagaaagtactcaaatcttgttgactgatccagtgagaaatgaccaacttcagttccagcctctctttaacatgtacatagcaatttgggcaagtcaagctccatcctgaaggacataataggggactctttaagcacattattatgaaggcccttcagggataacaccggagtgatgaggtgccctataccagggataatggagacagagttcttgggattcatcactggggtcctcaaagcatcttccaagggcataataaggaaggactcaaacacctttgaatcttcgtgagaccaggcatgaggtcttttgaaagagttctttaactggagtgaatgtcaaagagaagtataataaaataaaagacc

SEQ ID NO: 11830 - DNA, 807 bp, Homo sapiens
ctgatgagtcatctccttagacttgcattttaaagagatagatagttatcaggttccagagaagacatggtagaacatttatatctcaaagacacagagctgagacttcaggtttagatactataatttgcctaaaccaaaaaggaaggtgtaggtaaagttctagtcaggacaggatggccaggaaaaacaccttaaagcaagggatggcttgctttgctgatttaagccaatggcttctttatcataagacttcccagtgatttagtcctccctctcttccagtgcacagagacatacccctccttacaaataaaaatgttctttatagatggaaatttattttacaaaaatgtttcaaaataaccagatgaaaatcatccttatgccagaaagacttgttgtttttttttttttttttactagaaatgaaacagtatttgttgtattgacatacttaggcttagacctatgtttaacaagaaagcctaataataacactgtggttagactgtagcctatttttccaaatcatcattttattattaaggaaagaaaggatcaaatacctttcattcatctgatatgatcctttaaaacacattccactaatgagtcacatttggaacagctgaaaatcttttaataaaactttttaaagatgagctcatggcttagtgtatatttcacaagcttaattaggtcaaatggaaggaactcagatgagtagttgcccaatcagagcccattatttgtaagtcatcagcccccttcatgaccttaaaactccaccctgacctaattatt

SEQ ID NO: 11831 - DNA, 492 bp, Homo sapiens
aggttcagaaatttatttttatcagcgtcaatagggtagctacattgcttagaagcaaacaaaaataaccatgcttcaatagaaatcaggatatagatgtattaatacagaatgaccaatataaatgtgacagaaataggaatgcctgtttatggtcatatacggccaatactttcattacagccaaactcatacatgcagccaaataagaggcccctggatacacaggaaatcagaataaaaaaagaactgaacatttaatagtcttctttcattcaatcaataattttttttaattaagcaactactatgtccaggtaaccttctaggtcctggggatacagagttctctgcttacagaagtcatatgtaagtagcaggtgaagagtatgtgtttcacagaaggttattacaatatattaacaagagcaaaaaattttggaagcaatctaaatgttcaataatagagctccaattaaatgacaataaatc

SEQ ID NO: 11832 - DNA, 296 bp, Homo sapiens
tagcccagcgataacatttggtcatatcatgttatttctgttttgcatgaagtgaagaagctgaagtctagagaaactgagatattgaaattttattcaaagaaaatgcaaacatagcatcctaatttctttaggcccatgttggtaaaggtgactgagatggagacagttcataaagagcttaggcatgtagatcacaaaaactgtctctgcatgtattcagcttaagttttagcccttcaattggagttgtgattccagagttatttctaaatatagaaaaatgaaccataaca

SEQ ID NO: 11833 - DNA, 242 bp, Homo sapiens
aggcgggcagatcacgaggtcaggagattgagaccatcctggctaatggtgaaaccccgtctctactaaaaatacaaaaaattagccgggcttggtggcgggcgcctgtagtcccagctactcgggagactgaggcaggagaatggcgcgaaccgggaggcgcagcttgcagtgagccgagatcgcgccactgcactctagcctgggtgacagaaagagactccttctcaaaaaaataaaaa

SEQ ID NO: 11834 - DNA, 806 bp, Homo sapiens
ctgatgagtcatctccttagacttgcattttaaagagatagatagttatcaggttccagagaagacatggtagaacatttatatctcaaagacacagagctgagacttcaggtttagatactataatttgcctaaaccaaaaaggaaggtgtaggtaaagttctagtcaggacaggatggccaggaaaaacaccttaaagcaagggatggtttgctttgctgatttaagccaatggcttctttatcataagacttcccagtgatttagtcctccctctcttccagtgcacagagacatacccctccttacaaataaaaatgttctttatagatggaaatttattttacaaaaatgtttcaaaataaccagatgaaaatcatccttatgccagaaagacttgttgttttttttttttttttactagaaatgaaacagtatttgttgtattgacatacttaggcttagacctatgtttaacaagaaagcctaataataacactgtggttagactgtagcctatttttccaaatcatcattttattattaaggaaagaaaggatcaaatacctttcattcatctgatatgatcctttaaaacacattccactaatgagtcacatttggaacagctgaaaatcttttaataaaactttttaaagatgagctcatggcttagtgtatatttcacaagcttaattaggtcaaatggaaggaactcagatgagtagttgcccaatcagagcccattatttgtaagtcatcagcccccttcatgaccttaaaactccaccctgacctaattatt

SEQ ID NO: 11835 - DNA, 494 bp, Homo sapiens
aggttcagaattttatttttatcatcatcaatagcgtagctacattgcttagaagaaaacaaaaataaccatgtttcaatagaaatcaggatatagatgtattaatacagaatgacaaatataactgtgacagaaataggaatgcctgtttatggtcatatacggccaatactttcattacagccaaactcatacatgcagccaaataagaggcccctggatacacagggaatcagaataaaaaaagaagaactgaacatttaatagtcttctttcattcaatcaataatttttttaattaagcaactactatgtccaggtaaccttctaggtcctggggatacagaggtctctgcttacagaagtcatatgtaagtagcaggtgaagagtatgtgtttcacagaagtttattacaatatattaacaagagcaaaaaattttggaagcaatctaaatgttcaataatagagttccaattaaataacaataaatc

SEQ ID NO: 11836 - DNA, 809 bp, Homo sapiens
ctgatgagtcatctccctagacttgcattttaaagagatagatagttatcaggttccagagaagacatggtagaacatttatatctcaaagacacagagctgagacttcaggtttagatacaataatttacctaaaccaaaaaggaaggtgtaggtaaagttctagtcgagacaggatggccaggaaaaacaccttaaaccaagggatggcttgctttgctgatttaagccaatggcttctttatcataagacttcccagtgatttagtcctccctctcttccagtgcacagacgcatgaccctccttacaaataaaaatgttctttatagatgtaaatttattttacaaaaatgtttcaaaataactagatgaaaatcatccttatgccagaaagacttgttttttttttttcattactagaaatgaaacagtaagtatttgttgtattgacatactaaggctaagacctatgtttaacaagaaagcctaataatagcactgtggttagactgtagcctatttttccaaaccatcattttattattaaggaaagaaaggatcaaatacctttcattcatctgatatgatcctttaaaacacattccactaataagtcccatttggaacagctgaaaatcttttaataaaactttttaaagatgagctcatggcttagtgtaaatttcacaagcttaattaggtcaaatggaaggaactcagatgagtagttgcccaatcagagcccattatttgtaaatcatcagcccccttcatgaccttaaaaactccactctgacctaattattg

SEQ ID NO: 11837 - DNA, 1807 bp, Homo sapiens
cgacaagccatccccctgcccttcctgcaggctgccttacccattcagagggaggccgaggctgtgccgggcggcccacagctgcgggaccgcgttccagggtgtgctctgctgcaagcatgagggaaggacagttaaaagcaaaacggaagccttgcatgggccgcttatgcttctggagctactttttttttttttttttttttactatacatggtatttagataaaggtctagagtaaaaggctctacaaccatcttatgttcagaggtcagtgtgtgacttaatttaacatttcctttacttttgtttttctccatcttgtattttatagccagagcctgaacctcctcgtcgattttttgtcgaccagtgggagctttctcttagtctccgctcctctgcccgccccgcctctccctcctccgactccctccgacaggtagcatggcctaggactcactaaaactctgccctccgcagcctccactcacgtcactttcgcaagtgtcatgtaccccaggaggctgcagtgttcctcacttgggcccgtctcctgtagggagccagctgcatgtgttgctgtttgcctgtgtcggtctcgtgtgtgaggtctgtggcacactcctcagctaaagtggctgctggctttcatccaactgtatctgacacatccaggtctgttgatgtgaacccgctttgatcctatttcaactatatcaaataatgataaatgttttgcagccattggcttttttaacttcacatgtcttccaaaataatatgtgttaaaaagtaggaaccacaatgtaattaaatcacctcaatggaggggtgatgatgcggtattctggctgcctgttgtcatcatttgaggaatgtacgcggctgtcacctgaagtagcgctggtccagttgtagggagtttctagagagattggaaggtctctttgccactcctactggtatttcccatgcctgagttgacgccagacctcacgtcctatgtgcatggtagcatatgcacgcgtatggtgtgcggcgggatctgaagtagcactggttcagttgtagggagtttctagagagattggaaggtctctttgccgctcctactggtatttcccatgcctgggttgaggcctatgtgcatggtagcatatgcacacgtatggtgtgcggtgggatcgatcccgcaattgccacatttctgctattttttatgagtgatgagaaggaaaccatcgcttttcatgccagaaacaaatagaacttgagtcttcacctctcttgcagggatgcttgtcagtgttgccaacttgctgagaactgaatgtggcagatgcctttgcacgggcagccccaggtttagttcaactaaacccagatggtttagttcaggagaaaagggtcctggctgagcagtgagggcccagggctggcttggtgtcctggcctcatacttggcatctggcccacactgccccgtgtctgctgcagaatgagagaaatgccattttctgctccctcagtgtcagctgttaagttacctgctcagctctgcctggtgtctgtctgtcccaagcctcagtttctttagtgtccctaaagaaggtttagatctgagagccacgtgtttgtcttgaccactaataggtataatctgtgaagttaatgggcaaatggcaccaatccttgggaatcttatttttgaattaaaagctataattgcttcttcagttcagctgagccttgagctgagccacaagaacggcttcgtcgtgtgtgcatctgtgagcccctcgag

SEQ ID NO: 11838 - DNA, 448 bp, Homo sapiens
ggtgagttgctgagtcagaattagggtcaggttcccccagggggcagggagcccccttactccatgaagttcatgagaggagcatcacccacatggtggtgtggccatctccacatggaagggtgatttgatcgtgggagtctctagaggacttcctctcgggacaggtcaaggcggggctgcctgggcacccagcttaggtgtgagcagggcggctcatgatggagacgtggaagtttctcctgtggtttcagtgttgccagaaagaggcttgagttggttgggtttttttctcttacctttcttcaacctctaaaataagccctcctggcctagaacacattcccaccttcctgggctggtggagcagcttggctgcatggccacacctcgtggccaacatgcccagcccagtctagaaggctctggcctcagcacctggatgggc

SEQ ID NO: 11839 - DNA, 974 bp, Homo sapiens
gaatagggctacctggagcaaaccctggctccgtaggagtgatcctggggtttcctggctgctggggcggcagtctcgccctcccagtcggcctgcggttggtgggtgggggagggggcggttctcgctgccacggatccagaaggccaaattgaaccctcgttctgggatttctggctcctactcccgcaggccgcttgggtgactgtccttttttggagaggatatagagacacagctgtggcctctgcacactgctcttcttccaggctcaggaaaggccctcgcccaggatgtcgccactcagaaggccgagacccagcggtcttcaatagaagtccgggaggccgggacgcagcgttcggtggaggtccgggaggccgggacccagcgttcggtggaagtccaggaggtcgggacacagggttctccggtggaggtgcaggaggccgggacccagcagtctctccaggctgccaacaagtcggggacccagcgatcccccgaagctgccagcaagggagtgacccagcggtttcgcgaggatgcccgggacccagttactagattatgaaggcatctcaggccctggagccagagccagtcaggggttaaagtgaaagcccgtatttccgcccagaagctggggttggggagaggatgtggattttttgttttaccctttctgttgcatggttgcaaacacaaacttgagttctaataaagaattgcaaagtggaagcccgccccccgcctcccccccgcctcacttaagtccaggaagctggggtggcgaggaaggatgatgtggattgtttttgttttacaccttctgttgaatggttgccaacacaaacttgagttctaataaataattgcatttccctaacgtctgtattttggaaggtagaggggagggaaaggcgcattcctccaacagcccagttctgccctgcgcagccctctacctcgag

SEQ ID NO: 11840 - DNA, 974 bp, Homo sapiens; identical to SEQ ID NO: 11839

SEQ ID NO: 11841 - DNA, 974 bp, Homo sapiens
gaatagggctacctggagcaaaccctggctccgtaggagtgatcctggggtttcctggctgctggggcggcagtctcgccctcccagtcggcctgcggttggtgggtgggggagggggcggttctcgctgccacggatccagaaggccaaattgaaccctcgttctgggatttctggctcctactcccgcaggccgcttgggtgactgtccttttttggagaggatatagagacacagctgtggcctctgcacactgctcttcttccaggctcaggaaaggccctcgcccaggatgtcgccactcagaaggccgagacccagcggtcttcaatagaagtccgggaggccgggacgcagcgttcggtggaggtccgggaggccgggacccagcgttcggtggaagtccaggaggtcgggacacagggttctccggtggaggtgcaggaggccgggacccagcagtctctccaggctgccaacaagtcggggacccagcgatcccccgaagctgccagcaaggcagtgacccagcggtttcgcgaggatgcccgggacccagttactagattatgaaggcatctcaggccctggagccagagccagtcaggggttaaagtgaaagcccgtatttccgcccagaagctggggttggggagaggatgtggattttttgttttaccctttctgttgcatggttgcaaacacaaacttgagttctaataaagaattgcaaagtggaagcccgccccccgcctcccccccgcctcacttaagtccaggaagctggggtggcgaggaaggatgatgtggattgtttttgttttacaccttctgttgaatggttgccaacacaaacttgagttctaataaataattgcatttccctaacgtctgtattttggaaggtagaggggagggaaaggcgcattcctccaacagcccagttctgccctgcgcagccctctacctcgag

SEQ ID NO: 11842 - DNA, 607 bp, Homo sapiens
gctccagctcggcctttgggtttgctgtggtgtccttgtctcctgcaggaccggccgcagcatggacgctcccaggcggtttccgacgctcgtgcaactgatgcagccaaaagcaatgccagtggaggtgctcggtcacctccctaagcggttctcctggttccactctgagttcctgaagaatccgaaggtagttcgccttgaggtttggctggtggaaaagatcttcggtgagtggaccaagaaggggcagcccccatgcggcttctttctgccacccatacccacagcccacatattctggctgcgttccagggcgatcctcaccagtagccaatgccctctggctgtctcctccttccaccttcccctcccaagacccccgggagccaccggtccctcacagcctctctgctacccgcgcaggccggggcggagaacgcatcccgcacgtccagggtatgtcccaaatcttgattcacgtgaatcgattggaccctaacggcgaggctgagatcttggtatttgggaggccttcttaccaggaggacacaatcaagatgatcatgaacctggctgactatcaccgccagctccaggcgaaagg

SEQ ID NO: 11843 - DNA, 607 bp, Homo sapiens
gctccagctcggcctttgggtttgctgtggtgtccttgtctcctgcaggaccggccgcagcatggacgctcccaggcggtttccgacgctcgtgcaactgatgcagccaaaagcaatgccagtggaggtgctcggtcacctccctaagcggttctcctggttccactctgagttcctgaagaatccgaaggtagttcgccttgaggtttggctggtggaaaagatcttcggtgagtggaccaagaaggggcagcccccatgcggcttctttctgccacccatacccacagcccacatattctggctgcgttccagggcgatcctcaccagtagccaatgccctctggctgtctcctccttccaccttcccctcccaagacccccgggagccaccggtccctcacagcctctctgctacccgcgcaggccggggcggagaacgcatcccgcacgtccagggtatgtcccaaatcttgattcacgtgaatcgattggaccctaacggcgaggctgagatcttggtatttgggaggccttcttaccagcaggacacaatcaagatgatcatgaacctggctgactatcaccgccagctccaggcgaaagg

SEQ ID NO: 11844 - DNA, 607 bp, Homo sapiens; identical to SEQ ID NO: 11842

SEQ ID NO: 11845 - DNA, 957 bp, Homo sapiens
cttcaatgaaatttatagaaaagactctcacaagtaccattgaatatagttttctgatgattttgagatcgtagtatttgactgggtaagaattccgaacttcagtgaaaaaactgaactcaaaaaactactaacccaacatcaagcagaataagaattattacatgggactaaagcaatgaaagattatgattttatgacttttttgtttggcacatggcttattctttcatgtttcattttccacattaattttttttttctttcagctatctacagtttacgggaatatgggaaggtgtacttttgtgtgcagaattgaaatttttttttctccctacctgatccctccagagtttggagactatttgtgagtattcttatttcaataacaatatagttatttgcttacatttaagaagaatctattctctttctaataggacacaattggaaacattggccatattaccaaggctttgcctgacatgtcctattctgagatatgaccagattgctctaaggaattaaagttgactttataaagccaattaaaaccccttggaaaatctatcttgatatcttggataaataattaacatggttgatttacaggtgagaaaaaatgtcacttcctgagaggccctggaacctgaatatatttttgggaaccttgagaagagaagtattcactcaagtttaaaggtattacaggcacaatttgagggtgactcctccttggattggcttcccagcctcaagaggctttcaaaagtttaatctgagattccttgtgaaaagttccagcaaagcaaaattgaaaatgagcttatatgattaatcatcattttgctgtacttctgtaaattattaggcaaagtataacaagcctaaaacttattttgcaaacaaattagttttattgtgattaactttggtaaaaaggggggaactcga

SEQ ID NO: 11846 - DNA, 923 bp, Homo sapiens
cttcaatgaaatttatagaaaagactctcacaagtaccattgaatatagttttctgatgattttgagatcgtagtatttgactgggtaagaattccgaacttcagtgaaaaaactgaactcaaaaaactactaacccaacatcaagcagaataagaattattacatgggactaaagcaatgaaagattatgattttatgacttttttgtttggcacatggcttattctttcatgtttcattttccacattaattttttttttctttcagctatctacagtttacgggaatatgggaaggtgtacttttgtgtgcagaattgaaatttttttttctccctacctgatccctccagagtttggagactatttgtgagtattcttatttcaataacaatatagttatttgcttacatttaagaagaatctattctctttctaataggacacaattggaaacattggccatattaccaaggctttgcctgacatgtcctattctgagatatgaccagattgctctaaggaattaaagttgactttataaagccaattaaaaccccttggaaaatctatcttgatatcttggataaataattaacatggttgatttacaggtgagaaaaaatgtcacttcctgagaggccctggaacctgaatatatttttgggaaccttgagaagagaagtattcactcaagtttaaaggtattacaggcacaatttgagggtgactcctccttggattgcttcccagcctcaagaggctttcaaaagtttaatctgagattccttgtgaaaagttccagcaaagcaaaattgaaaatgagcttatatgattaatcatcattttgctgtacttctcggccgtattaggcaaagtataacaagcctaaaacttattttgcaaacaaattagttttatt

SEQ ID NO: 11847 - DNA, 615 bp, Homo sapiens
cttatctcaaaatgtctaaagcaaattttccacagttatcaatcctattttaatatgtaaaactttctgaaaataaatttcaaagaggggactgtgggaaaccaaaatatgccatccaaagcgtgcctctttggcatattttgagatggctattcagagggtctgcagacacaaagcatggctctgaaaatttatccttttgtaaaataaatttacatgtatatattaataaagcaaacaagggatgcaggcagacggtttctctgaggtccttttatttgaatctaggaaagattaactcacaggaaaagaagactaaagacaggtttgacacttttaaaggtctgacagagaaactattaccacaggttaccatctactctttttgagggctattacctgatagaccttctctgcacaatgaaacaacagcctttgttcacagtgcattcttccccttacccttccataacctgtcaccacagcctccaggagcttcaggcctctttttctttctgtatcatataaaaaccttaggcccttctttgagtcctgtattttgtgtagctccctgtgcacgtgcatgtaataaatttgtatgctttttcctgtgaa

SEQ ID NO: 11848 - DNA, 476 bp, Homo sapiens
gaagaccccactcttccctcatgaaccatagcagataagttatcaccccttaccattaagtatccaaacccttattaatggaaatcatccattacgctgcccttgcaggaatcaccctacttactctactctttgccataggaatatatactgtcttgcctcctgggtggaatttcagacaaaaaaaactcaatattcgtaacctcttgcctcataatcctcctcatagcaggtataatagccaccaccaacagatagtggcccctcctaaatgtcctgtctttgcccatcctggcatttcacactcttccttcactgcatcacagaaaacctttcatggtcctacccagaacatcccaccctcacagcattccttgattggatcaccaatcttatatttcaaggggatttacaggaattcactccagatgaagccgaattctttacctttacacttgctctctgtctatttactc

SEQ ID NO: 11849 - DNA, 34762 bp, Homo sapiens
  misc_feature (19530)..(19530): n equals a,t,g, or c
ggccctgtttgctgaaatgttggggccaaacaacttgatagagcctatgatgttcctttcaagctttctaaagtttccaccaacctcagatgaaaatgtaactgtgagaagtaaatttaacaacattgttgtctgcatatgtgtgccaaaatggaagacagaatcatgaaaaagaagcttattttataaccatggtggtggctcatgtttgagtagtaatggtaagtatcaattggtggaaaatttatttaatacaattttgatattactttgactactcttttatcataatctacaaattaaatatcatgttcctgcttcctaagtttatgagtcaggctattttacttaggtgaggtacaacgtatttcttgcctctctattcagtgagaactattcagtgaccataatgtcagatataccaaaacctgatactccaagtttgtgagcagattccagtattcctagaaagaaagatatgtactgagaagcaacataaattaattgaatttttgaaatttcaatctaatatgtactgagaagctcaaatttggcaataaaaatataaatccaaaccaaaataagtttccaaatgcttgagaagagtcttgacttgctactgaaaacataattaatcatcagtacttaataagtactttgaaatattttaatagttttttaccctacctaagagtttctgacccttccattcactgacagaacttagaaatttcacagatttaccaagctcctttgtgagcttgccaacatactgttgcattgtgagcttgccaacatactgctggaaatgacttatttttccttcacagctcaaataaatagttcttttccaaatatgcttttctcgtgtccccaaatagaggtaggaaaactgcagagtttccatatactaaagttaaatattggctgggtgtgatggctcatgtctataaccccagcactttgggaggccaatgtggaagcatcacttgaggccaggaatttgagaccaatctaggcacaatagtgagacccagtctataaaataaagaaaaataaacaattgaatattaaagcatagcttgctttctttgaattgtttcatgcttaacattataggattaaataatgggttgtctcttcctttcaattttttctccaacaatattattatcctttccaagatcaaaatgtactccaggaaaaatgcttcagttctcatgtttaataaagtagctagtattttttttttcatgtggaatatttcaatgaacaagacaatagattaaatgtagaaagactgttcaaggctcaaggtccagggtgctgggagtatggcctagaagggaatggacatgcccccttgctctgctagtcctacagtgaagccagcaatcagaggaagaccagacagtccttttaagtgtaggggcttgggatggaggcctcaattgcctagatttaaggagggttctgattgccagtgttacaggtttgggcttagagagtgctgacgtgaagcaacttgcaaatggtgaagagggagggtacactcttaggtgactgagaagggttagagatctatgtgaagccaagagaggagaatatcaggaaagaggatggacttattaattttcctttttgcatataaatgttttataattttatacaacagaacgtaagatttcagtaatgtaaaatgaaaatgaaatgttaacttgaaaaactatataaacttgcaaaagtaatgaaatcaagacaatcttgtagtattaaatttaaacatcattttaaactcatattttcaaaatctatcttttctagctctgcaaactaagatggcttagtaccaatgagtacatataaagccaagatttttttctctaacatttaccactaaaggaaaccatgactccttgaagaaattatttactctaggattcagctaggaaagatttacatatgtataaaaaaagttatgacagtaaatataggaaggtgtcaacatcagtgagcttagcaatgtaggaatgtgatttattattattgttagggttcacccaagtgtactgtttccccctcccatagacctaagccccaaaggccaaaagtaaaacctcctaccccaaacccgcctgtaactgtctgaccagttcccggatgcagtcaagacgtctaccttacacaacagaactggcaagaaaaacatccccaggaagcggtcagacacctggcacaaaggaccctacaactcttttctttttccttcaccttgacccagttctacaccctataaaaccttgctatagcctgtaagcggggctgcctcctctgcttttgtcaggaggtagcccggcaggactgacaataaatcagcttgcctgaacttaggtctattggcctcattcctttctcggctgtccttccaattatcccttgtatcttggtgccgaaacccggcaaggtggtagagctcggcctccctttctccctctctcctttcctccccgcttcccccggccaaactcccccttccagaacgtgctggagacccagaggatttcctactcctttccattgctggcagacacatccaacaccagggccacctcaggggtgagtaaaggagacttctgccttctgtccggaacccttgtccactctttccttcccaaaagatgcagcactgggccaagagttttctcctcccagcctccaggcccttggtatctgcctttcacggatgcttgaatggggaattatcgcacctctccgactcaggggacgccttctcctatcattctagtctctggccacgtctctcatctccatctgttcctcattcattctatcatgggagcctctcagtccagtccctcaaagacatctcccctccgatgtctcctccggaatcttaatgcccttggcctccattccgaaattcgaccacaaaggctcatctttcattgtatcacagcctggcctcagtataaattggacaatggctcccagtggcctgaaaatggcacattcgattttaacatcctcagggacctagacaacttttgccatcgcaatggaaagtggtctgaaatcccttatgttcaggccttttttgccctccatagctgcccctccctttatcggtcctgtttcactttccaaatcctcctcgcccgctccaagccaggctcaccctcagctccccttccttctggcgattcctcctcctttgaccctgccgacgtctccccctgcccctcccagtcaacataataatgctccgcccaatcaccacgaccctccgccctatgctccagctcctgccctccctcttccccccctctccaaccacccagcttctgactctgattcatccgcatctccacctcatactccacctcatacgctctcaaactcagcatgcccaacaaccagcccccatacttcccctccgagaggtggctggagccgaagacatcattcgagtccacgttcccttctccctctctgacctctcccaaattgcaaaacgtctcgggtcgttttcctctgatcccgacacttatatcaaagaatttaagtaccttacccaatcttatgaactcacttggcatgatctctacattatcctctcttctaccctccttccagaaaagaaggaaagagtgtggcttgcagcacaggcacatgccaacgatcttcatcggcaagaccctactaagcccataggggctgctgcagttcccctggaggaacccccctggaagtaccaacccacagaccctggccgggcatctcgtaaccatatgattacttgcctcatcgcaggacttaacaaagcagcccataaggccgtaaattttgaaaagctcaaagaaatctcccaaagagccgatgaaaatcctgctgaatttctttctcgttttacagaggccctccaaaaatatactcgtgtagaccccacctcccgggaagaaactatcgttcttaataaccatttcatctctcagtctgctcctaacatacagcacaaactgaaaaaggccgaagatggccctcaaactccacaacaagatctccttaacctgactttcaaagtcttcaataacagggaggagcagattaaattagacaaggcccaaagagattgtgctaaataccagcttctggcagtggctatccatcaacctagccatagtacccaagggcacaaaaaacccaatggcagtaaccctcctgggccttgttttaagtgcagcaaagaaggtcactgggcgtgggaatgtcctaacccaaggacaccaaaaactccttgcccagcctgccaacagaccagccactggaagtctgattgtcctcttaaaaaccaggctaacagaccaactcctcaaagccctggcaaggcagagagtgaaagatcactcatcctaccgcagctccttggtctggccactgaagaatgacagagcccagggcccccggtcccatctgccatcactgctttggagcccagggtaactctgccagtaacaggtaagctgatctcctttttaattgataccagggccacctacttggctttgcctgaattttcaggacccattcatccctctcaggtctctgtcatgggggttgatggattcgtctctcatccacacgccactgagtcccttacttgttccttgtttaatactattttttcacactccttccttatcatggctcattgtcccacccccattctaggccgagaccttttagctaaattcaaagattccatcactttctcctgtgtctctcaaccagagtcctttctgctcctctctgctagtccagcccctgacccttctccccactacccacttctctcctctctcattaacccagtggtgtgggataccaccacctcttctattgcaggatctggccagcagcccacaatgcaacagggctctttctttgttcccaggcggattggcatgttgagaaataatagacacacacaagatagtgaaagccaggtctaggggggtcaccgccttctggtcctgcagtgccaacaatgcactggatataccagcatttattattaagtttagtgaaggtgggggtaggttactgagggatttaggggcatttgattatgagatgagatggtcacatggggatgaagtaattctttaacataacatctgtatgcagaagtacagtatacagagataagaatttacaatatagtgtgtgcatcagtaattcttaacagagccttaaaacagaaacatagcctttccataacctatgattagccagatattaatcagcagtaacagttgcagcaaaagctggttacaaacaatccatagaaacaggacgtaaaggtagacaaccggttagaccagatattctcagaagggagtatgccttaaccctaaagaggcctagaagagctgtggcaagatgagggcagttatagccctatcttaccatatggacaggtgcccctcatgcatccgtttataggctctccacaaggctcacattccattcccagagctatgaacatctgcttttctggaataggattcttggtgatgtgaaactccctgactgcaagtccgttcataggctttctgcatggggaagcacatcacgcactattggctcattctggcagtccaacctggcattgtctttacacaatcctgaatgcaattttgtatttacaataatcaggggcatttcgtcttttattccatagcaatagtttcagggggtctccctacactcttccatagctgcacaccataaccccatcaaaatccagttaaaggacccctccaaatttcctaacgttccccaataccctatctccctaacccaccaaaaggtcctccaacccattataaacaagctgtactcatgtgatcttcttagaccaacacattctccatataacacccccttcctccctgttagaaaatctgacagctcataccgactcgttcaggacctctgagccatcaatcaggctgtactccctatttaccccttggtccctaacccctgtacacttctctccctcatcccttccaacaccacccactatacagcaatcgacctacaggatgctttcttcaccattcccttacactctaattcccaagacctcttcaccttcacctggacagatcctgacactcttcagtcacaactcacatggactgtcctccctcaaggcttcagatacagccctcacatctttggacaagctctagcccaagaccacaccaccttaaacccctcccccagctgcctcctccaatacattgatgacctccttctttgcagcccctccctagaggactccaaactcacaccatcaccctactaaactctctttctagcaaaagatatagggtctccccctccaaagcccaactatctgccccaacagtaacatacttaggagtccaactctcccctggggcccaagccatgaccccagcacaagcaaccttaataaacagcttgcctctgccttcctcaaaaaatgaaattctctctttcttaagactagaaggtttctttagaatatggattcccaactttgccctcctggctcaacccctctacgaagcagccaaaggccccctcaatgaacccctaagccccatacacaacatacttcccagtttctgtaaactccaaactgctctcatcactgcacctgccctgtccttacccgacctctcccaaccctttgttctctataccaccaaaaatcaaggaatagctcttggggtcttagggcaacaaaagggaaatcctccttcctttgaccctgtagcatatctctgtaaacaactagacaacactgtcaaagggcagccaacctgtcttaaagcatcatcagcagtggccgttttgcctctggaaagcaaaaaactaacatttggccaaagcaccaccattcacagccctcacaacttacaggatctcctctcctcctgggcattaagctccctctctccttcccaaattcagtcgctctacgccctctttatcaaaaatcctgaattcagccttgccaaaagtgcccccctcaacctggcatccctacttcccatatcctcttcccctcctactcattcttgcactgacattctggatcacttgcagccacaattccctaacatctcctccaagcctctcactaatccagatgaccaactatttatagatgactcctcttccagagcccccggctctcccaaaattgttgggtatgcagtagttaccttaaaccatgtaattgaggctaaacccctacccccagaaacctcctcccagaaagcagaactcagctctcacaagagccctaaccctctccaaggacaaacaggtcaacatatacacagactccaagtatgcctaccacattcttcattctcatgccgccatctggtaagagaaaaaattccttactgccaaaggaaccctcattactaatggcccccttatttaccaactccttcaggctgcacacctcccaactgaagcaggagtcatacactgtcgaggacagtaagcaggttcagatgaaatctcaagaggaaataggctgatgagcaccgaaacaggcctctctttctcctatccctgcccccatcctccttgtcaccccagcagtccaacccagatactctcccaccaaaaactcttcactactacagcaaggagcctcccttcaaggggactggataatcaaaaaccaaaagctcattcttccccaagagcaaaccaaggaaattccaacatctcttcaccaatccttccatatcagtgggcgccccctgtacctactccttcacccttatttctcctccccccatctattcacctcactaaaggacataacctcaaactgtcatatatgctctgttacttcctcccaaggggccctccgccctctcctcatccctacacatcagctcagaggaacactcccaggggaggactggcaagtagacttcacccacatgcctcctgtcaaaaaaactaaatattttcttactctcatagacactttttcaggttgggtagaagcatttcctaccccttcagaaaaatctctcaaattctcataacaaaaatcatccctagatttggtctcccttgttccatacaatcagataatgggcctagcttcatctcccaaattacccaacaagtctctcaatcccttggtgttcagtggtgcctccatatcccataccagccccagtcatctggaaaagtccaaagggcaaatggaattctcaaaactcagttaaccaaactcacacttgaggttaaaaaaccttagacctccattttacccatagcactggctcatatcagagccagtccaaaggccccctccttcctcagtccattcgacttaatgtatggatgccctttcctcttacaaaacagaccccctcctgagtatcaattagaatacctcccaacactctccctcatccatcatctcctctgcgaacaagctgaccaggcccccacaaaaccccaccaaggcaccactgaccaaacactccttccaggagaatatgtcttcctaaaaatcaacaagtctcatgccaaagtgcgaaatccctttccaagtccttctcgctacctccactgcagccaaactttgagaacacaagtcttggtaccatctttccaggttaaaaagagcacctgcagctgacccatcaccaactaaccaaccagctgttccctgcaaatactccagcactcttctcagaccaattcgactccgcctaacgcccatgcctgaagaccccactcttccctcatgaaccatagcagataagttatcaccccttaccattaagtatccaaacccttattaatggaaatcatccattacgctgcccttgcaggaatcaccctacttactctactctttgccataggaatatatactgtcttgcctcctgggtggaatttcagacaaaaaaaactcaatattcgtaacctcttgcctcataatcctcctcatagcaggtataatagccaccaccaacagatagtggcccctcctaaatgtcctgtctttgcccatcctggcatttcacactcttccttcactgcatcacagaaaacctttcatggtcctacccagaacatcccaccctcacagcattccttgattggatcaccaatcttatatttcaaggggatttacaggaattcactccagatgaagccgaattctttacctttacacttgctctctgtctatttactccttcttccctcctccttctcgctaccgctccacctacagcgcaccattccacaggcacatatgatactcagtcaaactaacccctccctggccaaggcctgctggtacacccctcagaaaccgtatcaaaagatgtcttcccagctcccctcaaagactgggttctcagcaatatgaccctccacccccgctaccaaagttttggagaagtaaatgcactcaaaagttacaaactcaatcttaccacacatactgcagaacacaaggttatcttaggaacacttaccccagactcagaactcagtcaaccagcatccctatgcataaagcgtgaactttccaaaggagtgcccctaggcaccctctcctctagcttatgcaactgtaccctaacactcactcccccgacaggcatccaaacaataacagaaaaaaaccccacacaaactctcaaaatctccaacccccgtcagacccaagtcacgggagaaacatcaggattctgcaataactgacacaggccctgcatagaaatcgcagggtggaacacttgcctaaaccccgtccccacttcccaatgcatggaaatcccactgcctaacacaccctcaaacaaactacttattgacacaaaacgcttcttatggactcagcctgggtgacagaggaagattctgtatcaaaaaatatatatatatacacacacacatatatatgtatatatatgtgtgtgtgtatatatataatttgttttttccatgataagctattttaaaacaaagattctgaattctgtatgttttctatggataattttgttagagttaaagaatttgttcccgagttattactcaatacatgctgtttattggaatacagataacagcatgatcattgacaaactttgccctagtttcctattactcattaaaccttgaagttgcacttaacatgactgtatctggataacagataaaattttggccttattatgccaacccttaaactaagtgagcaactctgttttcaaagcttttgggtggagctgaagcacactgcttattaaagtacactattcaggcatatcatgtaggtttactttctgtgtttctagagaccaagaagcgggacgttcaccatgggaagaaaatcgctgtaccttctgattgtggggatcctcatagcatattatatttatacgcctctcccagataacgttgaggagccatggagaatgatgtggataaacgcacatctgaaaactatacaaaatttggtaagtttggaattttatgaattcagatgtgcatacaccaccatttgacccagagaattaagtttttcaagattctattcttttgatttattgacttattcatcttttaaaataactgctgtggcctttgacaatgtgttacttagaaatgttgtttgttttctgtcttatgtattggaatcatgttaaaaaaatatcaagaacagcaagcaaggagtcatttgaataggttttgctaaaaagtactttgtttaggtagctttaatatcacgatagtggctctcctttgaaattcttatcttaggtatggtttgttcctgaatgtgtatactcaaattagagatcatctgattatgcagcactgtgttagttacagatttttatgcacttatctttggagttcagaatatagactaaggacacgtaaataagttctcaagaaaagattcaatgggcaggctggttggcacatgcctagggttaaccacgagacggcacaatatgcacaaatgagagggggagggagacctgggtgtcctggcaactgggcagcttggatgctggcaaattaaaaaggtgtagctctctctggatccttgatgatattttactattacttctttggttattttattatcttcattaaaacaaatctcttttcagaacttaaaccagataaatgttgtaactcctggattaatcttttattttgcatttattcaacaattcaactgtctcaaatcctattaggcaaacaagtagtctatccccacacagttgacattctagtggtggagaaaaaaataaattagaattaaatgaataaatgattttagttcatgagaagtacctttaaggaggtaagatggaagaaaagagagtaatttgggcagaaggcaagagtgggctactgtatgcatggtgagaaaaagccattctgaagaggaaacagctacttagggaccagaagaatgaaaagaaaccaaccattctaagtgctaagaaaaatgttttccagcagagacaccaacaagtaaaaacaccccagctacagaatattgacaagtccaagaaatcatatgaaacatttgggtttaatggggaaattgttgcaattagtttggagaggttagaagccatatcatacagtgctttgtgggcactggtagtaagttttgatttaattctgtatgtgatgcagagctattaaagagctttaagaaagggacacatttttttccctcatatttgctgtctgtgctacaatatgtgagaggtctttgatttttttcttggagtctttatattaatttttatttatttaagcaattatatatatattcttctctggtagccttttaattaattaattcattcatttacttacattctgtccacaatttatgaaagtaatgtattttcagagctctcagtcgatataccttttaaaagttgttttaatgccctttcttattcctgaattatctgcttgtttgtttgcttgcttttttgtgatcgtttatgctcctggtttgtcccttttttcctgattagttttgctggcttctctgaaatgtctggcaatctttgagtgttcataccctttattaaaggattatgttatgaacattacatcaagaatcaaactactggattgagaatcctggtaaatatcatttactagttgtgtaggcatggacgacatatttaaccttcctgggctcactttcctcatatctgacatggataagaaaatgttatcttcctcccatataagcaagttgttaatattactgagatgactacaatagagtgctcagaacactgactcattctacagtgaaaggatgggctgcaggcaggcaagctgccctccctttttctcccactcattccttccctcccaaccctgactcccagctcccatgtgcaaccagctccatagccacacctcactgcacctccctatttctaaactaaaccagttcctcgacctgccagggtttttccttttcttatttggttagcaaaagacttaggaaaaggtatttatttcaagcctcagacaaaattgcttttccagtttctactcccaagtagctttttgtaatcacctgctgttcgctcccaaagtactttgtacagagctctgtaatagtatttacattgttttgtaaccatttatttgtctttcacacttaactctgagattcttgagaagagcatttgtctggttcatctctgaaaccgtaaagcttggtagagagcctgacacattttagtgacataggaactaaattagtagcaggggtcacaataaaacttcatctttgccctctgaaagttgctgaaagtcaactgacaggtctggttaatagaagaaaaaggcatatacatttttagcatacataatagacttacaaaatataaaatctcaaagaaatggccagatggttgacactttttttttactatcttgaggttacagaaagaatggtggcttggccaaaaaatgatatggtggcaagacaggttatgggaaggagagaagaggagacatggttagcaaaagtggtcttgttatatagatggatcctcacaggtagcagccctcagagagaacagatggtaaaaatttctttcagacttttaaaggtgtcagattctcagttgatttttcctagatctggacaaatgaaggctctcagaagccatcaatgcagattttctctacagatgcaaatcacctccacaaaagaaaagctttccagctaatcttgtatttccagcccttctgaaaagctaccttgcattatgtcaaggagatatattttgggatgaaatatttttatttccttcacagtgtattccctcttttttaagaaccaccctaggcataacctttgcatttctggtttcttttaaaaggaccaagcaggattcatgcatgaaaatttagttcattccatttgagtttattaagggttaatgtctacctataagtccatagatctctttgccatttgatacttgaatttcaggaggtttgtgaatttcatttttaggctacatttgtggagctcctgggacttcaccattttatggattcctttaaggttgtcgggagctttgatgaagtcccaccaacctcagatgaaaatgtcactgtgactgagacaaaattcaacaacattcttgttcgggtatatgtgccaaagagaaagtctgaagcactaagaagggggttgttttacatccatggtggaggctggtgcgtgggaagtgctggtaagtgaatgctttgaaaaatctctgtcactgaggtagttcgcagacattttactaagtcttcagtaggtacacatgcccttcggcatggacattactgcctcttttatcttctcgtgctttgttctggcaaagttttacttttccctgaagctttatatcactcttttccacatatgcatttcctcatcaacccaggtagaggtgagaagaaactttttttttctatttatcacaattactctaagaaagccttgttatttctatcattctccacttgatattacagaaccatttaatgttttcatccatttactcatatttactatatgtctggtaatatttttatatctttgaatatatttttgaattgacaaaatttcctcacgcctgtaatcccagcactttgggaggccaaggcgggtggataacttgaggtcaggagtttgagaccagcctggccaacatggtgaaaccctgtatctactaaaacaatacaaaaattagccgggtgtggtggcgggcacacattatcccagctactcggggggctgaggcaggataatcacttgaacccaggaggcggaggtcgcagtgagccaagattgcaccgttgcactccagcctgggcaacagagcaagactctgcctcaaaaaaaaaaaaaaagaaaaaaatcctgtcttcctgtattcttggatcttacattctaatggagacaatctttgatcgataaataagtaaataatacagtgtgttttaaagtgataaatgtaggaaataataggccagaatgttagaagaaaaaccttagacaaattaaatttaacagagtttaattgagcaaagaactacttgtggatcaggcaccctcctgaaccagaataggttcagagagtcaccagcgctgcctcctggtcgaagaagagttataggtagaaaaaggaaagtgacattcagaaaacagaagtgaggcacagaaataggcggattggttacagctcagcgtttgccttatttgaaactggttccacaagttggttacctttggctgaaactcagtgattgggacaagagtagattacacatccaattaagttacaactcactgtgtatcaagaaacctttaaaatatgcaaagaggcagctttaggctaaacttagtttatttggcaagagtaatcaagattgggtgtgaaggttgtatatttcttgatgtatagaattacagcagaaagacaaaaacatttagaagtggaagcactgggataaaagtcccaattatgtgagaaaatcacctaacccacctgagtcctagggctcttgagattcatctgtttacctccaatgaatacagtatagattaactggaggagtgaagattggactggacctactaagttaagaactctgaactctagagaggaagaataaattagtcctgaaaagaaaaggttacaggcttgaaattaagcaaatttgtccattgatgtgggaagttagaggagaaaaagacagaagattaaaaaaatagatctgaatgagtgcctcatttctgacaggatgactgggagggtgagaacagatttctggggaatgcaaacaaaattgttgggtgaaggaataagcagacagcaaagcactgaggtggtcaaaaatgtcagaaaatgaaaagaaagccgaagaaggtgagaacctcaagaaagaggaaataatagaagtcctgcatcgtgtagagatgtcaagtaagtaggatggaagtatgtctcttggatgttgaactttctatgttaatattgttgaggagagacttgctgacatgatgggatattcacagagaaacacattacagcaagcaaaaagtgagagggaagaaaataaaatggttagaataattgctggccttaaaaggacttagttgtgaaataaataagcaagaaaattatagattgaaatgagagttaagtaggagaattttcttttatttttgtgcaggagaaatataaacaagttggtagactgaaataaatgaaggcaataagtagaaatatgttagccaagtaatgggctgggagtgttgactgatagatacacatcccagaggaaatgaaagggaagaagatttagagcactagtaaaataattggatatagataggaaggttggaaatggaaaaaaagagcattacgtcttcctcttagacaagagaaaaagaggcaaagagaggcctcagctagatacattcttaaagtagtagtacagatgcaagcagtaagttccagtgtttgtttaaggggacctagttctattccacttatattcaggtgccttttctattgtcccatgcagacttaggtgatccttctatattgcaacaattctgtctatatctccttggctcacatatctgacaacgtattgatcaagttagcgacttgtctttttatctttgtatacccatcatctaaaacagagccaaatcagtacctccttccagtatacacagttgggttaatctagagaatgagtctgacacagaaggatcaatggcaaaatgtgcaagacaaaagataaaagggaggaagagcattaggaggttcactgggaaacttgaattccactgagtcatgaatggatggcttcttataaatacagtgttaaatttgtctctcgtattttaaggtaaaatagaactgccagaacgtgaaagaagtgcagcaggatttttgtgaaggaaacagccttgtcttcatttgtctgttttactaatatgttgcttttatccttttatttcagctctaagtggttatgacttgctgtcaagatggacagcagacagacttgatgctgtcgtcgtatcaaccaagtaagagctgtgctgtttggtttcctggccagatgtctgacatgccaagattttctcagctttctttttttttttttttttttgtgatggagtctcaccctgtcacccaggctggagtgcagtggcaggatctcggctccctgcaacctcctcctcccgggttcaagtgattctcatacctcagcctcccgagtagctgggattacaggcacgagtcaccacacccggctaatttttttattttcggtagagatggggtttcaccatgttggtcaggcgtgtcttaaactcctgacctcagatgatccaccctccttggcttcccaaagtgctgggattacaggcgtgagccaccgcgctcagccgattctctcagctttctcagccaatgcatgatcatgccaaaaataaatgtttctcagatgacactaagtaggcaactgcaagtgagtgctaggcttaacctgattagagttgagaaaaaaaaatctgtatatgtgtgtacacgtgttattttggcaaaaagaaacagcaaaaagtaaaaatttttttcacataaattcaaactgtatcatttatggatataattacctggacggtatttcctttcaacccttaattcccagtctttaaaaatgagtgccctggagtcacaggatcatctataaaagtgcatcataaataatttccatctcagatggtcactgtgaagagtaagtgataacatccttgaaacagagtccagcgtatatagcacttggtgagcctaaaatgtaggctatataattttaaatatttaaaatatagcgtatagtttaggctcaacaagtgttatacactgcgctaagtatattaaaaatgtattatcaaattaaacaaaatagatgagttcatataaaattatgttagataaataatccacctatggaaagagcacttagggacagcaaaattaggggcggattgctgggtagactcatgccagagcagtatatatttaaattgaaatttcagagagtaaatgaacagttaaaaaaataacatactcatcaccatttgtcaagttaaatcattattataaagttgggacataatcttgatcaatatttggttgtatgtgatcactcataaatatagtggctagaataatattttgtaaaatgcaattagaaaatccaagcttatgctgttttgcattccaactttatacttaaagagaattttcttaaacatggcaagtcaaattatagtataagaccgacatctgtgtttaattcattgcaatgactaataaatcactagtacatgaaagataaaatatactttaaaatatttatgcaaatatatgccttgccttcaaatattctcattttatttatattaaagatgaagaactccagtattcaaagatagataattttggttatatttaaattaaaatggccaataagcatctttcatgtacttgaaagataaaatatactttaaaatatttatgcaaatatatgctttgccttcaaataatctcattttatttatattaaagatgaagaactccaatattaaaagatagataattttggttatatttaaattaaaatgaccaataagcacatgaaaagatgctcaatatcattagtcattagagaaatgcaaatcaaaaccacaatgaaataccacttcacacccactaggatgggtataatatatatatttaaaaagataataacaagcgttagtggggacatggaaaaatcagaatcctctatactgctggtgggaataaacacttcggcagctccttaaaagttcaaacagagttaccatattgacccagtatttccatttctaggtgtatacacaagagaaatgaaaacatgcccatataaaaacttgtatgttcacagaagcagtattcataaaccttaaaagtggaagcaacccaatgttcattaactgataaatggatgaataaaatgtggtatatctatacaattgaatatttgaaattcaattgaatatttaaataaaatgtggcatatctatacacatattcagttgtgtaaatataccacattttattcatccatttatcagttaattattcatttgttaataaaaggaccactacagtatggacaaattttgaaaatattatgctagatgaaacaagccagtcataaatggaaagttttgtgattccatttatataaaatgtccaaaatagggcaaatgcatagagatagaatgtagattaatggttgcctatgattgggtttggaggatggggagaaatgagaagtgactactaatgggtataggatttccttttggcatgaggaaaatcttccaaaattgattgtggcaatggttgcacaactctgaatatattgaaaatcactgaattgcatacttataatgtgttaattttatgggttatgaatatctcggtaaaatggttatattaaaaattaagggcatacttttaatgtgttaattttataggttatgaatatctcagtaaaatggttatattaaaaattcaggctgggtgcagtggctcatgcctgtaatcccagcactttgggaggccgaggcaggtggatcatgagatcaggagtttgagaccagcctggccaacgtggtgaaactccatctctactaaaaatacaaaaattagccgggtgtggaggtgggcacctgtaatcccagctacgcggaaggctgaggcaggagaattgcttgaacctgggagtgggaaggttgcggtgacccaaaattgnccactggactccagcctgggcaacagtaactagactctgtctccccgcaaaaaaaaaaaattaagaaattatgttcatcaaaagacattaatagaagtcttaaagtttgtgtgtgtatatatatgtgggtatagacatatgtatactataaaagtttttaaatacattttttttttttcaaatccaaaatataaaaacacctaccaattaatagaagtataggcgaaagactcagaaagacaatttacagaaaaggatattgaaatcatcaaacaatatatgaaaatgtactgtatacatcaggaaaatacaaattaagactattataagatacctgcatatactcgagattatagataaaatgagaaagacataagataccaagtgttggtaaggttttgaatcaacagcacttccataagctctagtttgagaataacttggtaaactacttagcaaaactctttgacattattaagtaaagctaagcatatatgcatacctctgttattatcaatagcacaggtatgtatcaacaggaacacagccatagggccccaaaaaacatgtactagaatattcatagcagcactgtttgtgcccaagactgcaagcagcctaaatccccataacatttttttacttggaaaaatatttatttagtatttattgtttgtttaattatttataagaacatttaatatgtgatctaccctcttagtgaatttttaaatttgcattatttttgactgtaggtacaatgttgtacagcagatctgtggagcttattcaacttgtttgactgaaactttatgccagctgatcagtaactccccatttcctcctccccacagcccttgcaaccatcttttcactctgattctatgaatttgactattttagacaccttatataagtggaaacatacagtatttgttcttccatgagtggcttatttcacttagcccatcaacatgttaatgggtaaatgatttgtggtatattcaaacaatagagtactatacaggaagacagaagcaatgtgaatgaggctcaaaaacataatgttgaacaattgaaaccagatacataggagtatatgctatatgattttatttatttaaaggccaaaactaggcaaaattaatttatgctgttatgtcaaattagtggatacgtcaggaattaaagagagtaaacaaaaggtttctgggatgcgggcaatgttatatttcatgatctgagtgctggttatatggctgtgtttagtttgaaaattaaagaaattatatacttatgtgcacctccagcatgtattaggttggtgcaaaagttattgcggttttgtcattacttttgcaccaataatatattacagtctaatcaaaacaaacaaaaaaatgtgtaaactatgttttctctctacagctacagattagcacctaagtatcatttcccaattcaatttgaagatgtatataatgccttaaggtggttcttacgtaaaaaagttcttgcaaaatatggtgtgaaccctgagagaatcggtatttctggagatagtgcaggagggaatttagctgcagcagtgactcaacaggtatgttcataatttctatgctttttaaaaatagcgtttctacgctgttttaaaaacatatttataaacatattgaatgcatgtattaaaatatgaatgcaaataggagatattgattttttgaaactattaaagagaatattgagaagaaatgactaaaacattataatatcaatccctgcttctgtcatagatttttttttcttccttaagggaatgttaattctttggataaatcattcatttaaaattatagcctgcatgtggtagctcagcactgcaatcccagcgctctgggaggccaaggcaaagggatcacttgagaccaggagtttgatagcagcttgggaaacacagtgagaccctgtctctacaaaaaaaaaaaaagaaaaaagaaaaattagcctggcataatagtgtaagtttgtagtcctagctacctaggaggctgaggaggctgaggcagaaggatctcttaagcccaggagttcaaggttacagtaaggtgtaatcgtgccactgtactccagcctgggtgacagaataaggccctgtctcttaaaagcataaaaaataaaataatatgtgtcagtaaaatattatattaagtaggtgaatgagatcatgtaattgtgagactaatgaccctattacgctattagagattcagacgaattcatataatcttcgatggtgtattcctttattaccataataatcatcctattttaagaaaattatcaacacattcaaagattcccatgctacttacaaagaagaaatatgaagaattcaaaagatttttgtatgtagatgtaaaatcagatctttttatctgtcatttaataatggcaatataataataataataataacaaatggcatttttgtcccagattatatgtagaatagattttgtttttatgatgaaggagaaacactgctattgattgtttaaacatctaaactcttttctcatgtagtagtcgcaaaggaactattttcccatggagtagcagtcaggagaagaagctacctaagatcttctctctaatgttaattctttggataaatcattcatttaaaattataggctgcatctggtagctcagaactgcaatcccagcactctgggattatgtagaagttaagtagaacatatgtagaaggttagatttttattagttgactttagttacaaacgagggttctacagcaattttaaaacattgctgttatttgttttgttaattatatttatttataatttttcacactaaaagcattttgactgctagaatctgttggacaatattctcaaaagtaaagaatcatagttgcactttgtttcaaccacaatatagaacaagtatttgaaacttcacagatagatttctaatcattattatggatttcataatgtagcagcaaaagcattagactggacatcaggaaacttggagatgcagtaatttctagatttgatattggcttaatctccctaaataaacattcatttcctcacctgtaagaaaaatgaactctttcaactttaaagagttgtttgagagtcatatgaataaatttatataaaaatacctggcaacttgtaacaatctttacaaataggctccacaatggtctattttgataattatagttaaaatgtggataaatactacaatttgcaaaatatttgggttacatctaataatatctgtacttttatttagaagttctatacatcttttatagtatattacacacttcaaaaacacaaaattattttttaacctatatgttttcacaatttaaaacatattttgtaatatttcattcttataagtctccttttttcctccctggtattggtatatccctctttacagaccactgattattacaaatattagcacaacagacttgatataaaagatgatgttaatagaccatttcacacagaagtcttgcccaaatctcctaaagtaacatgtcgctttagcatcaaagccatgtcagaaacctctattaagtgatccttcttcttcatggcaaagcttattgatatactggtatattttaataatatatttttttgagacagtgtgtcactctgtctcccaggctggagtgcagtggtgttttctcagctcactgcaacctccacctcatgggttcaagcaattcttgtgtcttagcctcctgagtagcttcaatgacaggtgtgcgttaccatacctggctaatttttgtatttttagtcaagacgggtttttgccatgttagccagctggtctcaaactcctgacctcaagcaatccacacttcagccttgcaaagttctgggattacaggaatgagccaccataccaggcctattttaataaactcttacatgaacagaagataatatttatgcaattcttctggttatcattcctagcagaaaggagattaactttctaatgatcacttagatctttttgcattatccataaagcatatatgacagatgattttccttaagttgaaaatattgatgaacatctagttctagaaacccattttgaatgttagaaagtttgctgtggtggtatgtttcatttattacttaagtctttttgagatcatgaatagatagatagataaaaacaagatagatagacagatagataatcttattagggatattttattgttttaaatgaaaatgatttgtgcaaatcatcttgcttctcagctccttgatgacccagatgtcaagatcaaactcaagatccagtctttaatttatcctgcccttcagcctcttgatgtagatttaccgtcatatcaagaaaattcaaattttctatttctatccaaatcactcatggtcagattctggagtgaatattttaccactgatagatcacttgaaaaagccatgctttccagacaacatgtacctgtggaatcaagtcatctcttcaaatttgttaattggagttccctgctccctgagaggtttataaaaggacatgtttataacaatccaaattatggcagttctgagctggctaaaaaatatccagggttcctagatgtgagggcagcccctttgttggctgatgacaacaaattacgtggcttacccctgacctatgtcatcacctgtcaatatgatctcttaagagatgatggactcatgtatgtcacccgacttcgcaacactggggttcaggtgactcataaccatgttgaggatggattccatggagcattttcatttctgggacttaaaattagtcacagacttataaatcagtatattgagtggctaaaggaaaatctatagtaaaacatgtagctataacatattttaaaaataaaatctgaaaacctcagaaaatttgcattagaaattggtctttcttagaatggtctagttaagttccacatgtagcataattcttaaataggcacttttctgttttttttttcttactgtgggatttcatttcaattttctacattgtctatctgctttttctgagattttccttcttacactgttaatcttattttaaaaaatattacattcttgtatactttatttttgtgagttggctactatttacgatgcaagagaataaatgtgagcaaatattgcctgtctgagtaatgtcaagattttattcaatgttcatttataacgtgaaacatccctaatcacagatatgaattaagtgccaattcttttcaaaagcagttgcctcagtgaaatgtcaatttattaccactgtaaatttctttatgaaacacttttagaattcagataccaagtgttaaactaaccaatgctaaaaaaaaaaaaaaatcactgtggtactttggggaattagctgctttttatttgaggaaaggtagagaaactgaagtttagtaaagacagaagaaatatttgggatgaacactgacctaacagccaaagactacagatgtggaagtcactgaccaatgatagaaaaatcagagaaaattttaatctctgaaaagcccatcccaatattgcagggagaaaaataaaatggaatatctttaaggctgagcagaattacttgtattaactatgaactatgtagtgtattctaattataaagaagcccaactacaggcagtcttcagatggcgcagaagctccacaccgttatcagggactaaagctttttctatctttgtactcactgatatggtttgactgtgtccccaccccaatctcatcttgaattgtaactcccacaattcccatgtgtcatgggaggaacccagtgggaggtaattgaattatgggggtgactctttcccatgctgttctcatgatagtgaataagtctcacaagagctaacggttttaaaaatgagagtttccctgcacaagctctctgtctctttgcctgccgctatctatgcaagacataacctgctcctccttgccttccaccatgattgtgaggcctccctagccatgtggaactgtaagtccattaaaccccttttgcttcccagtctcaggtatgtctttatcagcagcatgaaaacagactaatatactcaccatcctcagtgtctgtttgtgtgtgcatacttataattgtatttttgagtaccgtctaaatattatatctaggcagagaagggatatggcagaagagctgtatttgaggtaattttattttatcaggaaaacagtagtaatctcagaagatccaacaaagagacttcttatatttcattttctaggacggtgtcacaaggaattttgcaaaatagaattttagtagttgggcaaattgcacattcttattttaagaaataaggcaataccctagccagagcaatcagacaagaggaagaaataaagggcatccaaatcagtaaagaggaagtcaaactgtcacagtttgccagtgatatgattatatgattatatacctagaaaaccctaaagactcatcagatcatagatctgataaatgaattcagtaaagtttcagaatacaaaataaaagtacacaaatcagtagctctgctatacaccaacagtgaccaagctgagaatcaaatcaagaactcaaccccttttacaacagttgcaaaaaaataaaattaaatgagatacttaggaatatacctaaccaagtaggtgaaagatctctacaaggaaaactacaaaacactactgaaagaaatcatagatgacacaaacaaatggaaatacatcccattctcatggataggtagaatcagtattgtgaaaatgaccatactgccaaaagcaatctataaattcaatgcaattcccatcaaaataccatcattattcttcacagaactagaaaaaaaattctaaaattcatgtggagctgaaaaagagcccacatagccaaagcaagactaagcagaacacaaacaaacaaacaaacaaacaaaaaacaaatctggaggcatcacataacctgacttcaaactatactacaaggctatagttaccaaaacagcatggtacgggtataaaaacaggcatgtagaccaatggaacagaatagagaaccaagaaatgaagccaaatacttacagccaacaaagcaaacaaaaacataaagtggggaaaagacaacctattcaacaaatgatgctgggataactggcaagccacatggagaagaatgaaactggatccttatctctcatcttacacaaaaatcaactcaagatgaatcaaagacttaaatctaagacctgaaaccataaaaattctagaagataacgttggaaaaaacatcttctacctattggcttaggcaaagtgttcatgatgaagaacccaaaagccaatgcaacaaaaacaaaaataaataggtgggacttaattaagctaacacacttctgcacagcacagcaaatgaaataatcagcagagttaacagacaacccacagagtgggagaaaatccttgcaaattatgcatccagcaaaggactaatatccagaatccacaaggaactcaaacaaatcagcaagaaaaaaataatccaatcaaaaaatgggctaaggacatgaatagacaattctcaatagaagatatacaagtgtccaagaaacatgaaaaaatgctcagcatcactaattatcagagaatgcgaatcaaaccacaatgcaataccaccttactcctgcaagaaggccataatttaaaaatcaaaaaataatagatgttggcatggatgtggacaaaagtgtaaaagaaaacacttttacactgtggtggaaatgtaaagtaatacaaccactatggaaaacagtacggaactttcttaaagaactaaaagtagaactaccatttgatccagtaatcctgctactgggtatcttcccaaagggaaaagaagtcattatatgaaaaagacacttgcacacgcatgtttacagcagcacaatttgcaattgcaaaaatatggaatcagcctaaatgcccattaaccaacaagtggacaaagaaaatgttacacacacacacacacacacacacacacacacaccatggaatactacccagccataaaaagaaatgaaataatggaattttcagaaacctggatgggtttggggaccatcactgtaagtgaaataactcaggagtggaaaacaaaatatcatatgttctcacttataagtcagagctgagtcatgaggacacaaaggcataagaatgatataatgaacacaggggacttggggggaaagttgagagggcggtgagggataaaatactacacactgggacagtgtacactgctcaggtgatgagtgcaacaaaatctcagaaattaccactaaagaacttatccatctaaccaaataccacctgttgccccaaaacttttaaaataatgaaaaatgaaaaaaaaaagtccaggggataaaagttggaaaaagataaaagcacttaatctgtaaaacaggcagaaaataaagaaagaaaagaaaagaaaaggaaaggaaagaaaccaataatataggcaactagtagaatatgccacacatatctacagcaggaatttgttaaaaagcaattgtggaatgatgattttctgagtaaataaggagagttgtaggttaatattaaaggtaatgaatagaaacataagttggattatggtcccaaattgaccgtttctgtaccatgtacaaataaaaaatgtgttggctgctttgaaataatctctagaactcatccatgcctggcgtgtgctattgttttatctgatccttcttcaagggtagaaagcagtgacactaacatggatactaacaagcaaacaccttcttggccagaaagtggggtttttaactgttatctgtgatatttgtacattaagcaaatattttctttgacactttgatattctgctttttgtcctaaaggcaaaaagcagacaggagaagcaggtcagagtgtcagcctactgagatctatgaaattaacattctgaaagttggaactttatcttcataaaggtgataatgtttttagattagtttaatttttagtaaaattgagtggcagtgatacaatttcaaaacagggggattactttgggagaaaatccaaaaattccaatgatctggcaattctatttcaggtgtttttctcaaaacaaattgaaacataggtctacaagacagactggtacacgtaagtgtattctggctttattagtatcagcaaaaaattggggggggggtggaattctccaacattttctattttcctcctcttcaacttctaacaactgaaatttagtacttacttgaggacgctgctttctctatattccttacatcacaagggctaggagtgaggtacggatttgccttactgctccttgaagaacattccttctaccgccagttttgttcaggggttagcaacccacagcctactggccaaattcaacctcttgcctgtttttgaacaactctaagctaaaaatggtttatacattataaagcactgtggaaaaaataagaaaaataagaagcagtgatggtagcagtggaggaggaggaacaggaggagcaacagcaggagcaagaagagcaggaggagggaggaacaggagcaggaaacaaagactatatgtgactggcaaagcctaaaatatttattatctgaccctttacagaaaaagcttgcaatagaccttaccaccactatcagtcctttttgtagtcaactcctgagccctgtgttactctccctcatatcttaaaagattttgagctcactgacaatatctcacaattacattggtaatctcagtatttatctagatgatccgtcgagctacctagaatcccagctgtttggaattctctcccctaataatcttgttcttttagtggataaaaaactctcatggtcaatcctagaatgtgttatgatcaattactgtgcctactctataatatcaataccaaacattccagttcactccagttgggtctctaattttaataacatttaagaaataatagaagttaaaattcattgactatatccaacacttcactcttcctcattgccctaatgtaattttttctcttccttacccagaatatgttctgtggtcagttagagcaatgcctcccttgcataagccatcaaccatcaacccccgtggatctctactaatgtacttgtttatcaaaactccaaccttgaagacattcacctactgcctactcttcacatgtacctatgcagttacacatggttggagaaaaccaaaaaagtgctgaaatttcccacttaaatgaagtctgtaaacctcgattatgcctttaataatgcctagcaatcatactataattttccagtcccttgagacttctgttcctaactctcatcaggtctccaatacctcctctgccatcttttatcacagctgataactgtgcttcctatttcaccgaggacacagaaacaattgaagaaaatttccacaagttctcaccctatatcaacctctatcgtctatttcaccttttattactatagatgaactaagcgtttgtgcttctgtgtaaggattgttcctctcaatatgtgcacacgtaaatgactcttgattttgatgtttcttcaaatttgttgtgtattaagaatcatctcaaagggttctttttaacaaatgaaattttgagataccactacccagaattttcctttcatcaagaagcccttagatgattcccaaaaaagaacattgaaataaaacccaatctggtgacagagaaagataaatatattaaccacttcaattgatagaaataagaatttgttcttcagactggaaagaaggaaggaagcatactgccaagaaaaccttgacacttgccctgaatttggaggaacaaacaggagtccccagtgaagaggatagctatgggaaagcatttgcaacaggagaaacaatgctttggagatcctggaggcagtaaaccacatagttcacttcatcctttgacatctttcctagagagtagaaggcagggaagctggctggagaagtgaagttctgaggagcctgggctgctgagccaaatacactgaaggttgctctgattgatgcagtacgtgatatgatctttaggagaacagtgtggtaggtggactgcagagacactaaatggaaacagaatgaggccctggctatacctgcagtgattgtgtggcctgagaagctgcaaaaaaactaggggagtgtctctgaggaatttgcagggacataagaatttcaagaggaagggggtaattggttctgtcaatgctaaaaataagatgtgaaaaagtgtcagatagtctcctaaaaacctgtggctcatgcagttactttctgtaacttcctttttccttccccaaccttaaaatataagggtgaagtcaagtcattcctttatgacatagggcagtggtctcatattactatcacacgagagttttaaaacatcatttgctgaagccacaccttgagctattattatgtctcaatctctgaaggtatggcctaagcatcagtatttttttgaagctcttcacaagatttcaatgtacaggaagatcaagaaacactgacttagagagtgaggaacatttcttttcatgtacagagttccaacaccatttaagtgtttcaatttcccagtagtaatatttatcacccaccaataatattcatcagactttactttaggaaatatatatcttagaaaatcctacagatagatagatagatagatagatagatagatagatagacagatagatacagatatacacatacatatatgtatatatgtatatatcatagaactaaatgaatatataaatacgtgtgtgcacacatttagttttcacaatttcattaggtaaacaatatatgtagtatatataaaaatatacatatattttttgacatatataaaatatatatataagtatacatatatatatatatatatatatatatattttttttttttttttttttttttttttttttttgagatggagtctcactctgttgcccaggctggagtgcagtggcgcgatctcggctcactgtaaccctcgcatcccgggttcaagagattctcctgcctccgcttctggagcagctgggatcacaggcacccaccaccacacccgtctaatttttgtattttttagtagagacggggtttcgccatgttggccaggctggtcttgaactcctgacctcaggtgatccgccctcctcagcctccccaagtgctgggattacaggcgtgagccaccgctcccggctgacaacaatattaataggtattttgcagagaaggaaaaggaagaaattgaatttacatgggtttccaaggtcccatggctaataagtggcagagctggaagccaacccccataggccagtttcaaaggctttgccatcaattgcttaaggattttggagactactttttgctttcttagaaagggtggtaggaaaacaagggaatctgaatcatacaaataccagattaagtataaaaccactaactaggtaacctcaggaaaatctcaagattcctgagactgccgcaaagatccacagctctgttgttaatagtgtgcaacgtggataatcaagagttaattatgcttagtttctttaccatataaacaaatcaataccacttctgatgtacctcaatagtggaaaaagcatttaacattctgcaatgaatcactgcaaattggtatgttgctttggccctaagtgtatgtgttggggagcggcaggagggaatttgagctgcacaaatacccagtaaaccaaaaaggtgctcaggcatttagaaactcaccaggtgccagagggggcatgacacgcaggatccaggagaagattttgatttcctctgtgctctgagctctttaacctggacctgaggaatatctgcccagcaacccgtcaaaaggaagcagtgggaaaaaaagcacacagctgtggctggtgaccattttaacctcaaaaaaaccacagctgctggttgttaccaaatgccaaaaaatcactaaaccttgttgattgtttcatgtaacttatgtctagccttctagcctttaaaatttttcatttacaggaggagcagtattgaaaataaataaaattaaattaaaaaataaaataaaataaacttttcatagctttcccggagtttttcaagtttattttatattatattattgttaaacggggtctaatcttggtaccagtactttaaattattctcttagaataaatattcacaatttctttctcttgatgccaaaaagagattaattagggctggaattatttccaatggcatttcaaaaattcttagctcctcctctccctaggcttgagcattgttataaaattaaaaatagcccattttggaaagtccaagattctttaaaactgaagtctcttataaaaaatcaagaggaggctgagaggaggcttctctctcatttgccaatttctttaaaacaagaggcaccgttgtcagtacttttaaagtgctgaaaaagactacaagcctgcaaaagaaggctgagtgtttcattctagagctgttttttcttagtgaacatccattgacttcatttggaggttgtatctgagtgagccctctttcttacaagtaaagtaaaacaccagtcagctgaactctttatcaaacatactcttcatttatctcttgatgacacaatgtcactcttccctttcaagctgagccttcagattctccaaaggtttcgacctcccacaaagtcttcacgaggtgactcgctcttcaaggagccctgctattatgccatatggtgttatgactcagcaaacctgcagtcccttctacttccgagacctggaaagacatgttctaactgcttctggatgaaccaggcataccagtattagttcatgccatccaaaaagaaacttcatgttctttttaactctaaattactaaagctaaaagttacagtcttctgatcttcaagagttcccagaattatgctctctggtgattaaactcccttccctaaaaagtggctcatcctaatagtgcaatgttcactatgtgtcagctttaaaattctatgcctgtaaaatactcgaagtttagagaatgcatcttttttcaaacgcttcttaactttctgagggtgaggaccaatttaacaggattacatgtaaattggcctttcagctatgaccatttcaaatcttggaaaatttttctcctgcatacgctttatccttaagtaaagatacatagtatctatttagagatctaatcacaactttataacctttaaaatatttattctataaattaaataccaaatatgaacatatagcgtgtacacatatgcatatatgtacatatgtatgtgtgtgtatatataggtatacacatatacataaaatctcaaacaaagaaattgtcaataagattaaactgtggctccctggagtatacgagaagttatatacatgagctagaactcaatcagtaatttggaattgaagattggcttaggaaataagaaacttcatactttatactaatttaagtaaaacactttgcttgaatatatttaagtatatagactgttagatgaattctatttttaatctaattaaattagaagtaacatgcattagtatattagctaaatctcatttatttacagtgaatcgaagttggacatattccttgaaaatattttgaaaattattttaatgattaagaatcaattaaaaagagattttactttatttgctaaagaatgactttcaatagtttagtctcaaaattgttacacatgattaccagtgtgaaatatatgagcaaagataaaaataatacctccctgccaaaaacagctcctgttagaaaatattttattaactaatcaaataatcttctggtaaatacagagagatgtttaaaggttgcaatcgaattacaaggacacaataaaactaaaggaaatgc

SEQ ID NO: 11850 - DNA, 173 bp, Homo sapiens
ttttttttttgagacagagtcttgcactgtcgcccaggctggagtgcagtggcacgatcttggctcactgcaagctctgcctcctgggttcacgccattctcctgcctcagcctcccgagtagctgggactacagacgcctgccaccacacctggctaattttttgtaatttt

SEQ ID NO: 11851 - DNA, 817 bp, Homo sapiens
cttacttggttcagctcatggactggcttcttaattctctgtatgctggccttttgtttttttccataaaagcacttttctttagtttccataaaatccattttcagaaaccagttgtgcaaagcatagaatttttttaaaaagatacctgcagatggtagaggggatggggaaagttcttactatgtggcaatattaataaatacagattaagtattgggtatctttgctatttaatatcctcaggctactcttcactgccctttcccaggttccctcccactgcacgtcatctctctgactcctctttggtgccttccttctgccatagcttgttctcacatcctgagttttggatttcccccagaaattccaaactttccaactaggtcatacaaagcaattcagttctcttcagcctctattcgcaaactctccttttgatattcacactcatcctgttgcttgaaggaccctttatttgccataatcaatcttccttagaaagtagttattcaggctgggtgcggtggctcatgcttctaatcccagcattttgggaagccgaggcaggcggatcatgaggtcagaagttcgagacccgccctgccaacacggagaaagctcgtctctactaaaaatacaaaaattagctgggcgtggtggcgggcacctgtaaccccagctactcgtgaggctgaggttggataatcgcttgaacccaggaggtggaggttgcagtgagccgatatcccaccactgcactccagcctgggcaacagagcgagactctgactcaaaaaaaaaaaaaaagaaa

SEQ ID NO: 11852 - DNA, 101 bp, Homo sapiens; identical to SEQ ID NO: 6685

SEQ ID NO: 11853 - DNA, 817 bp, Homo sapiens
cttacttggttcagctcatggactggcttcttaattctctgtatgctggccttttgtttttttccataaaagcacttttctttagtttccataaaatccattttcagaaaccagttgtgcaaagcatagaatttttttaaaaagatacctgcagatggtagaggggatggggaaagttcttactatgtggcaatattaataaatacagattaagtattgggtatctttgctatttaatatcctcaggctactcttcactgccctttcccaggttccctcccactgcacgtcatctctctgactcctctttggtgccttccttctgccatagcttgttctcacatcctgagttttggatttcccccagaaattccaaactttccaactaggtcatacaaagcaattcagttctcttcagcctctattcgcaaactctccttttgatattcacactcatcctgttgcttgaaggaccctttatttgccataatcaatcttccttagaaagtagttattcaggctgggtgcggtggctcatgcttctaatcccagcattttgggaagccgaggcaggcggatcatgaggtcaggagttcgagacccgccctgccaacacggagaaagctcgtctctactaaaaatacaaaaattagctgggcgtggtggcgggcacctgtaaccccagctactcgtgaggctgaggttggataatcgcttgaacccaggaggtggaggttgcagtgagccgatatcccaccactgcactccagcctgggcaacagagcgagactctgactcaaaaaaaaaaaaaaagaaa

SEQ ID NO: 11854 - DNA, 93 bp, Homo sapiens; identical to SEQ ID NO: 7709

SEQ ID NO: 11855 - DNA, 126 bp, Homo sapiens
ctgaggcaggacaatcgcttgaacctgggtggcggaggttgcagtgggccgagatcgcgccattgcactccagcctgggcaacaagagtgaaactccgtctcaaaaaaaaaaaaaaaaaaaaaaaa

SEQ ID NO: 11856 - DNA, 115 bp, Homo sapiens
gaggctgaggcaggagaatcgcttgaacccgggaggcagaggttgccgtgagccgagatctcgccattgcactccagcctgggcaacaagagtgaaactccgtctcaaaaataaa

SEQ ID NO: 11857 - DNA, 628 bp, Homo sapiens
ccactactgtccaacatcaatttggaggttctaacagatgcaataataggaaaatattaaatgattgttataaacaaaattaaaactatatatctttttctggttatgttacagttcacgcggaaaatccaaaagattttaaagaaaaaaatctgctggaattagtaagataatttagaagatggcttgacagataatatatctgtcaaaatcgttttcccttatttccacaaaaagcatctagatatagaagcagaaaatgtttttcattacaagggtggcaaatgttacatggtgcctagaataaatttagcataaaaaaaacccagtcggccaggagcagtggctcacaccggtaatcccagcactttgggaggctgaggcagccagaccacctgaggtcgggagttcgagaccagcctgaccaacatagagaaaccccatttctactaaaagtgcaaaatcagccgggcatggtggcacatgcttgtaatcccagctacttgggaggctgaggcaggagaattgcttgaacctgggaggcggaggttgcggtgagacgagatcgcgccattgcactccagcctgggcaacaagagcgaaactccatctcaaaaaaaaaaaaaaa

SEQ ID NO: 11858 - DNA, 628 bp, Homo sapiens; identical to SEQ ID NO: 11857

SEQ ID NO: 11859 - DNA, 102 bp, Homo sapiens; identical to SEQ ID NO: 8430

SEQ ID NO: 11860 - DNA, 159 bp, Homo sapiens
ggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcc

SEQ ID NO: 11861 - DNA, 128 bp, Homo sapiens
acacctgtaatcccagcactttgggaggctgaggtgggcagatcacctgaggtcgggagttcgagaccagcctgaccaacatggtgaaaccctgtctctgctaaaaatacaaaaattagccaggcatg

SEQ ID NO: 11862 - DNA, 86 bp, Homo sapiens
ggaggtggaggttgcagtgagccaagattgtgccactgcactccagcctgggtgacagagtgagactctgtctcaaaaaaacaaaa

SEQ ID NO: 11863 - DNA, 128 bp, Homo sapiens; identical to SEQ ID NO: 11861

SEQ ID NO: 11864 - DNA, 1058 bp, Homo sapiens
ggcctttggtagcctgccagcgcctccctcatttcccacatgtcacaggacttcttacggtccagccggctctgttcctcggttgtccctcccaagcacagtgcgtcctctcctgggacggctctattaataaccctcatgtggatgttctgggacggccattcatgcttcctgtcctcacgtgtggcccccactctacgccattcatgagagtgacccccaggcgtggctggctccctccctttctccactgccagcgtgtctgcaggatccaaggtgccatgtgtttgctgttcacagtgacccatgagtgagaggcagcggcgttcacaccatagtttaagttaacaatgcccggctgggacgtgcgctgtgtggccctcctcggggactgcagtgtggcagaaaaaaacaccctgagcttcctctcttctctttctcctgctgatattttgctgcccctaacaatcattggatccaatataagctataaaaggcagcctcacaagtgctgagcaggggagggaaggatggagaggggtctgcaggggcgactaaagattcccagcatgaaaggcaactgctatctatcaaggatattcatccatctaacgggggtaataatttatcctagagctgttgctaaggctgagttaatatagctgaagtgtactatcaaggttaatggcacccacctgagttcaaatctttgcacacatcctcacttaaatgtaaaaactcaacaaagaatgcaaatgaagccatgactcactccttcaacattactaggagacagaacccaacaaacttcaaataatctgcaggtagaaaaaaaccaccaaataccagcagacctccactgcctctataggtcatgagcagggtcaacaggtcaagggaggcttaaaggactcagtacaggccaggcaccggggctcacgccggtaatcccaaccctttgggaggcaaaggtgggaggattacttgagctcaggagtttgagaccagcctgggcaacatggtgaaatcccatctctacaaaaaaaaaaaaaaaaaaa

SEQ ID NO: 11865 - DNA, 1058 bp, Homo sapiens
ggcctttggtagcctgccagcgcctccctcatttcccacatgtcacaggacttcttacggtccagccggctctgttcctcggttgtccctcccaagcacagtgcgtcctctcctgggatggctctattaataaccctcatgtggatgttctgggacggccattcatgcttcctgtcctcacgtgtggcccccactctacgccattcatgagagtgacccccaggcgtggctggctccctccctttctccactgccagcgtgtctgcaggatccaaggtgccatgtgtttgctgttcacagtgacccatgagtgagaggcagcggcgttcacaccatagtttaagttaacaatgcccggctgggacgtgcgctgtgtggccctcctcggggactgcagtgtggcagaaaaaaacaccctgagcttcctctcttctctttctcctgctgatattttgctgcccctaacaatcattggatccaatataagctataaaaggcagcctcacaagtgctgagcaggggagggaaggatggagaggggtctgcaggggcgactaaagattcccagcatgaaaggcaactgctatctatcaaggatattcatccatctaacgggggtaataatttatcctagagctgttgctaaggctgagttaatatagctgaagtgtactatcaaggttaatggcacccacctgagttcaaatctttgcacacatcctcacttaaatgtaaaaactcaacaaagaatgcaaatgaagccatgactcactccttcaacattactaggagacagaacccaacaaacttcaaataatctgcaggtagaaaaaaaccaccaaataccagcagaccttcactgcctctataggtcatgagcagggtcaacaggtcaagggaggcttaaaggactcagtacaggccaggcaccggggctcacgccggtaatcccaaccctttgggaggcaaaggtgggaggattacttgagctcaggagtttgagaccagcctgggcaacatggtgaaatcccatctctacaaaaaaaaaaaaaaaaaaa

SEQ ID NO: 11866 - DNA, 811 bp, Homo sapiens
agaaggttcagtctcagtttagctgtagtctgctcagggtctcacacagctggactcaagatgtcaacttggagtgctatctcatttgaggctcagagttctctttccaggtcaattagattgttggcaaaattcaattgtttgaggctgtcagattgaagaacctattactttgctggctgcggctgaggacaatactcagcatctagaagccgtctgcggtttcttgccatatgacctgttccagaggccatctcacactaccaatctctgacttctgtctccaacctccagacccagacttaaaagactcatgtgattagggcaggccactcaaatactcttccttttaactcaaagataactgattagtaaccttaattatagctgtacagttccttctttcacgttatataacataatcatgagaatgatttcccatcatacatcatattcagatcttcatcccgtacccttccttcctaaatatttcagcttcaagtggagggattgatataagacgtggatactaggggacaggaatattgggggccgtcttaaaattctacttaccacatagattttcataattattgtatcatcatagtggattatgaactttttcataatgtgatgcatttaaaaaatcacctttactgcctcaaagcttattttaaagcctgaaattcaagtttgtctgaattatgatcccaacactacttagtggttgtttacacttttttggtattccttttttccgtctttttatttgcaacctttttgagatactttgttttataagtacctcgag

SEQ ID NO: 11867 - DNA, 811 bp, Homo sapiens
agaaggttcagtctcagtttagctgtagtctgctcagggtctcacacagctggactcaagatgtcaacttggagtgctatctcatttgaggctcagagttctctttccaggtcaattagattgttggcaaaattcaattgtttgaggctgtcagattgaagaacctattactttgctggctgcggctgaggacaatactcagcatctagaagccatctgcggtttcttgccatatgacctgttccagaggccatctcacactaccaatctctgacttctgtctccaacctccagacccagacttaaaagactcatgtgattagggcaggccactcaaatactcttccttttaactcaaagataactgattagtaaccttaattatagctgtacagttccttcttccacgttatataacataatcatgagaatgatttcccatcatacatcatattcagatcttcatcccgtacccttccttcctaaatatttcagcttcaagtggagggattgatataagacgtggatactaggggacaggaatattgggggccgtcttaaaattctacttaccacatagattttcataattattgtatcatcatagtggattatgaactttttcataatgtgatgcatttaaaaaatcacctttactgcctcaaagcttattttaaagcctgaaattcaagtttgtctgaattatgatcccaacactacttagtggttgtttacacttttttggtattccttttttccgtctttttatttgcaacctttctgagatactttgttttataagtacctcgag

SEQ ID NO: 11868 - DNA, 596 bp, Homo sapiens
cccattggcacttattggttccactggccagtccaccctacccaaggacagtgtcccctcctccattgtctgctgccatatttgattcctctctactctattatgggtcagcaggggcgggggcccactgtgagccttcctcatgcccttggcctcagccttctgagcagacacctgttcctacttgtcttggtgcccagggtagcaggaggcaaagtgcactcaggaccccttaactctaagattgtcaaacaacgacaatccccttggggccagtcattgggtgggttcatggttccttctgagaaaccccatatgcacttcattcttttcatttcccatgctctctcttttggcctgaagagagtatttttccttagaagaagcaagtagttaaaaaatattttcttcttttctttgacctagagcttaacaaaagacaaaactcagatgatgaagtacttaacatcttccttctttctttcctgctgacttgatgactctgctttggagcagtgggggcctcaaggtcgcagtggagaaagccatgggccagtgggaggtgaaacggagccaaaggtgggagagggctcgag

SEQ ID NO: 11869 - DNA, 596 bp, Homo sapiens; identical to SEQ ID NO: 11868

SEQ ID NO: 11870 - DNA, 1435 bp, Homo sapiens
ttcagtacacatatgcattgcctaacgatcaagtcagggtatttagcaaacccgtgacctcaaatatttattatttctttgtggtaaacacttttagaatcctctcttttaggaattctttgtatagtttcaaggcttctgccacctccacagaatgctttttggttctctctgtgatctgcacagtgtattttttctcatttcatctactgcttgtcctacactttcatttcttcatagcactcctgatgtatttcaaaatctttaaaagcattactggtaatcatcataataataataatgaggctataacattttccataccacagtcttagaaatcatctagtttattacgttcaaaaaatttcccaaaagaaggcctaccaaacatgtaataaacctaaaaatgtatcaggcactagttcagaggctgcatacaccaatctgatgctcataaactcattctagctatttgtacaatacaggctttcttctccaaggtttccatagagtcctagaggaattattagaatcctgagccggaattaaatgaaatgagtgttaaactgtgatctggtaaattgaggtagatggtgcaaacagctgattgttaaaggaaagtatcctcaagcctcacagttgcagggtctgttttataatctcatatcctagttttgcctatttggccattgaaaaccaatccaaacagcctctttaagtgacagctagattcaattcctgttgaggtgttgttgtttaaaccctctctccagagagcttcagtgggattgaaaaatacttgttccctggaagctacagtaggaatgctctatgatttgtgcataatacatatgataatctgagctttaaattaatccctaacccttctggataatacgctgcaggtaatttctccttcctatattacactgcggaagctagaattcagaagtatagtcttgctcaccttttaaggataatagagcttcaaaacagtattgcaggaagcaaagtggaataaacagaaaactgtcaaactagatgccactactgtgagttgttgaaaaggttaaatgtcagaagcaaatataattggatgactggaatgaatgactaagtgctttttacactaagttgcttgtttcacaagcaaccctagacccttagaaacagggttgatgaagtcaaagggacggccattctgtcttgtctttccccttctcagatcagcagaaaagcagcagaaaaacatggtgttggattgtagtccctacagatttggtacttccaagactctcccactccagcaaaaagaaaggacactcataacctttcctttttttctactccatggtaaaaatctagagatgggtatagtgcaaaatattcagattttggagaattattatccattttgtacttaaaaaaaagaaat

SEQ ID NO: 11871 - DNA, 1863 bp, Homo sapiens
taatttaggtcaaggtgagtttattgtccaaatagcataacctaattgcattcaaaaccattttcaaatccatctttaaactagtcagaaaacaggttattatttttttaaatcacttaacactgaacagataagacctcttaaaaggcagctgactatatcatgtcaccatcatagccaatacaacatttttgccatacttcctaaaaaccttttcgcatacactgatcatgctacttatcagcactttctaacatcctgaccaaacagacacccacacctcttatagagtacactgtgagagaataacatggacttgatatggcatcacacttgttttaaagcaaaaaaaaaaagaaaaagaaaagaaaaaaaaaagtccaagacaagaaactacataactgagagagaggagagagagagagatctgaggtacatgatataagggtgatgaacataatggaaaaaatccaatggcccgatgatttgctggggatgtaagagttggccagcagttaagaactaaaccaattaaaaataaaaatagaaactttgtttttcaaggacaggcacctgtcaaaagacattggatactgtaatggctacagtcagtaaggcactttatttccccaaagtaggctgcaggcgaagggatgcaggctgcagctacagcatgcacgtacacatttgctgatggcttctcaaaacctgagccgagaatagggtctgatagcccagccaagtttaaaagcagacacacacgaatgtagtatcgttgtgcctgaaatgaccattctgggttgtttagaatccagaatcatcaaaagccatgtggtatgaggaagtaataaatatcctcttgaatcttcttaccctattttgcacaaatggatggctgcatgaacagctcttgtaaattgctctgagtccacaccaatagaaacctgcactcattctatagctacagagggtttgttggcttaaggggactttatcatctcagcattaatttcccttttaaagctattctcaaggttggactgtctcagagataaacaaagaggaatccttttggcttagaagccaactggcttactcagacttcctccccttcctacctccaattcccacactaccaatattatcttcttgaactagaaaatcaattatttacatgacataaggtgcaagtctatttcttctcccagccctgtcccctgtggcccatggagagaaaattcccctgccctcttggagagagtcatctgatcctgccttatgttcttaacctttcagtcccagagctcccagggcacagtctggagaggccctagaggtgctagactgcagggaagcgcagctccgtctgaagagttgccaatcctgctagcaatgggatgcagcgtgatgctgtcagggttgtcttctcctctggctttgtcacttaagccatgtgtgcccctgacctggctgataagaggcagaacagagcctccagtacagagcacatagaccaaggatgacccagtagtaaggcatgctgtgctctccagtggggtcctgaggcagttcaaaataaggcctcctggaagaacagccccttcttcaaggagctcgcctctcagcacgcatggggtgttctgcggagggaactgcccttggctttctcctgcaggcttcttggctgttatggacccgcatggagtttaattatgcttagcatatatttttggcatactaggatttcttccccctaggatttggccaaaagaggggaaggatcaaaatttggcaggctgggggaacaactcggcccccactgatggagaaaaaaacaaacagatggaagtaaagacgagatag

SEQ ID NO: 11872 - DNA, 166 bp, Homo sapiens
agaaatcaggtgggagccacgaagaacagcaggcaggagccaggaaagctgcaggggcagtgttcccagagactccctagactctggagatggcaccgcaggcttctggtacctctcatgccaggagatgcttcctcacagcccagaatgagtagctggcaacaat

SEQ ID NO: 11873 - DNA, 643 bp, Homo sapiens
gattcttgtagtgccccccagtcccggaaggtgtgtgtctggcaacctggacttaccctgttaaacactggcagcatcatatacagtttctcttcttgttccttctgagtcatgtgccggggaggatggcacaactccgtgaagagccggcggaggtgcatcagtcctaaggcgttgtcttgtgggctgcactcctcctgcctcggccgccccatgatcctcttcaccatgttcatcttggctggttggtgagacgcacttctaattctgtaggaaaatgtcaatacatgaacagtcaaaacatcatcatcttgactaggtcaagcatgcatgtaagagcttataagaaatttgcaaaatagaaaattctgtctaaaatatatctttctacttctttaaacagaaaagacagagaagcaaaatttgataaatccccctgaagggcaaattatgaatctcagcattggaagttcttactcactttgccacaatttgtataaaatgtaaaacattaatcagacaagtaataaatgtttccaattagtttagtcatatcaagttcaaaaataaaggcgccgggaatagtggtgcacacctgcaatcccagcacttttggaggccgaggccggtgaatggctcgagc

SEQ ID NO: 11874 - DNA, 129 bp, Homo sapiens
gggcgcggcggctgacgcctgtaatcccagcactttgggaggcctaggcgggtggatcacgaggtcaggggatcgagactatcctggctaacacggtgaaaccccgtctctactaaaagtacaaaaaaa

SEQ ID NO: 11875 - DNA, 826 bp, Homo sapiens
aaataacacatgctttttttctcttagtgtttaggaggtcaaagtctaaaagcaaggtgttggtaaggctgcattccttctagaggtttcaggggagaattgtttccttgcctttttcagcatctaaaggatgtctgcattctatggctcatggactcctcttaatatcactccaacttcttggtcccattatcacatatactaccatttctgatcccactaccttcctcttataaagactcttgtgattacattgggctcacccagataatctgagataatctccccatctcaaagtcgttaacttgatcacatttgcaaagtcccatttgccatgtaagataacatatgaaatgttctgaggattaaaacactattctgccaactacaatgatgaaggaaatatgaggaggaatactagatcttaggttgcaatgattttgaagactttttgaatataggcacgggaagcactgacctgctgtggcctggacttccatggttccttttttgaaatactagaagataagaatcattgatagccatcttagaatcgttctgccactatgtacatgtgtatgaatgtgttctcttgtgtgtgtgtgtgtgtatgtatgtatgtgtgagatatggttagtgcaaaagttgttgtggtctttgccattaaaagtaatgcaaaaactgcaaatactttttcatcaacttagtagttgttttcagtaggtctcataaatgtcttagaataaatttcttacaatggctgggcacggtggctcaagcctgtaatcctagcactttgggaggctgaggcaggtggatcactcga

SEQ ID NO: 11876 - DNA, 100 bp, Homo sapiens
gcttgaacctgggaggtggaggttgcagtgagccgagattgcaccactgcactccagcctgggtgtcagagcgagactctgtctccaaaaaaaaaaaaaa

SEQ ID NO: 11877 - DNA, 2090 bp, Homo sapiens
gtgaagttgcaagttattttacttagatgtttaagaaaggtgatttctagaaagctagaaacttggggcactaggtttccaatgatgatacaactgctatttctattaaatgtctattctagtcccattgcaacatgcttgatatacataatctcctttattgctccaaacacatctaaaaggcagcattatctttattaccagatgaggaaaatgcttagaaatactttgataattagatgtttgtcttattttatgttcttgtaatagaagtatatttatttaactcttttttaccagttaattctggccttccttgcagtggaatttgaattggcattttggtaggcagattataatacaactggtataagttattgatggatagaattcatttccaagaagaaaatagaaatatttatgcaattccaaaatgtttttaaaatattaattatgcttaaaatatgtaagggaagagttcttatggcttatagttaaactaaactttttttataattgtatttcttgttttaaatcatgatgcaaaataacaaagagaatattgtgtttaattttttagtattaaatgactaaaagttactgggatttactaataagatttatgattcgcattctcttaccatgttatagaatgagtagaatgagtgtttatttccaatatggtatactatatgcagcaaaaagaggctacgttagtaatgaataataaagtcagagaaagtcttcatgatgagcaatatttcagttgccaagtctgctgcttttcttaaatccatttatttttactattttgctactgtttccctgtggagggtttaatacttctattttcttccttaaccaactcgatagttaaagattatatggagaaatgtacttaagtgtaaatggaaatgcctggctgtgaaagtctattggcttttcttaaaattaggagaatatttatagtcataaaaaaaacagagatggttgattacaaaggagagtagactatgagcttaagtgagctacttgagaaaactttttgtcactttatcacatgcacatggcacaaagttgagttgtgatgtgctataatttgagaaaggagtgattatagcatctttctcattctcccgcccccagtacctgataactccccccactgaatcacttaggaagctcttggaattgtgtgcctgatgtacggcaaaactgtagcctcccaggtcattgtggattcaagtagaagggagaggtggtcaagctgcctaaagacaaaacaggtcatagcataggcagagcttaagctagagatctaggcagatagagaagtggtgggggcacttgtggataagttgacagaactggaaccaaaatcttattcttaggtgggaggcaaagtaatttaaaatgatttggcagattgcagcaggatccccaagaaaagtctagatagaaacagtgcacaaaagtctgttttgctgagcataaggtaagaatggagcaggccttcagatggagtttgagattggggtcttggtccaacaggactaatttccaatgggtcttgtggcttttccaagggcttacagcaaagcttacctcccaggatataaagggacaaaacctctttggactgacaatttctaatctccaaggaaggaggctggatctctgccctccagagaatggtctgggcatggttttggggagtgtttgtgaactagctgggtacaaattcctcctcggggtcattgcctccatactctatttttacaaaattctcatttgcgggtccaaacttctctctctctcttaggtcctgacagctagaatcttgacggtatattttttaaagatgctacatttcttaagcctagcaacatcttagttgtataaaaaaatgtacaggctgggcacggtggctcacacttctaatccccgcactttgggaggcagaggcaggcagatcacctgaggtcaggagttcgagaccagcctgaccaatatgatgaaaccccgtctctactaaaaatacaaaaattagctggatgtggtggcaggcacctgtaatcccagctactcga

SEQ ID NO: 11878 - DNA, 160 bp, Homo sapiens
gatcacctcaggtcaggagttcaagaccagcctggccaaaatggtgaaaccccctctctactaaaaatacaaaaattagctgggtgtggtggtgggcacctgtaatcccagctactcaggaggctgaggcaggagaatcacttgaattcgggaggcagag

SEQ ID NO: 11879 - DNA, 238 bp, Homo sapiens
gggcagatcacctgaggtcaggagttcgagaccagcctggccaacatggtgaaaccccgtctctactaaaaatacaaaaattagccgggtgtggtggcaggcgcctgtaatcccagctactcgggaggctgaggcaggagaattgcttgaactcaggaggcggagggtgcagtgagccgagatcacgccactgcactccagcctgggtgaaagtgcaagactccatctcaaaaaaaaa

SEQ ID NO: 11880 - DNA, 952 bp, Homo sapiens
agtgatttaaccccccatgaagatgaggatctggaaatataagtaggatctgaaactggtctgcagctgcatgcacagaaacaccctgtaatgctgcctttgtaataaggaggaatccatactctcgacagtcactccctgactctcctcttcctcttcctcatctttctgtgcgtgtagtggatttactacggtttattttcattctcatcagttaggaggaaatggaagaaagagtaagtaactgaggttgaatatgttaacttactgggctgttttcattaagcaaataaacaacaataaaaaaaatctcaggctaaaatgaaccataggttccatttgtgaaatttgatgatacagataaccttaggttttcactactatctctatgtatatttcctaaatagcaatatcagcaaaacttcacaggcattggggtgggtaataatatttctttaaaatactcaggagaagtgaaagtcatttcaaaggactttaactgtcatggagtcattccacttcccacttaactttttctgcctcaaggtcccctctacgcagactgtctaaggcgtgatttaggtttttggaagcagctggtggcagcataaatctggccaaacaaggagggtgctgtggaactggcagtacaccctgagtgcccgaatgtcacatgaaacactctgcaatgaagcaagcagggtctactaggtgccctgatcaatgtgaatatatgtaaggaaaggagaaaatgttggttcgtatatttaatttacagacatacaattcaagtgtggtttcaggcccagcatgggtgatgttagaaaggccttgtgcagtgctcctccaagtggggtctgaggcatctggcctgtggtctcactgctgacctactgcatcaaaacaagggaatgctgtttttcagtgtccctggtgattcttggtatactcg

SEQ ID NO: 11881 - DNA, 2941 bp, Homo sapiens
aacatgaccagaataaagaagaactatttgccaacataccatttttaatggagactcaaaacattaaaaaaaaaaaatcagaactgagcattgccaggagaggtcagacttgccataggatagactttctgggtctcatatgaagcctctacagacagaagcgtgtcctatgttcatggcctttctggatgtaaactggagtctctgacaaactacagtgcttttccaagctcacctctctagcctgtgatgaacactgtcaaatacattaagtgaaacaccaaagcttagagggcgctgagcaacagaaaatggtatcagttggtccagcattcggacctcgtattcgtattgatggttctccccctccttgcctcctccctactccacctctgctgcccttatgcttggtacctctcattttggctctgcccctctggaagatcttctctgtatcctcatcctgcgatgagtggtggcaacgtgtgccctgagccctatgctaacgtgagtggtttctttcagtgttctcagattttccccagctcagtcctccctccttttctgcagcttggtcctggtttcttcttgccggcgtctccaagcagcaatgatggcttcatcgtccatttcttcctcttcctccctgtcagtgcttctccgatactgggaccgccgtccagatgcaaacctcccttcttctctgttttctgtcctctctttctctccctcttcttcagacctcataaagctctgggtgaacttcctcttggctccaaattcagagaagtctgacttggatgactcttccacatcttcccagtccctggacctggcccaatttgggcgctgtggttctggggactcttccctttctgaggactctggggtccggcggaagaagtagggctctgggctctcctctcgggaacttgaggtctcgttgtacgtggacctggagaacttgtgcatctctctgccctccctggtggaggaagatgagaaccgtgaagtgcttcttacagagttgccatttgcctcgtggtaggaggaggtgtcctgttcctctgactgggatttggaaaacttgtaactggaggatttagactctgtctccctgagcagggacgatctggtgtacttccctctggaacttccagaccagtcactttggaaaggaggtttttcctccgtcctgaggccactgagccacttattaatactgctatccatctctttgccaactctgctgccacttgcatagtgatcacagacagccagggaggagcatgtgtctgtttcaggtttctgggaattactgcgggaagaatatcggaagctccctatggcactgtcagtgtcctcatccccatcacccacaccatcatcctcatcttccttgaccttcttcttcttgaagagggagctgcgtttgttgtctgaggccagcttttccatttggtactcagacatcttctccctaagctccatctgcatctccttctccttccggccaagttcctttaggtccacattgtcagcaaagaggctgaagatgggcttgctggtccccctcactttgcttctgcaactttccgcgggtgagctcagtgtggtgttgcaggacagcacagactgcatgtcagagctgggtcttgcctggctctgaggcaacaggcagccacccaaggaggagctgctgtgtccactaagcatggagacttggtcatcccccaggcagctagccgctggtactgccttcatgcttgcaacagacggtgagcgggacaacagcagcatttcattttgcttctgagcaagggtctcactgactacattggcaatccagttctggatactggcaatggaaatggtgtctccaggccccactggcaggttaggcaggggtgtggtggggttggaggttgaacaccccgctatgttgcttgcagcctgagacaggtgggagcggtggctctgggtgctcagtactgacgtcgtgtccccatcagcgctgactgaggggtctgcagaccagaacgcagacaggggaatgctcccgctggccgtggagctgtccgcctcccagcttgccatagactggctctcctccagcgtctgccggcttctctccagcagctccagcctccgttgtctcttcttagccaaggccgagtcctcccccttgctgagctccaccacctcctccttgttctcactgcccaccttcttctggtgtttcagcttccaggcctggtaggctgtcaggctgacgtcggaggggttcttctcccctactgcctcctctgcaccgggctcaccgctgctgtctcccgctcccaagtctttcttgtgaaatccaaattggattctcttgatcttccatctttccagggcagtgagcttgtccttgttcctgctgcagaagttgtagaaggaactggcctcagagcccacgctgtcctcatcatcctcccgcaccctgctccctgcttctgagctcctgtctgccgcctcctctctcttgctcttggcgtggtacctccgggaagcctccttctcaatctccagcagcctctcgttccatgcgtcccaggtgctctccgaggacatcgagtctgcgcggcgcctcctgccgtggtccgggcggttcagctccagctgctgcttcaggacccagatgtcgtggctgctcacgctctcccaggcgctgctctcgctcagggtgcgccgccgcctccccaccgaggagccagcgtcgctctcctcctccttctcctcctcccttccccacctccggtacccttctgcttggtacctctcgtttcggctctgccactcctggatgatcctctccacgtcctcgtcctcgagctcctccccaccctggccagaggaggctgagcgccagccacctccatcctgggggaccttgtctgag

SEQ ID NO: 11882 - DNA, 2941 bp, Homo sapiens
aacatgaccagaataaagaagaactatttgccaacataccatttttaatggagactcaaaacattaaaaaaaaaaaaatcagaactgagcattgccaggagaggtcagacttgccataggatagactttctgggtctcatatgaagcctctacagacagaagcgtgtcctatgttcatggcctttctggatgtaaactggagtctctgacaaactacagtgcttttccaagctcacctctctagcctgtgatgaacactgccaaatacattaagtgaaacaccaaagcttagagggcgctgagcaacagaaaatggtatcagttggtccgcattcggacctcgtattcgtattgatggttctccccctccttgcctcctccctactccacctctgctgcccttatgcttggtacctctcattttggctctgcccctctggaagatcctctctgtatcctcatcctgcgatgagtggtggcaacgtgtgccctgagccctatgctaacgtgagtggtttctttcagtgttctcagattttccccagctcagtcctccctccttttctgcagcttggtcctggtttcttcttgccggcgtctccaagcagcaatgatggcttcatcgtccatttcttcctcttcctccctgtcagtgcttctccgatactgggaccgccgtccagatgcaaacctcccttcttctctgttttctgtcctctctttctctccctcttcttcagacctcataaagctctgggtgaacttcctcttggctccaaattcagagaagtctgacttggatgactcttccacatcttcccagtccctggacctggcccaatttgggcgctgtggttctggggactcttccctttctgaggactctggggtccggcggaagaagtagggctctgggctctcctctcgggaacttgaggtctcgttgtacgtggacctggagaacttgtgcatctctctgccctccctggtggaggaagatgagaaccgtgaagtgcttcttacagagttgccatttgcctcgtggtaggaggaggtgtcctgttcctctgactgggatttggaaaacttgtaactggaggatttagactctgtctccctgagcagggacgatctggtgtacttccctctggaacttccagaccagtcactttggaaaggaggtttttcctccgtcctgaggccactgagccacttattaatactgctatccatctctttgccaactctgctgccacttgcatagtgatcacagacagccagggaggagcatgtgtctgtttcaggtttctgggaattactgcgggaagaatatcggaagctccctatggcactgtcagtgtcctcatccccatcacccacaccatcatcctcatcttccttgaccttcttcttcttgaagagggagctgcgtttgttgtctgaggccagcttttccattttgtactcagacatcttctccctaagctccatctgcatctccttctccttccggccaagttcctttaggtccacattgtcagcaaagaggctgaagatgggcttgctggtccccctcactttgcttctgcaactttccgcgggtgagctcagtgtggtgttgcaggacagcacagactgcatgtcagagctgggtcttgcctggctctgaggcaacaggcagccacccaaggaggagctgctgtgtccactaagcatggagacttggtcatcccccaggcagctagccgctggtactgccttcatgcttgcaacagacggtgagcgggacaacagcagcatttcattttgcttctgagcaagggtctcactgactacattggcaatccagttctggatactggcaatggaaatggtgtctccaggccccactggcaggttaggcaggggtgtggtggggttggaggttgaacaccccgctatgttgcttgcagcctgagacaggtgggagcggtggctctgggtgctcagtactgacgtcgtgtccccatcagcgctgactgaggggtctgcagaccagaacgcagacaggggaatgctcccgctggccgtggagctgtccgcctcccagcttgccatagactggctctcctccagcgtctgccggcttctctccagcagctccagcctccgttgtctcttcttagccaaggccgagtcctcccccttgctgagctccaccacctcctccttgttctcactgcccaccttcttctggtgtttcagcttccaggcctggtaggctgtcaggctgacgtcggaggggttcttctcccctactgcctcctctgcaccgggctcaccgctgctgtctcccgctcccaagtctttcttgtgaaatccaaattggattctcttgatcttccatctttccagggcagtgagcttgtccttgttcctgctgcagaagttgtagaaggaactggcctcagagcccacgctgtcctcatcatcctcccgcaccctgctccctgcttctgagctcctgtctgccgcctcctctctcttgctcttggcgtggtacctccgggaagcctccttctcaatctccagcagcctctcgttccatgcgtcccaggtgctctccgaggacatcgagtctgcgcggcgcctcctgccgtggtccgggcggttcagctccagctgctgcttcaggacccagatgtcgtggctgctcacgctctcccaggcgctgctctcgctcagggtgcgccgccgcctccccaccgaggagccagcgtcgctctcctcctccttctcctcctcccttccccacctccggtacccttctgcttggtacctctcgtttcggctctgccactcctggatgatcctctccacgtcctcgtcctcgagctcctccccaccctggccagaggaggctgagcgccagccacctccatcctgggggaccttgtctgag

SEQ ID NO: 11883 - DNA, 562 bp, Homo sapiens
tctcctccatcaacttctcattgagctcccgcagctgcttcaggaagccgtcattggggtagatggcccgcttcttacgcacggtcatcaaagcctccaggatggccatgttgtggaagatcatcaggtaggcgaccaccagcactgctgaccggctgatgcccatttcgctgctgaccaggactttccctgaaatgaaaacacaagagaaaatgatgtaatgacagtggcttccttgtagtgttcttgtttgtttgttttctttggtaagtgctgttttaatatgctgcacttaaggtgtttactttgcctctgaagttcaccgggctcaagacacaggagggctgagcatcactgaccccatattacagatgggagacatcacaatccccactggccctgtatttgaaacactggagtgcatttctactttctcctcacaaaccgagcaacagagggaggagaaatacaagaacagggggaagggtgataaagcagaaaaggaatgagaagctaagataaatgaatcacagagaaatagaatcttggtgttgggaagcat

SEQ ID NO: 11884 - DNA, 665 bp, Homo sapiens
tctcctccatcaacttctcattgagctcccgcagctgcttcaggaagccctcattggggtagatggcccgcttcttacgcacggtcatcaaagcctccaggatggccatgttgtggaagatcatcaggtaggcgaccaccagcactgctgaccggctgatgcccatttcgctgctgaccaggactttccctgaaatgaaaacacaagagaaaatgatgtaatgacagtggcttccttgtagtgttcttgtttgtttgttttctttggtaagtgctgttttaatatgctgcacttaaggtgtttactttgcctctgaagttcatccgggctcaagacacaggagggctgagcatcactgaccccatattacagatgggagacatcacaatccccactggccctgtatttgaaacactggagtgcatttctactttctcctcacaaaccgagcaacagagggaggagaaatacaagaacagggggaagggtgataaagcagaaaaggaatgagaagctaagataaatgaatcacagagaaatagaatcttggtgttgggaagcatcataagtcacatcctaaacttgagaattccctttacaacatccctgatgctggatcacctgtcacacctgttatccagccactgctgaatgcttccagtgac

SEQ ID NO: 11885 - DNA, 1152 bp, Homo sapiens
gttcatcctcctcctgtgcctgaacacatttctgttctgctcactgaatgacaggcagagaaagggagagaaatccccatagaaagaagagcatacagccaagtttgcgttggctgtgcattctgctctcaatattcttagcctgtcttaacaatcattcttctgggtgggcatacatgcttttctttctcatgaaaaactgggcatctcagagcacggactaaaacccactaccaaggctgtgcctgcatctgactcatcaccctcaaagccctcctcatcctcctttctcattccctcattttcctcactagcctgggagagcactttgcccagcatggtgcttggctcatcattaagcttcctgaaaggacccacatcatcatcacttcctccatgaaggcttcaacaacatcccaggctaagttgctctgtgtttccacccagtgctcccacatcctgttttgcttatggctggcaccttgtaaggaaaatctgtttacctatccatcttccacaactctccattcccagcacacaaacactgtcagtcaccagcaggccttctctatctttgtgtctccatgcagtagaatcaaagaaagaattggttggattaattcatccatcaccaagggcacacaagggagccacggagaattagaaacaagcagcttcgagtcagacagctctgaatgtaacccctttttttacattttcaggtagaaaatcacttaaacctttagattttcaatcacctcatgtgtgagtgatgtcaatcaaggaaagtgactgagacaagtctcagtcattttaggggtttatttgcctaagttaaggatacccaggctgggcgcggtggctcatgcctgtaatcccagcactttgggaggctgaggcgggcggatcacctgagatcaggagttccaagccagccaggtcaacatggtgaaaccccgtttctactaaaactataaaaattagccaggcatggtggtggacgcctgtaatcccaactacttgggaggctgaggcaggagaatcactggaaccagggaggtggagattgcagtgagccaagatcatgccactgcactccagcctgggcgacagaggaaggctccgtctccaaaagaaaaaaaaaagatactc

SEQ ID NO: 11886 - DNA, 1152 bp, Homo sapiens; identical to SEQ ID NO: 11885

SEQ ID NO: 11887 - DNA, 1123 bp, Homo sapiens
gccaggcgcagtggctcacgcctggaatcccagcactttttgggagtcgtaggtgggcagatccctttaggtcaggagttcgagaccagcctggccaacatggcgaaaccccgtctctactaaaaatacagaaattagccagccgtggtgtcaggtacctgttgtcctggctactcgggaggctgaggcaggagaatcacttgaacccggaaggcggagattgcagtgagccaagatcatgctgcagtactccagcctgggtgacagagtgagactctgtctcaaaaaaataaggaaaaagaaaaggaaggaaagagcccacctcgctggttatgagcctcaggccagtaactcaactacgtttggagactgtggctctgtttctagccacggggaaaaaaacctatgaacaaacaggcacagcccctgcctccacgaagtgatgacttcatgccgcagacagcgaaccctcacctcccaacagatgcctcagtgactgcgggggaaaagccacgaaacagagggccagatgttgagactgaaccattcagggcctgagctgtctggaaggccggggcaggtccctgaggtggtgagttgggaaagagtggaacattccagaaagcaagagcctcaggtatgagtgctctgagctccaggggttcatcttgtcctctataaaggggggaatgacacagcgcagttgctggggaaaacagtggggttcctcaaagagtcacacacagagttactgtcattaccaaccagcgactccagtcctagggatctaccaaaagaactgaaaacaggcactcggcaaacacttgcacacacgtgcatagcagcatgagtcacggcagccgaaaggcgcaaacaactcgatagccatcaatagatgaatggataaacaaattgtggccgggcacagtggctcacgcctggaatcccagcactttgggaggctgaggtaggaagatagcttgaagccaggagtttgagaccatcttaggcagcaaagtgggatgcccatctgtaaaaaaaaatttttttttaattagctgggcatggtggcacacttgtagtctcggtggctcaggagactgagggaggaggatctctcgag

SEQ ID NO: 11888 - DNA, 1155 bp, Homo sapiens
ctcccctgtgtttccgaaatggggaaagaaaggccaggcgcagtggctcacgcctggaatcccagcactttttgggaggcggaggtgggcagatcccttgaggtcaggagttcgagaccagcctggccaacatggcgaaaccccgtctctactaaaaatacagaaattagccagccgtggtgtcaggtacctgttgtcctggctactcgggaggctgaggcaggagaatcacttgaacccggaaggcggagattgcagtgagccaagatcatgctgcagtactccagcctgggtgacagagtgagactctgtctcaaaaaaataaggaaaaagaaaaggaaggaaagagcccacctcgctggttatgagcctcaggccagtaactcaactacgtttggagactgtggctctgtttctagccacggggaaaaaaacctatgaacaaacaggcacagcccctgcctccacgaagtgatgacttcatgccgcagacagcgaaccctcacctcccaacagatgcctcagtgactgcgggggaaaagccacgaaacagagggccagatgttgagactgaaccattcagggcctgagctgtctggaaggccggggcaggtccctgaggtggtgagttgggaaagagtggaacattccagaaagcaagagcctcaggtatgagtgctctgagctccaggggttcatcttgtcctctataaaggggggaatgacacagcgcagttgctggggaaaacagtggggttcctcaaagagtcacacacagagttactgtcattaccaaccagcgactccagtcctagggatctaccaaaagaactgaaaacaggcactcggcaaacacttgcacacacgtgcatagcagcatgagtcacggcagccgaaaggcgcaaacaactcgatagccatcaatagatgaatggataaacaaattgtggccgggcacagtggctcacgcctggaatcccagcactttgggaggctgaggtaggaagatagcttgaagccaggagtttgagaccatcttaggcagcaaagtgggatgcccatctgtaaaaaaaaatttttttttaattagctgggcatggtggcacacttgtagtctcggtggctcaggagactgagggaggaggatctctcgag

SEQ ID NO: 11889 - DNA, 288 bp, Homo sapiens
ggtgcggtggctcacgcctgtaatcccagcactttgggaggccaagacgggcggatcgcgaggtcaggagatcgagaccatcctggctaacacgatgaaaccccgtctctactaaaaatacaaaaaattagccaggcgtagtggcaggcgcctgtagtcccagctactcaggaggctgaggcaggagaatggcgtgaacccaggaggcggagcttgcagtgagccgagatggcaccactgcactccagcctggatgactgagcgagactctgtctcaaaaaaatcaaa

SEQ ID NO: 11890 - DNA, 288 bp, Homo sapiens; identical to SEQ ID NO: 11889

SEQ ID NO: 11891 - DNA, 197 bp, Homo sapiens
ttatccagccctcctggtgggccaggcgtttgggggaccaactcaatcatttgctgcgacttccatgctttagcactgaatatcttgtgtcctaggaaacccctctgtcccagtgaaaccttgtcaccctgcagtcagcaacctgcctgcaggcatggtgcctggccccctctgggaggtgggtgtccctgagcttc

SEQ ID NO: 11892 - DNA, 38771 bp, Homo sapiens; identical to SEQ ID NO: 9789
  misc_feature (29356)..(30880): n equals a,t,g, or c

SEQ ID NO: 11893 - DNA, 90 bp, Homo sapiens
tttttttttttttttttttttttttttttttttttttttttgagacggagtctctctctgccgcccaggctggagtgcagtggcgcgatc

SEQ ID NO: 11894 - DNA, 741 bp, Homo sapiens
tttttcttcctagttacttttttttttttttttttgagacggagtcttgctctgttgcccaggctggagtgcagtggtgcaatcttggctcactgcaacctctgcctcccgggttcaagtgtttctcctgcctcaacctccccagtagctgggactacatgcacgtgccatcacgcccagctagtttttgtatttttagtagagacagggttttaccatgttggccaggctggtcttgaactcctgacctcaggtgatccaccctcctcggcctcccaaagtgctgggattacttttttctttatttattttggcttctgcttttcacatgaggggcttttctccaatatctgatgatccttcattgtccattcatcttcacaagtaaggcaccaaaatgctaactggaaatcacaaaatctctgtatgcctaggcaagcttgtgaactaatgaagcatcactgcaggatggggaagctaggtgttccactggagcaggggtccccagagttcagtatctgagatggtttctcttgggctgatcagtttctctgaagatgaagggtgcaacacatatgaaaatgaatcaatttcatcttcagagctacctgatattttcgattcctgatcctttctgaagcctacctgagtcttctgaggttctgtggaataaattagtttgctccttggccctaccctaactccacacacaccgtgcccacatttcagctttctcttgtc

SEQ ID NO: 11895 - DNA, 129 bp, Homo sapiens
tctttgtttttttttttttttttttttttttttttttttttgagacggagtctcgctctgtcgcccaggctggagtgcagtggcgcgatctcggctcactgcaagctccgcctcccggttacgccattc

SEQ ID NO: 11896 - DNA, 5775 bp, Homo sapiens; identical to SEQ ID NO: 9834

SEQ ID NO: 11897 - DNA, 738 bp, Homo sapiens; identical to SEQ ID NO: 9835

SEQ ID NO: 11898 - DNA, 3098 bp, Homo sapiens
tgtatctataaaaagatatatttttattctttatttttaaaatttatgtatgttcgtgaggcacaagtgcaattctgctacattgatatcttgcttctcagtcccacacaaggaagctgtctcacactatagagaaaatattcatgaacaaattcgtatcagtcacagtgagaggtaacactctaaatagcccatttcatgctcaagacatccaagtcaaagaaacccaatagcacagctgagtcccctctgttcccccccaacaccccactcacatcagggcccctgccctggagtgtcacctttattagctgtgagagacaccccagagccctgggcactgtcagtgattggggtagaacaaaaacaggacctggtcagagcccacagatgtggctagaggaactgtggggtgggtgagctccctcataggctcctgaccacaatatcccaacaatctcagggatcagcctccttcatcttacctgcagcctgagagtagctccctctgtttctatctatgggaagaaaatgtcctgtgagaggccagaaaggaggcagggccataaggtcctagagcaaacccctagtctttgatcccagagaagtttccagaaaagtgtaactgtagatccagggcaggatcaagaaatatgaagaaagcagatgtgggtcctggaccaactgccctcctgaggtctgtcatcagcagggaccttcccctgtgatttgtgactgctgggatcaggtcccatcaccaccataatcatcgaagtgaagaatctgtccttcattttcacaggagctttacaaatgagtaggtgctggcacacagggcccaggctgggtagacccatgagtgtggatggtgcttcccagtaatgaggcagggcacacttctacttggggcttgcaacccccagtgggacaagaaaactcagactccactcctcaccccttcctacctgagctcttcttcctccacatcacagcagcgaccacagctccagtgaccacagctccaaggacaacaaggccagcaacgatgcccacgatggggatggtgggctggggagactgctctgggaaaggaagggaaggtgaggggccctgatctccaggcctcagccctgaccctgctgaagagctccagaagggctcctgctttccctgagaaaagacatgacccctcgttcccctctttacccatctccctccttaccccatctcaggatgaggggctggggcagcccctcgtgctgcacatggcatgtgtatctctgttcctctccaggaggcaccaccacagcggcccacttctggaaggttccatcccctgcaggcctggtctccacaagctctgtgtcctgggtctgttcctccccatcccgctgccaggtcagcgtgatctccgcagggtagaagcccagggcccagcacctcagggtggcctcatggtcagagatggggtggtgggcaacgtgtgcctttggaggatctgagaagagtcagaaaattcaggcactttgcactcctcatgggaaaccccagcagcacccatgtgaccaacctgagaatggacaggacacctggggtggggaagggagcacagaacccagacaccagcctggacacagacacctgggaaaatctcctattccttggaaagttagagtctctgaggggggagcagggacttctggccctgacctaagtggaggccgagggactggaatcagagcctcaaacacattgagtgtgaggcagagaacaaaacttgagagaaaagtcacggggcccaaggctgttggagggctcaaaggggaccgcggatcggtattccagggactgtcttccctccattccctcagaaatttcatcccttaattgtcccagagagcagggcggactctcacagtcactctctggtaccggatctcgaaagccaggaagattcttcctactcaggactagagggagggcgatatcctagcattgggtccactttcctcccaaccttgtgcgaggccatcccaagagatctacaggagatagggaaggcgcccatggcccctggtacctgcgcgctgtagcgtctccttcccattctccaagtatctgcggagcaactccaggcactcgccctccaggtaggtcctgaactcctctgcatattcctctgcctcatagaagcgctgggtgatctgagccacggtgtccgccgcggtccaggagcgcaggtcctcgttcagggagatgtaatccttgccgtcgtacgcgtgctggtgatacccgcggaggaggcgtccgtcgggccccatgtcgcagccattcattccctggagggtgtgagaccctagccggtccccgcagtcagccccgcccagctagccccgccccctccccgcccaacccgcggggattttggcctaaactgaaaatgaacctgggtaaaggcgcctgggactctcccgggtggagggtctgggcgggtcccgctgcctcggggtagatttcggatccggagactctgagggacccgggcggtccgtggcggatggggggtggtcgtgacctgcgcccccggccgggttcactcaccagcctcgctctggttgtagcggcggagcaggttcctcagggccactcggtcagtctgtgcgttggccttggcgtaccctgtggtccactcccaatactgcggcccctcttgctccacccacggctcccgcggctccatcctcggaatcgcggcgtcgctgtcgaaccgcaggaattgcgtgtcgtctacgtactccacggcgatgtagcggggctccccgcggccgggccgcgacacagcggtgctgaaatacctcaaggagtgggagcctgggggcgaggaggggctgagacccgccagaccctcctccggaggcggctccctgagtcctgcgcccccaccgggcgggcccctcactcctccccacagaggccgtttctctctggaccccgcactcacccgcccaagtatcggtcagggccagggcccctgagagcagcaggaggaggcttcggggcgccatgaccccaacctccgcgtctgggaaaaatatgag

SEQ ID NO: 11899 - DNA, 169 bp, Homo sapiens
ggcacgcgcctgtaagtcccagctactagggaggctgaggcaggagaatcgcttgaacctgggaggcagaggttgcagtgagccaagattgcaccactgcactccagcctgggagacagagcaagactccatctcaaaaaaaaaaaaaaaaaaaaaatttctgaaagaa

SEQ ID NO: 11900 - DNA, 4771 bp, Homo sapiens
gggtacggtggctcatgcctgtaatcccggcactttgggaggccgaggtgggtggatcacgaggtcaggagatcaagaccatcctggataacatggtgaaaccccgtctctactaaaatacaaaaaaattagccgggcgtggtggtgggcgcctgtagtcccagctactcgggaggctgaggcaggagaatggcgtgaacccgggaggcggagcttgcagtgagcggagattggcgccactacactccagcctgggcgacagagcgagactccgtctcaaaaaaaaatttttttttttggtagatacggggtcttgctttgtcacccaggctggtctcaaactcctgagctcgagtgctccttctgcctcagcctcccaaagtgctgggattacaggcgtgggctgctgtgcccagcaggaataatttctcagtgcatctctgatggggaggctaatgaagaaaggacacctggtttgaaggcttctctgtgtctgtccgtgggcgctactgatctgagccaagcaccattccgcaggcatgcctgaaatgactcccatggctgtcatggtgccatctggagagcatttgctcactgtaatggtcccgtcacacttgtctgatgaggatctgttggttgactttgacagtgataaacgaacacagcctatctgggtgttttttgcacttatagtttgggggtttgaagtactggctagaagctggcggggtgtgtgtgtgcaggtgtgcgagtgcatgtgcaagtgtgcgtgcaagtgtgagtctgcacttgtgtgcaagagaatgtgtgtgtgtgtgtgtttggagatttggacttgaaaattctagctcaggtctttggggtagtgtttgacctgaactctgaaaggcagagggtcccagactttcctgggatgatgggaactgggcaccccagatgaggctcggttgtgagtaggagcggggtgggccaccgaagagaagacagagtgggcctgtagggccagcccgaggtacccacagtggagggtctacaggctgatttgggaggtggtggtttatacctgtagtcaccttctatcttagttaggaattcaccttcacacttccagaaactgccaagaagaatgccgccgctcaggtttatctggtagaataagctgtttgaacaaagatctggaggttgcacaatcctgtgtcattctggatttatcttggggtcgggagtcaacgatacttcttgtgctgtcgtttctccggccgtgtgaagttaccacctcgtgagtggtcataagttagcgtgtctaaatgcactttgaaatcctaggatgaaaaagccaggccctgtcttttttccttgtctaagcaccatccttgcttaggagagacacggctgtggctctcaggctgtggggcaatgttctgcttataatgtttcaagaggttcaaagcgtgcaggccccatgctccgtgagagccttgacctgggtcagcaggggcggctgggcttgactcgagaattcccacagggcccgagggaagagcagagcaagagggaggagcgcgtggagccctatgtggcctgcgatattggggtggcgtccaggcccgcctagatgggggagggagacaacagagctgccacctgctcaccgcagacccaggggcccaggaggagcggactaggaccggcagtgccttccagcctaggtctcctgcccctgggctggagttcatcttttaggcaaatttggaataggaaccttaaaaatgctttcttcactcgtttaaatagtaatgataagaatatggctgcagggggcagcttatgcctgtaatcccaccattttgggagctcaaggcaggagtattgcttgagcccagaagtttgagaccagtctgggcaacatagtggaaacttgtctctccaaaagctaaaagaaaaagccgtgcatggtggtatgcacctgtagtcccagctacttgggaggctgaggtgggaggatcgcttgagtctgggaggtcgaggctgctgtgagccatgattgcaccactgcattccagcctgggtgacagagcaagatcttgtcttaaaaaaaaaaaaaaaaaaaaaggtgttgtattttatcattagaaggccatcctgtttagaagagtgggtttctcataagaaaaaaaagaaaaaggttgaccttgtaagtatattttcttgggtgaattgtggtggtggtaatggttttaactggtgttaatttcagttcttttaaaagttgtggtaagatacatgcaacataaaatgtgccctcttccccatttttaagtgaacagttcagtggcattaagcacattcagtttgcctgccaccgttaccaccatccatctccaaaattctctccatttacaaaactgaaactctgtccctattaaacactagctccccattccccactgtgccgcccccccaaagcccctggcaccaaccattctacttcctgtctctgagtttgactagggacctcctgtaagtggatttgtacaatatttgtccttttgtgtctggcttcttcatgtagtataatgtcttcaaggttcattcatgttgtagtcaggatcaccttccttttaaaggttgaacgatatcccgttgtatggacagaccacattttatccattcacccagggatggacacctgggttgcttccatctctcggctcttgtgaataatgctgctgtgaacacgggtgtgcagatacctgttcaagtccctgctgttttcttttgagacggagtctcgctctgtctcccaggctggagtgcggtggcaccatctcagctcactgcaagctccgcctcccaggttcaggccattctcctgcctcagcctcccgagtagctgggactacaggtgcccaccaccacgcctggctaattttttgtatttttagtagagacggagtttcaccatgttagccaggatgctctggatctcctgacctcgtgatccacccacctcggcctcccaaactgctgggattacaggcatgagacaccacgccccgccgagtccctgcttttaattctttggggcagggatccccaaccccctggtgatggaccaatactggcctgcggccccttaggaactggactgcacagcaggaggtgagcggcaggtgagcgtgcattcccgccggagccccgcctcccgtcagatcagcggcggcattagattctcataggagcgggaaccctcctgtgaaccctgcataccagggttctccatgcaacaatctaatgcctgatgatctgaagtggaacaggtttttgttttttttttccagacagagtcttgctctttcgcctaggctggagtgcagtggcatgatctcggctcactgcaacccctgcttcctgggttcaagtggttctcctgcctcagcctcccaagtagctgggattacaggtgcccgccaccatggccagctaatttttttgtttatttgtttatttattattttttgaggtggagtcttgctgtcacccaggctggagtgcagtggtgcaatctcagctcactgcaacctctgccttctgggttcaagccattcttgtgcctcagcttcccgagtaggtggaattataggcgtgtgccaccatgcccagctaatttttgtatttttagtagaggcgggatttcaccatgttggccaggctggtctcactcttgacctcaagtgatctgcccgcctcggcctcccaaagtgttgggattacaggtgtgagccaccgtgctcagcctgaagtgaaacagtttcatcccaaaagcatatacctctgccccatccatggaaaaattgcctctcatgaaaccagtccctggtgccaaaaaggttggggaccgcggctctggagtatatgcctaggagtaggagtgtggggtcatatggtaatttatctttaatttttggaggaattgaatttcaattcttattattaccaaaaatacttaaaattcttacagatggcatgggaaagtagcacacagtcgggactctgcagccgagtttgcctccttgaatgcacacataacacaggaacaaagacagagctgcttccctcctgttgggtctctggcggacagtcaggtatgctgagggagacactgttctcaaactccaggccagggtggtttccggagggtccaccggtggtctcatctcttctctctcaaaccatggatggtgccttttaaagaaaatgacaccggccaggtgcggtggctcatggctgtaatcccagcactttgggaggccgaggcgggtggatcacctgaggtcggaagttcaacaccagcctggccaacatggtgaaaccccgtctctattaaaaatacaaaaattaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaatacaaaaattagctgggtgtggtggtgggcacctgtaatcccagctactgaggaggctgaggca

SEQ ID NO: 11901 - DNA, 787 bp, Homo sapiens
cgagtgttggagtgactgtttgcacacatctgttgtgttttgcctgtgtgcattcctcctcctggtcagagagcccgtctcttccgccctctcccttaccctaggagggctgagtcaggcctccctacccaggcccaagggcagatgcacctgagccattgtgtcccatggttgatacgggacggggctgatttcctgacctggacccctgagacccagtgctcttagctgtgagcctctgggaagaggttctggcaggtggaggggatggacgttacagtgctgtggccacctagaaaagccgtcccggaactgagaccaactgctgagggaggaagggccaccagatcgggggccgggccggggtgagcacctgaagccggctccacctgctcttctcagctgtgcgcctccaggaatttgcactcgcttcagctgatttgggttggatttctagcgtttcacatacaggatctagactcgcacacaactgcattaatatgttggtgtttgataaactagggttgaaggagttccatcagtgaagagagaagccacgtgacctgaggatgcagggcactgttcacgtggacatgagccgtttcttagcatcatgagattttagaaacatgttcttactctgccaggacccagggataggtgaggctctcctattgggataccatttcaccagcagagagattaattggagaatgtgtaattttttcccctttggaaataatttgttcttttttttttttgacagagtttctttctgtcatccagg

SEQ ID NO: 11902 - DNA, 84 bp, Homo sapiens
ggaggcagaggttgcagtgagctgagatcgcgccattgcactccagcctgggcaacagagtgagactctgtctcaaaaaacaaa

SEQ ID NO: 11903 - DNA, 359 bp, Homo sapiens
gtttaacacctcgcagtaagggattcttcacatcccagaagtagctaccctgcatcttaaacagtatgctaggttagattcttgcccgtttgctgttcctgataatgccctttaactcacacaactgagctgttgttagttaggatctacggccacagaaatagtatgtctgaaataaacataaatatgagtaaaatccaggcataccccgctaaatcatgcccttcacttccttcctgtttgtaaatcttttgtaagccttcaactttttttctttttaagcttgtagccatttctttttgaatgactcttagcttactgtgtttccaggggttgaggagccatgtatctgtgggata

SEQ ID NO: 11904 - DNA, 358 bp, Homo sapiens
gtttaacacctcgcagtaagggattcttcacatcccagaagtagctaccctgcatcttaaacagtatgctaggttagattcttgcccgtttgctgttcctgataatgccctttaactcacacaactgagctgttgttagttaggatctacggccacagaaatagtatgtctgaaataaacataaatatgagtaaaatccaggcataccccctaaatcatgcccttcacttccttcctgtttgtaaatcttttgtaagccttcaactttttttctttttaagcttgtagccatttctttttgaatgactcttagcttactgtgtttccaggggttgaggagccatgtatctgtgggata

SEQ ID NO: 11905 - DNA, 147 bp, Homo sapiens
aaaaaaccagccaggcatggtggctcacacctgtaatcccagcactttgggaggccgaggtgggtggatcacttgaggtcaggagttcaagaccagcctggacaacatggtgaaaccctgtctctactaaaaatacaaaaattagcc

SEQ ID NO: 11906 - DNA, 111 bp, Homo sapiens
ggccaggcacggtggctcacacctgtaatcccagcactttgggaggccgaggtgggcggatcacctgaggtcaggagttcgagaccagccccgccaacatggcgaaacccc

SEQ ID NO: 11907 - DNA, 610 bp, Homo sapiens
ggaggaaagagggtggaatctggacagtatgaaggatttgtattgtacctgtaatgtttgatgtctgaagctgggtggtgggcatggctgtttgttattctccatccttttggtatgcctgatacatttcataataattttaaaaaggacaagactattgcagagaaatgcatagagtgagctctgtttgggtttttaaaatgattcctacatctatgcttgcagatgtaagcaccagccctggaaaacattgcaagggattcttagtaggcccaagctttgggaaagggcccagggggctggggagttgattaggaggggatacatgctttttcctgctgccttttgaattttgtaccacacgtagtattacttattaattaaaaaataatctgaactagccaggcgtggtggcacatacctagtctcagttacttggaaggctgaggcaggaggatcacttgagcccaggtggttgcggccagcctgggcaacatagtgagaccctgtctctttagaaaaaacaggccaggcatggtggctcacacctgtaatcccagcactttgggaggctgaggtgggtggatcacctgaggtcgggagctcgaga

SEQ ID NO: 11908 - DNA, 610 bp, Homo sapiens
ggaggaaagagggtggaatctggacagtatgaaggatttgtattgtacctgtaatgtttgatgtctgaagctgggtggtgggcatggctgtttgttattctccatccttttggtatgcctgatacatttcataataattttaaaaaggacaagactactgcagagaaatgcatagagtgagctctgtttgggtttttaaaatgattcctacatctatgcttgcagatgtaagcaccagccctggaaaacattgcaagggattcttagtaggcccaagctttgggaaagggcccagggggctggggagttgattaggaggggatacatgctttttcctgctgccttttgaattttgtaccacacgtagtattacttattaattaaaaaataatctgaactagccaggcgtggtggcacatacctagtctcagttacttggaaggctgaggcaggaggatcacttgagcccaggtggttgcggccagcctgggcaacatagtgagaccctgtctctttagaaaaaacaggccaggcatggtggctcacacctgtaatcccagcactttgggaggctgaggtgggtggatcacctgaggtcgggagctcgaga

SEQ ID NO: 11909 - DNA, 612 bp, Homo sapiens
ggaggaaagagggtggaatctggacagtatgaaggatttgtattgtacctgtaatgtttgatgtctgaagctgggtggtgggcatggctgtttgttattctccatccttttggtatgcctgatacatttcataataattttaaaaaggacaagactactgcagagaaatgcatagagtgagctctgtttgggtttttaaaatgattcctacatctatgcttgcagatgtaagcaccagccctggaaaacattgcaagggattcttagtaggcccaagctttgggaaagggcccagggggctggggagttgattaggaggggatacatgctttttcctgctgccttttgaattttgtaccacacgtagtattacttattaattaaaaaataatctgaactagccaggcgtggtggcacatacctagtctcagttacttggaaggctgaggcaggaggatcacttgagcccaggtggttgcggccagcctgggcaacatagtgagaccctgtctctttagaaaaaaacaggccaggcatggtggcgtcacacctgtaatcccagcactttgggaggctgaggtgggtggatcacctgaggtcgggagctcgaga

SEQ ID NO: 11910 - DNA, 375 bp, Homo sapiens
cagcctacaaagaacaatgatgcctgggaaccatcgccaggctacactgttgactaacaaagccacgggccccgcaagaaacaattcagtaatttccacagggttggagatgactcagcagttccactcctgcacgagcacccgagagttgccctgatagccgtgcacttgggcgttcatcacagcatttgcttcttacatgaatttttaattttggaataatttcagatttacagagaagttacaaatccaatacagagaattcttgtatactaccctgctcagttttctcctacaattaacatcttaatcatgatacatttatgaaaaccaagaaattaacattggtagaatgttgttaattaaatgacagat

SEQ ID NO: 11911 - DNA, 873 bp, Homo sapiens
tttggagctgttgggtacacctgcagaaagcctgtcacttcacacttggaagattacacagcggccaggcagaggcgcccctcacctcccagatggggcggccgggcagaggcgcccctcacctcccagacggggcggccatgcagaggcgcccctcacctcccagacgtgggcggccatgtctaggctcccctctactttcccagacagggcggccgggcagaggcgctctcccccccttttcccaaacggggcggcccggcacttggcgctctctcattttcctagacggggtcagccaatgcgataggcgctatcctcacctccgcagaacgggggcggcccagcagtggcgcccctcacctcccagacggggcggccgggcagaggcacccctcacctcccagacggggcggccaggcagagaaaggagacttcactgcccatccacgagggctggttgcatacactgcagaacatctgtgcaaaggaactggacagcctacaaagaacaatgatgcctgggaaccatcgccaggctacactgttgactaacaaagccacgggccccgcaagaaacaattcagtaatttccacagggttggagatgactcagcagttccactcctgcacgagcacccgagagttgccctgatagccgtgcacttgggcgttcatcacagcatttgcttcttacatgaatttttaattttggaataatttcagatttacagagaagttacaaatccaatacagagaattcttgtatactaccctgctcagttttctcctacaattaacatcttaatcatgatacatttatgaaaaccaagaaattaacattggtagaatgttattaattaaatgacagat

SEQ ID NO: 11912 - DNA, 375 bp, Homo sapiens
cagcctacaaagaacaatgatgcctgggaaccatcgccaggctacactgttgactaacaaagccacgggccccgcaagaaacaattcagtaatttccacagggttggagatgactcagcagttccactcctgcacgagcacccgagagttgccctgatagccgtgcacttgggcgttcatcacagcatttgcttcttacatgaatttttaattttggaataatttcagatttacagagaagttacaaatccaatacagagaattcttgtatactaccctgctcagttttctcctacaattaacatcttaatcatgatacatttatgaaaaccaagaaattaacattggtagaatgttattaattaaatgacagat

SEQ ID NO: 11913 - DNA, 2014 bp, Homo sapiens
tacaattccttttcttgcacagacattttcccaagtcagtacatctgggataatagttctcagagtggctgtatattatattcacatgaagagattttaaaagttataccccatgttcatcgctttatgttcaaaagtgtcttttagggcttttaaatctttactggatttttacataattttgaattacgttccccaaattgcttatttattacaaagagaaagagtgagattagaatcatggtgatatgaatgtgttgataatttcacatgtatacatgtataaaaaatcaagttgtacatcttaaatatatacaatttttgtcaattatacttcaataaagctgaaaaaagaacacactataaacatgtcactttttacatacatatctatttctattgtatttttctaaagctattaatgtacaagttttacaaagaatgtggttaacttataatggacttggaatttgaagaatagtctgtcagactcagggccagcaatataagtcctgattcgttccttcttgagtttcaggggtgtgtgtgtgtgtgaatgcatatgtctgtgtacacacatatgtagtatttatgcctggcatgtatacaatatgggtccatatatgcaactgagcaggtattttagaacatctgatgaccttgtcatttcaagaactgtggccacagattgagaaataaagcaccctttcagtagtctgagtatttctcaacaaaagtagagacttgcccatccttagtcatttctatgggaggagtggcctctcattttatgcttttatagggacgtctattcccagcccatagtttatgagcaacattctgtcagcaggcaggaatagtggctcgctataattaattcccttcttgctcccccacctctgagagtgagaaataaaagggcattaaagggaatgtagttacaacccacaaagggaccacataaaatgtcaccttttggctcaacacattgttcccttcgtgactcctagtcctgaatttccatctcacagggcaggcagagtgtattgtcagctgagacccaagagagacacattggcagtcaatctgcatgatatggtaggggtattagttaaaactttactgaaagttaagatctgtgtcaaaggtttttccttgtcctatgtgcattacatggaaggcagaagaaaacaaggaaaagagatgaattgctgttgcaatttaaagtatgggggcagagagttgagtgtgagctgcagaatttctatgtgacaacatagaatagtggtgaagttacttaacttttgtgggcttcagtcctcctgcctccctttgtagcattagcatcataatacgtgtctcccaatgtttcagggaagagtaagtgggtttagatatatgtagtgaataccacagtacctgacatatagtcagttctcagtgctgataatcatataaattgaaagcaattaaaacacccccatttatcttcccatgcataatttataaagcacattcacatcatgcaaattcatcctcacaacactcaacattcaattaagataagcatgcactcttgtttccctttgcacaacttttgcaagttgaatggctggtttggttagattcaatccagtgttctttccattagagcagctgccacctagagaagaggacaatgtttctcccagccattgaacatgctgcatgtctctgttgaggggccaccatcaaaactcaggccctgctgttctcctctaggaggacagatggtcttaaggaatatagggaccttctagaccggaatcctcacaccaaacctttagtctatggtaatcactgtttacaaaagtttaatcttgttcccttctttaaaagtttcagagcattggtgtttattgacttttttgtttctttaaaaaagaggacaagccaggcacggtggctcacgcttgtaatcccagcactttgggaggctgaggcgggcagatcaccggaggtcaggagctcgaga

SEQ ID NO: 11914 - DNA, 170 bp, Homo sapiens
ttctggccaggcacggtggctcacgcctgtaatcccagcactttgggaggctgaggcgggcggatcacctgaggtcaggagttcgagaccagcctggccaacatggtgaaaccctgtctctactaaaaatacaaaaattagtcgggcatggtggcgggtgcctgtaatcc

SEQ ID NO: 11915 - DNA, 2014 bp, Homo sapiens
tacaattccttttcttgcacagacattttcccaagtcagtacatctgggataatagttctcagagtggctgtatattatattcacatgaagagattttaaaagttataccccatgttcatcgctttatgttcaaaagtgtcttttagggcttttaaatctttactggatttttacataattttgaattacgttccccaaattgcttatttattacaaagagaaagagtgagattagaatcatggtgatatgaatgtgttgataatttcacatgtatacatgtataaaaaatcaagttgtacatcttaaatatatacaatttttgtcaattatacttcaataaagctgaaaaaagaacacactataaacatgtcactttttacatacatatctatttctattgtatttttctaaagctattaatgtacaagttttacaaagaatgtggttaacttataatggacttggaatttgaagaatagtctgtcagactcagggccagcaatataagtcctgattcgttccttcttgagtttcaggggtgtgtgtgtgtgtgaatgcatatgtctgtgtacacacatatgtagtatttatgcctggcatgtatacaatatgggtccatatatgcaactgagcaggtattttagaacatctgatgaccttgtcatttcaagaactgtggccacagattgagaaataaagcaccctttcagtagtctgagtatttctcaacaaaagtagagacttgcccatccttagtcatttctatgggaggagtggcctctcattttatgcttttatagggacgtctattcccagcccatagtttatgagcaacattctgtcagcaggcaggaatagtggctcgctataattaattcccttcttgctcccccacctctgagagtgagaaataaaagggcattaaagggaatgtagttacaacccacaaagggaccacataaaatgtcaccttttggctcaacacattgttcccttcgtgactcctagtcctgaatttccatctcacagggcaggcagagtgtattgtcagctgagacccaagagagacacattggcagtcaatctgcatgatatggtaggggtattagttaaaactttactgaaagttaagatctgtgtcaaaggtttttccttgtcctatgtgcattacatggaagacagaagaaaacaaggaaaagagatgaattgctgttgcaatttaaagtatgggggcagagagttgagtgtgagctgcagaatttctatgtgacaacatagaatagtggtgaagttacttaacttttgtgggcttcagtcctcctgcctccctttgtagcattagcatcataatacgtgtctcccaatgtttcagggaagagtaagtgggtttagatatatgtagtgaataccacagtacctgacatatagtcagttctcagtgctgataatcatataaattgaaagcaattaaaacacccccatttatcttcccatgcataatttataaagcacattcacatcatgcaaattcatcctcacaacactcaacattcaattaagataagcatgcactcttgtttccctttgcacaacttttgcaagttgaatggctggtttggttagattcaatccagtgttctttccattagagcagctgccacctagagaagaggacaatgtttctcccagccattgaacatgctgcatgtctctgttgaggggccaccatcaaaactcaggccctgctgttctcctctaggaggacagatggtcttaaggaatatagggaccttctagaccggaatcctcacaccaaacctttagtctatggtaatcactgtttacaaaagtttaatcttgttcccttctttaaaagtttcagagcattggtgtttattgacttttttgtttctttaaaaaagaggacaagccaggcacggtggctcacgcttgtaatcccagcactttgggaggctgaggcgggcagatcaccggaggtcaggagctcgaga

SEQ ID NO: 11916 - DNA, 1685 bp, Homo sapiens
gtagattcctatcaggttcatttgatcctgtgctgagttcaggttctaaatatctttgttaattttctgccttgatgatctgtctaatgttgtcagtggggtgttaaagtttccccctcttattttgtgggagtataagtctcttcgaagatctctaaaaacttgctttataaatctgggtgctcccgtgttgggtgaatatatatttaggatagtttgttcttcttgttgaacattttaccattatgttactataatgcccttatttgtctttttttgatctttgctggtttgaagtctgttttatgagaacctaggattgaaacccctgctttttttttctgttttccatttccttgagagatttttgttcatccctttattttgagtctatgtgtgtctttgcttgtgagataggtctcttaaagacagcataaaaatagatcttggttctttatccatcttgccactctgttttttgaccagggcatttagctcatttacatttaaggttagcattgttatatgtgaatttgatcctgtcatcataatgctagctggttattttgcagacttgtttatgtggttgcctcatagtgtaacttgtctgtgtacttcagtgtgtttttgttgtggctggtaatagttttttctttccatatttagcacttccttcaaaggctcttgcaaagtaggcctggttgtgatgaatttcctcatcatttgcttgtctgaaaagggtcttatttctcattcgcttttgaagtttagtttggccagatatgaaattaagggttggaaattcatttctttaataatgtcaaatattggcccccagtttcttctggcctgtagggtttctgctgagaggtccactgttagtctgatggaattccctttgtagatgacctgacctttctctctggttgcccttaacattttttctttcattttgaccttggataatctgattattacgtgttttggggttgatcttcttgtttagtatattactggtgttctctgcagtttctgaatttgaatgttggcccacttttctaggttgaggaagttttcctggatgatagcctgaagtatgttttctaacttggttccattctccccatctctttcaggtaccccaatcagtcataggttcaatctctttacataatcccatatttctcagaggttttgctcattcctttttatttgtttttctctatttttgtatgcctgtctcatttcaaatagttttcaagctctgagagtcttttccctgcttgttctattctgctactgatacttgtgattgcattgtgaagttctcgtgttatgtttttcagcttcttctggttagttatgttcctctccaaactggaaaatgctatggttctggcaggcttgtaaaggtgctgtgctgatggtcttagacaagatctggaataattatttggattatcagacagagattctcattctttttctgttactttctctcaaacaaatggagtctctctctctctgtgttcttagctgcctggagttggcagtggagtgacacaagcacccctatggctactgccactagggcggcactacatcagatctgaagacagcacagtgctgggtctcacccatggcctgctgcaaccactcctggctactgcctatatttgctcgag

SEQ ID NO: 11917 - DNA, 6694 bp, Homo sapiens
ttttttttgtttgtttggttttttttttttgagacggagtctcgctctgttgcccaggctggagagtgcagtggcgcgacctcggctcactgcaagctccgcctcccaggttcacgccattctcctgcctcagcctcccgagtagctgggactacaggtgcccaccaccatgcccagctaattttttgtatttttagtagagacggggtttcactgtgttagccaggatggtctcgatctcctgacctcgtgatccgcccacctcagcctcccaaagtgctgggattacaggcgtgagctaccacgcctggccctaatttttgtatttttagtagagatggggttttgccatgttggccaggctggtctcaaactcctggcctcaggtgatcctcctgcctcagcatcccaaagtgctgggattacaggcgtgagccaccgcacccagcccaccccagctgttcttctcaggccagttcttgacagcactcaactcaagccccggtaggtggcagggactcattctcctgttaggaaagggccactggatggggaaggaaagatgaatggagcagcatgtgtgcacaactattctggtagtgcttcctctacaaagactagtgtgaacattttccatttgttggtagtcccaagaaaatgtggcttgtagatattgatgatgatgacaatggtagaaataacagtgaacacttatgtagcatctcttatgttccaggtgctattttgagtgctttacatatattacatcattaaaacctcataacagagatttctctagtcaagaaataagaactgtgagacacaatgagtttctcctttaccttttctcctgaaaagcttagagttgggtgcctggaaaacttctgtctactcctctggcttctttcaaagcttctgggttctatgctatctttagacacctcagcctgctacatttcattctgtatgccatccccagggcttgggaagtaggaggagttcacaattttaacacaggtccaaaaggacatgatccagtgtaaaactccacaggtccaccctgtctttcccatcccacatcacccaggagaggactcccacgggactcaacacacgggctaacccaaagtcacccaccactcccggggccatcaccatgggagctgccaatcccagggcccttcagaggctcagcccagcagcccttcccatgcccaccgcagtccccagaagccacccactgctttggtttcttgccccttttctgctaatcttgtggtttgtagggagaaaaaggggcctttactcactgctgtcgcatcatggggatattgacacagttagccgcagccacagcggcaaagggcacccagcggcccaccaagggcggcgctttctgttgggggaagagaacagtaggagttgttcagaagcgctggaagatgggaggggagggggctgaacgactagaatacaaaaaagaaaactaggccttgctaccgccacacatccagacacccagtctgggaaccccaaactccctcaaaggcccaagaagaaccaacctggggacggccctggtgtatttctcatcacttggccagccgggctctggccattcccaactcacccagcctggggaactgtccctgggggaaggacgttttccctaggactctgctgcccccgcgtggccaccatgctgcagcggccccagaccatacctttgtcaacatgttcatgcccacagccgtggccacagcagtggttgtggctgtgaagtaggaaagggccatctgcctgggggaggagagagatgcttgggagtggggcccctgccggctgagggccaaaccacgggcttgagggagaaagtcggctggcgaggcttcgtgcgtgaaaaccgcacaggatctgtccccagccttatcttgtgaccctctccccctcactcacagtgccccagcccccttggacttctttcagtactgtgaacatgccaagttcctccctgcctcggagcctctgcacacggctgctccctatgcggggaggtgttccctgggctcttgggtcattcatccctcatccttcaggacagttgaaatgtcgtcttcacagatgggactgctctaagtggcctaactacacagacaccgctctgctgttctctgccttgcaaccctggttttctgggtggttttttttgtttgttttgagactgatcttaggcaatctgcctgcctcagcctcccaaagcgctaggattacaggtgagaaccaccgtgcctggcccaaccacatgtcttaacaatgtatcccagcatctagaaccatgcacatccccagcacataagacacactcaagaagaaatatttagagaatgaatgaataaacacatttggaattggtctaggaagaagatccacccctactcagcttgagaaaatatttccaaaccctgggaaagggtgacttggtcacctgctcagtgcaggtgctacccaggaaggactgacagcccagaaccctttagaaaagctgttcgtggggagacacgaggacagcctggggttcaggtctcctacctgactgatgtgggggaagccgcattcctgttggtgtagttgactaaggcattgaaggactggttcacccactgccagaagatcaccgccggcatcgtcctaccagtgaggaaggccaggagaggcagagagaagtcagatggcagggagtcctgagggtatgccagtcaaagcacatgatctgcaggtccccacactgttcccatactagttttttatttttatttttttgagacggagtctcactctgtcacccaggctggagtgcagtggtacgatctcagctcactgcaacctccgcctcccaggttcaagcaattctcctgtctcagcctcccaagtggctgggactacaggcacacaccaccacgcctggctaatttttgtatttttagtagagacggggtttcaccatgttggtcacgctggtcttgaactcttgacctcaagtaatccacccgccttggcttcccaaagtgctgggattacagacatgagccaccgtgcccagcttgttcccatactgttttatgcacctgggcttttgcgcaggctggcccctctgcctcaaatatctccccctcctccttccatacatggccaaccctgccctgttgagagggatcacttcctccatggaaccttcccgaccctttccctgcccctcctgagacagagtaagtcactccatgctcctgctcccacaaccccatgttcttcctccaacctaccacttaccaagctgtactgtaactgtttacttcttggtctcctcaacaaaactgggagctccttgacgggaggttactgaagccttcacattcccaacacccggcccaaagcccagctcaatagctgaaccaatcaatgcgtggggtgggggacgcaggggaggaaggaagaggtaggaagaagagtcacatgtccagcagctacagaggcagtctattctctccccagccaagccaagaaagggacttcctattgttttgtttgggtgttacataattaaaatcattgtggaataagtactttttaaagagggaattggggtagcttatttgttgagggttctacacaggactgcctcagttaaaatccaggcacccatatttcctgcctgtttaaacctggacaagttcttcagcttctctagaactctagttcttcatctataaaatggaaataatagtacctatagtgtagggttgttgagagggttaaatgaagcaatacgagcaaagaatgtagcatagtgcctggtatctggtaagtgaccaatcaagagaactattattattatcatagtatgactccctgaccagcagatccaggcagctgtacctcccacggccctgcccccaggtcccacctgtagaactggagcatgaagcccgtgatgatcatgccgccaggaagctggaaagacatgcgcccgatgacattcatcttctccccagtgtcggggtggaaggccgagtcatacagcttcttggcatacagcagctgctccacttgggtgcctgggggcacaacccccatcctgccacccaaggacagcaggcagtcaccatcctgcctgatcaatgtctcccagtctccccactctcacttcttccagcccccagccctgagatttctgcctattccttcaccttcggtttccacctcctcccaagaggaccccatcaatgttaccctactacttccagccccttccccgacccctcacctgctcttctccaccatcaccttggcccagtccagctcccgctcagatacaaagacagtgcgggggtccgtgatgtttaggaagtgcttcactctccccaggaaggtgcgctggtcccaacggggggcatcgatgttaaagccagacaggtcagcctccatcttgctcacacataaaactgtggacctaagggacaaaggaagaagatgactgtcccctaaatcaaagcccaccacagaggacctgagcaggtcccactgttgcagactgcctgctctcaccagctactgggcatcgtctgactcagcttgggagggcccaagtgaatggtcatcagattgagcaactgggcaccaacatgtgtttcctgagggcctgctggtggccagctctgtgcttgaccatacagcaggagggactggaaaaggggacaatacagtgcctgtgcttggggagctctgggaacaaaagcccacccattaaatagtataatacccccaggtgtttctggcaggggagatgggaaaagtagccattttgaaaaacagccagctgggtgcagtggctcatgcctgtaatcccagtactttgggaggccgaggcagggggatcatgaggtcaggagtttgagaccagcctggccaacatggtgaaaccccatctctactaaaaatacaaaaatgagccgggcgcagtgccaggcacctgtaatcccagctactcaggaggctgaggcagaaaaattgcttgaacccaggaggcagaggttgcagtgagctgagatcacaccactgcactccagcctgagcctgggtgacagagcaagacttcatcttggggggaaaaacaaaacaaaacaaacaaacaaaaaaacacccaaagccctttatacttcttttttttatttaattttactttttttttgagacagggtctcattctctcacccaggctgggatgcagtggtgtgatcatggttcaatgcaactattacctcccaggtcagcctcctgagtaactgggactacaggcacataccaccaccctggctaatttttgtatttttttgtagagatggcacctcgctatgttgcccaggctggtttcaaactcctaggttcaagcaatccttctgcctcggcctcccaaagtgctgggattacaggtgtgagctgccgcatctggcctgttttattatttagagacagagtctcattattttatccaggctggagtgaatggtaattgacaggcatgattatagctcactgcaacctcgaactcctgggctcaagcaatcctccaacctcagcctcccaagtagctgggactacaggcatgcactatcatgtccagcccttttattcttcttaacaaggtctacccttgagggaaactattttaccagagcctaaccatcttgggttgtaccagaacttaagtgacttggggaaagagaactccagccacctcttgccttcctgcctcacctaaagaggacaaggggaggctgagaagctcttgtgaaggttcaggggcacaggctccccagaagactgagacctcatcacaggactgtagatcctccactccctcacctcaccactgcaccagcagggctcctgtatcattacaaggattataacaaaaagagtaacaagtcttaggccctatttaagaagtctctagagacccatagacagcaagggagataagaacaaggacaccagaagaaaatttagccttttatacctatagctacagcaaacagtaaacatagcctagataaacaaaacctcacccctcagttcctctcacagggtacatcatgtccagctttcagtgaaaaattacaaggcatactaaaaagaaaaaaaaaaaaaaacgcagtttgaagaaacaggccaagtatcagaatcagatttagatatgagattttagaattatcagaccaggaattttaaataactatggttaaaattaattaattaattaattacaacgatggttaatattctaaggactctgaagggaaaagtggacaacagacaagaacagacaaataacataagcagtgatggaaaatctttttttttttgagacggagtcttgctctgccaccaggctggagtacaatggcacgatctcggctcacttcaacctctgcctcccgtgttcaagtggttctcctgcctcagcctcccaagtagctgagactacaggcgtgcaccaccatgcccagctattttttgtatttttagtagagatggggtttcaccatgttagccaggatggtctcgatctcctgacctcgtgatccgcccacctcggcctcccaaagtgctgggattacaggcgtgagccaccacgtcc

SEQ ID NO: 11918 - DNA, 738 bp, Homo sapiens
gacacaaaaagcattaaagtattaagtaatggcaactggaactttaacaacacttctgtccttctgtagtctgttgatatagattggatgtgtgtcctctgcagatctcatgttggaatgtgatccccattgttggagctggggcctaatgggaagtattggttcatgggggcacatcccacataaatcgcttagtgacatccccttggtgataagtgagttccttctttgagttcatgcggggtctggttgtctaaaagagtatggcacctctccccagctctctcttgctccttctcaccatatatcatggtagttcccatttgccttccaccatgattgtaagtttcctaaggcctcaccaggaacaggtgccagcaccatgcttcctgcatagttgttcactcttattcttcagaatggctactgcaaatattgtccagatgtcaaagctccctactccactctgtgcccctcctacactcaacttgttaactctttgctcccgatgcaaactcacttgtcctttctgtcaccgtggatgtctctctcctcccagtgcagttaccctcctgtgatttggtttccatttcctttcctttcattaggaactttagatcattcattttaaactctcctctgtgtccttaagtttttccactagtcattggtatcgacattttaacatgctcaagtctcctctatttctccctccctccaaaaaaaaagaaaagaaaa

SEQ ID NO: 11919 - DNA, 738 bp, Homo sapiens
gacacaaaaagcattaaagtattaagtaatggcaactggaactttaacaacccttctgtccttctgtagtctgttgatatagattggatgtgtgtcctctgcagatctcatgttggaatgtgatccccattgttggagctggggcctaatgggaagtattggttcatgggggcacatcccacataaatcgcttagtgacatccccttggtgataagtgagttccttctttgagttcatgcggggtctggttgtctaaaagagtatggcacctctccccagctctctcttgctccttctcaccatatatcatggtagttcccatttgccttccaccatgattgtaagtttcctaaggcctcaccaggaacaggtgccagcaccatgcttcctgcatagttgttcactcttattcttcagaatggctactgcaaatattgtccagatgtcaaagctccctactccactctgtgcccctcctacactcaacttgttaactctttgctcccgatgcaaactcacttgtcctttctgtcaccgtggatgtctctctcctcccagtgcagttaccctcctgtgatttggtttccatttcctttcctttcattaggaactttagatcattcattttaaactctcctctgtgtccttaagtttttccactagtcattggtatcgacattttaacatgctcaagtctcctctatttctccctccctccaaaaaaaaagaaaagaaaa

SEQ ID NO: 11920 - DNA, 763 bp, Homo sapiens
taatttctggagtttcaggagctttatcctaaggtggctgtgataacctggattgttgtgtaaattgcacatttggggcttggcaagtggcagatgggagttctggctgttttattaccagtaactgggacatgggcttgggttcgaggaggccacgtggctcctgacacagccttaaggatctgaggtggcccctgccctgggcacctggggtgggaagggaggtgcagggaacagggagacttatttttcactgtgatcttttcgaaccatttgaatgtattataccttgtgtgttttattcaaaaatgggtagatttgttaaacaaaacctaaaaaaaatatgagcaggagtgacagaaaacagagaccactgagtctgagtccaggttggcccctcccggtgtaaccttgatgcaacattgagcaggcctgagctggggtgacctcactgacagctaggagaggaatgagactctcctctgggtcactcggtggtaggggtgagctggggtggcctcactgaccgctaggagaggaatgagactctcctccgggtcgcttggtggtaggggttcagtgggaatgggtttggggcctctgacatatctggctcaggaagccagggtaaatttcagccttaaaggagaaaggctcgtgtcagcccccacagtctgcaggggctgtccctcctgggctcctctccacccctggtgatgtgaccacttgggtctctcctctaggacaggcccggcccctcgag

SEQ ID NO: 11921 - DNA, 9799 bp, Homo sapiens
aaggcggctggggagaaggtgtattggacctgccgggaccaggcccgcatgggctgccgcagccgcgccatcacccagggccgacgggtgactgtcatgcgtggtcactgccacccgcccgacctgggaggcctggaggccctgaggcagcgggagaaacgccccaacacggcgcagcgggggagcccaggtacctgggggtgggctgggagctgggccccaggaagcaggcaggagccccacactgcctttccctctccatgctgcggctccccctggcaaacgtcctcttcccttctttgaacatcctagaaggaactatggccctggcctcctactccttggcccccctgatgccgctttcaatgggtctcaccttcctgctcagcccagcctcccccttccagcctgacctgccccacagtagcagcagcagggatagacctccctgccctcctcttcctccgtttgtcttaagagttcatagtagtaatagagggtgttgactgcacatggtcagtctcgttgctatggtggaaggctgtcttaacgtctgagtggttaaggattgaggaggtgatatttacttacatgcagccggtttctcctctcggcccgctgttccatagacacccataatgtcctgaaacgctggcccgaggagggtcccggctgtctccatctttatccacacggtcggccccccgcagtgcctggtgttttgacttcacaaccacagttgcgtaaatgtccccatagcgtctggctgaggagccatttcatcgtggcctcctccactcacctgctcttccttcacgccccaaggcgctggcctctctttccagtggctcttccggatcctgcagcttttgggtcatgtgagttgcctcatggccctaaagttctctcggacttgagagctgtgattgtctttctctttttgttccatctccagagagacagtgctgcgaggtccccgcctcgtcctcacccccgctcctgaccccacaagtaactaagcaattgtttcttagggtcttggctgccctatttcctaaaatgtgcctccactactattaattggtttttccatttccttgtcagctactcagtgcacttcttgcacaggcttttttttttttttttttctttgagacggagtcttgctttatcacccaggctggtgtgcagtggcgtgatcttggctcactgcaacctccgcctcccgggttcaagcaattctcctgcctcagcctcctgagtagctgggattacaggcgcctgccacctcgcccagctatttttgtatatttagcagagacagagttttaccatgttggccaggctggtctcaaactcccaacctcaggtgatctgcctgcctcggcctcccaaagtgctgggattacaggcgtgagccaccatacccggccacgtttggtttcactttagcctagaaacctgctcgcggctgactggggggtgctctgtggtcccatcttcctaacacagctctgtcttctctgtggggtggcagctgctgcgtttgtttgcctgcttttgtgtgtccaggtcgaccccacctggatccgatcatccacaaccgcaggttgctggaacctcccagtgcagcctggcctgggggcagaggccgggcccagctgtccctcggggttcactgtgctgactccctgcttctgggcctgcctttctctttcttggttttctttataattttgtggtttggagaagtcctgcctcccgtcgtttcctgggccggtcccgggaggtagcacgttgaggcctttcatgtctgaaatgtctgtcgcttccctccgccggaggggcagcctggcctccgtggtgtcacaggtgcagagcctgcccttgaacgtccctgccgcttttgcgtgactgatcctctgtgtgccgtcagctttgcttgaggttttagggtctttgctccctcccagctgtacctggctgtgctgggggcctttttaggctttgggcttgtgtccttcatcgtggggtcatcctctcgtgctctttgttaacttccccatcatcatccctttctgttgctcctgttaatcagatgttgatcctcccagatgagggcgtcttttttttttttttgagacagtttcactcttgtcgcccaggctggagtgtagtggcgtggtcttggctcactgcaacctctgtctcccaggttcaagtgattttcctgtctcagccttctgagtagctgggattacaggtgcacaccaccacgcccagctaattttttgtatttttttagtagagatggggtttcaccatgttggccaggctggtcttgaactcctgacctcgtgatccgcctgcctcggcctcccaaagtgctgggattacaggcgtgagccaccgtgcgcagccccttgctggatattttcatccgtgtggaaggggataaagcgtgccccatggtcacaccaccccctcccgtggcctggcgtccccaccttcgtcctgacctcttctgtctcgtggtccccaggctcctgtgctgctgtgcccctcagggtcctcctgcctcccgagcctccctgctccacatggcccctgcccagccctctccatccctcttgaaggtagttccacagccagacaccctcccgccccccgctggcctctcctctagggcttgctacccacccccatcccctgcttccactgccacccgatgtgtccacgatgccccaggccacctccccacctctgtggcccctgagcctgcacggaggaaagggtatcctctgggcaaggcacagccacccgccaggtcctccctctcaccacatccaggacagtggacgctgctccctgcctcttcctcagagtcctggggtcacacctctacctgcgcggctctcgggggccacccctctcagccccatccggctcctgagcagctttgtccccagagggccccgggtcattcctctgaccaaccaggcacggcgcaccctgcatgcaagcctgggcgggtgctggggacggacgagtgacgcagcagacactgcctccctgaaggcatggcaaggtgggacgcttggccgccacctgcaggggcctcacctgaccagtccccagcctcaggaggcggaccccagcagctggagccccagcagagttggggggatggtggcatctgtgtcctgggctccggggccacctcactgtgaggaggaggtgtgggcgttgtgggaggtctcatctcggggccatgctgatctgggctctgagagctggtgtccgctgctcctcccctcccatttctcaacaggaggccccgagttcctgaagacgcccctggggggcagcttcctggtgtacgagtccttcctctaccggcgggagaaggcggccggggagaaggtgtattggacctgccgggaccaggcccgcatgggctgccgcagccgcgccatcacccagggccggcgggtcatggtcatgcgcaggcactgccacccaccggacctgggcgccctggaggcctgcggcagcgggagcacttccccaacctggcgcagtgggacagcccaggtgcgtgtggagggtgctgggctgggtctgcctggtctcccaggacctgtgccccacacgctggctggaggctgcccgtggggtgttgtgtgttgtgcatggtggtctgacagccggggccataaactccccaggggcaggaggctccatctgcgggctccgagctcctgcagctggtcctctgggtagtggggactggctgtcggaggtagaaacccactcagctctctagaggaagaggatggtggccaggggtggcattggcagccacagagagtgcttggcatctgctgacgggccgtacggtggatcctggacactcttggtctacccccacgccacccacactgcttctagtctcacggggttctctctggccaccccaacatcatgtgaccttttagttcagcttgttaaaagtcagctgccagctggctgaggggtaggtggacagggagccaggaggccctggtgcccagcccagaaaggctcagcccctgccctgggggatgcacctgcaagcatgaggtctgaggggttgggagagtccttcaggagcattcagggtccagtgcttgccaggccacgtgcccagtcatccccagagcccttggaaagggccagccagcgtgggagtctgggctgcagggcccagaggggaggagggcagggaccaccgtgcagcgtgctaggggatcgcagattcctggtggggcctggctgggggatacaaatcagacccccagccctgccacccaggcccctgtggccccactcacagtgtcactttccctttcagatcctctccggcccctggagttcctgaggacttccctggggggcaggttcctggtgcacgagtccttcctctacaggaaggagaaggcggctggggagaaggtgtactggatgtgccgggaccaggctcggctgggctgccgcagccgcgccataacccagggccaccgcatcatggtcatgcgcagccactgccatcagcctgacctggcaggcctggaggccttgaggcaacgggagcggctccccaccacggcccagcaggaggacccaggtacaggcaggctgtggggcagaggcagggctgtgggcatcctcatctcttccagctcagaactgatgccccaggccaggcacccactgagcagactgcttttgtgcacacacaaattattcatataaacagaatgtgaaaccagtctttgtttttttttttttttttttttttgagactgagtcttgctctgttgcccaggctggagtgcactggcgcgatctcggctcactgcaagctccgcctcccgggttcacaccattctcctgcctcagcctcccgagtagctgggactacaggtgcctgccaccaagcccagctaattttttgtatttttagtagagacggggtttcaccatgttagccaggatggtcttgatcttctgacctcgtgatccgcctgtcttggcctcccaaagtgctaggattacaggcgtgagtcactgtgcccaaccttttttttttcttgagtcagagttttgctcttgttgcccaggctggagtgcaatggagccatcttggctcactgcaacctctgcctcctgggttcaagtgattctcctgcctcagcctcccgagtaactgggattacaggtgtgcaccaccacacccggccaaaaccaatctttagaaagcattgtgtgtctcactgtcattcatgtgaatattaagggccatgtcctgtataacagtaacaaatccaagttggccaggcacagtggctcacgcctgtaatcccagcactttgggaggctgaggcaggcggatcacctgaggtcaggagttcgagaccatcctgatcaacatggagaaaccccgtctctactaaaaatacaaaattagctggacatggtgacgcatgcctgtaatcccagctacgctgtaatcccagctgcttgggaggcaggagaatcacttgaacctgggaggcggaggttgcagtgagccaagatcgcgccactgccctccagcctgggcaacaagagtgaaactccatctcaaaaaaagagaagaaaagaaaacagcctggccaacatggtgaaaccttgaaagaaaacagcctggccaacatggtgaaaccctgtctctaaaaaaaaagtttataaatcagctgggcacagtggtgcacgcttgtggtctgagctcctcagaaaaggggaggatcactctagcccgggaggttgaggctgcagtgagccatgcactgcagtccagcctgggtgacagaacaagaccctgtctttacaagaaatttttttgagaaaaggatttctttgagaaagccactatcgagcttacagagaaagttgtgctggaggcctggcctttcatctttgatgtctagttgacccccactattttccatgacagcagctgaaggtcaactcttaggagctcaagtagctgctgttacctgggaaggtaattgatgcgttgaattcccagcgttgcttcacccggttgtctttctcctcacagccttgagggcgtcgttaacaaggtgtgtgtccttggttctgtcagcttcaacaagagaagaattattaattcatattttcaattatttttccacagaaaagattcaagttcagctgtgcttcaagacgtgttctcctgaaagccagcagatttatgggtaattgtatttgttatctaatggtgcatgaccaattacaacaaaacgtagtgggcttaaaacaacaaatatttgctgtctcagcttttgtgggtcaacattatgggagtggttgggctgggtggttctgactcctgaggttgaagagaatttgtcagccagggtggcagtcatctgaaggcccaagtgaggctggaggccctgctcctcaccatagggacccctccttgggcccacttgagcatccttcacatgacagccatgggacagagagagaacaagagggaagctgccagcagcagaattcaggttcttctcaaccacagccaggccataaagcaagagtccattattttattttttgagatggagtctgtgtgtggcccaggctggagtacagcggcatgatctcagctcactgcaaactctaccttccgggttcaagcaattctcctgtctcagccccctgagtagctgggattacaggcatgtaccaccacaccgagctgatttttgtatttgcagtagagatagggttttatcatggtggccaggctgagtctcaaacttctgacctcaaatgatcctcctgtctcgggtctcccgagtgctgggattacaggcaagagccactgtgcccagccttgttattggtttgtaattacatcccactatggtcaaagaacatactttgtatcatttcagtcctttcacggctggatacagtggctcatacctgtaattccagcactttgggaggccaaggcaggcagatcatttgtaattccagcactttgggaggccaaggcaggcagatcatttgaggtcaggagttcgagaccagcctggccaacatggtgaaaccccatctctactaaaaatacaaaaattagtcaggcatggtggtacatgcatgtaatccaagctattcgggaggcagaggttgcagtgagccaagattgtgccactgcactccagcctaggtgacaaacaaaaaccaaatcaaaaacagagaaatttgggaaactcagaaatacgtagaaattaaagaacacacttataagaaaccagtgagtcagactgggcatggtggctcacgcctgtaatctcaacactctgggaggcagaggcaggaggatcacttgagcccaggagtttgaaaccagttggggcaacagagcatgaccctgtgtgtaatttaaaacaaacaaaacaatgagccaaagaagataattataaaatactttgaaataaaacttatgggatgcactgaaagccgtgcttagagggaaatctatagctaaaaacacttctattaaaaaggaagaagcctgggcaacatggtgagacctcgtctctgccaaaaactcagccagtcatggtagcatgtgctggtagtatcgcttgaacctgggagattgaggctgcagtgaagcatgattgtaccactgcactccagcctgggagacagagcaagatcccatctctaaatgaataaacagggccaagcatggtggctcacacctgtaatcctagcattttgggtggctagggtgggaggatcgcttgagcccaggagttccatactagcatgggcaagacctcatctccacaaaaaatagaaaaactaaaaaaaaaagaactaaaagtctgggcgtggtggctcacacctgtaatcccagcacactgggagaccgagggaggtagatcacgagaccacgggttcaagaccagcctgaccaacatggtgaaaccccatctctactaaagatagaaaaattagccaggcgtggtggtgggagcctgtagcaggagaattgcttgaacccaggaggtggaggttgcagtgagtcgagattgcgccactgcactccagcctgggcgacagagcaagactcatctcaaaaaaaaaaaaaaaaaaaaaaaaaaaactgaagcagaaggaaggaaataaataataaatgaaaccaaaagttggttctgtataaggatcaataaaattgacaaatatttagctctatctacagatcaaaaaaattgaaaagcaagaatactgaaaatactaaaatcaggaataaagatgagaccttactatggacctcattctggcagagtctcattctgacacccaggctggagtgcagtggtgccatctcagctcacttgaacctcaccctcctgagtagctgggactacatgcacgcaccaccacgcctggctaatttttctatttttagtagaaacggggttttcccatgttgtccaggctggtctccaactcctgggctcaatcagtccacctgccttggcctcccaaagtgctggcattacaagcatgagccgcaatgcttggccccagctcattctctaagaccagtatcaccctgatatcaaaaccaagcaaaggaatcacaaagagaaaactacagaccagtatttcttaggaacgtagaataccagcaaacagaatccagcaacataaaaaaggattatataccatgaccaagtaagatttatcccaggaatgcatcaacatgcaaaaccaattaatgtaacacagcaggcctgagactgctgccctaagaacagcctgtgtgcaaggttcacccttggctggcatctgggaacttttttttttttttttttttttttgagacggagtctcactctgtcgcccaggctggagtgcagtggtgtgatcttggctcactgcaagatcactgtgagtgatcccaggtagctgggattagaagtgcgcaccaccacgctcagctaatttttgtatttttagtggagacggggtttcgctatgttggctaggctggtcacgaactcccgacctcaagtgatccacccgcctcggactcctaaagtgctgggattacaggcatgagccaccacgcccagctggcatctgggaacttgactggtaaagagctcctatgtggatacaatactatccccaaataacaactgctcactcttttctatacaaatcatgtgatatttgctgaacacttgcttttcttctgagcctggcatttcggtgaccatattcagtcacgcaggcacaacgtacctacatgagcaacccccagtgaaaaccctggactcctgggctcaggcaggcttccctggtagagaacactttgcacatgtcacagctcgaggctggaggattcagcacattctgcgggaggggaccccaggggaggggactctgggggcttgtacctggtttcctccggccctcaccccaaatgcatcttcctgttactaattctgcgtcgcatcttttcaccgtagtaaatcccagccactagtatgatggtaggctaagtcctgtgagtccctcaagtgcagtcaccaagcctagtgtgtgatggggatgcctgcataccagatcagtagagaaaaggacaaaaaccgtgtgatcactgaatagacacaaaacatttgacaacctccaacacgctttcatgataaaaacattcaac

SEQ ID NO: 11922 - DNA, 131 bp, Homo sapiens
gccaggcgtggtagcgggcgcctgtagtcccagctactcgggaggctgaggcaggagaatggcgtgaacccgggaggcggagcttgccgtgggccaagatcgtgccaccgcactccagcctgggcaaaaga

SEQ ID NO: 11923 - DNA, 1193 bp, Homo sapiens
cgaccactcacaggtgccagggctctgacatctcgccaggcatagctaaaggttatactcatctatccccttctgcttctgttacttttggtgtgtggaacaagacccatgggagctggtgcctttggctacttggccttgccttgtctggtttgcttgacatatctgttacctaccttatctagaaaccattctcagatgggatgataaattaagagaacttacactcacagaaactccaaaacaattccaactgggcttttcttcatgttgaatcataatatactgtaatgatttactaatgaaataccattttgtttatcaaattaaatgagcaaatttaaaatactgatagccaagtgtggtggctcatgcctgtaatccccagcactttgtgaaggtgaggcaggaggatcacttgagcccaggagttcgagaccagcctgggtgacatagtgagacaccatctctacaaaaaacataaaattagccaggtgtggtagcatgcaactacagtcccagctactcaggagactgaggtaggaggaccacttaagcctgggagatggaggctgcagtgaggtgtgatcatgccactgcactccagcccagtgaaagagcaagaccctgtctcacaaaaataaaataaaataattgatattaccctttatacatggttgttgaaatagggtggtgcccttttggaaaatcacttgacagtatatccagaaatgctgatatgttttcacacaaaaactttgttttactttcagaaatttatcctaaatcttggccagacgcagtggctcatgtctgtaatcccagaactttgggaggctgaggcaggcgaatctcttgaagccaggagttccagacaaatttagcccatgtggcaaaaacctgtctctactacaaatacaaaaattagccgggcatggtggtacatgcctgtaatctcagccactcgggaggctgaggcatgagaatcgcttgaacctgggaggcagaggtttcagtgagccaagatcacaccactgtacttcagactgggtgacagagtgagactctgtctcaaaaaaaaaaaatcttaaatctagaaaactgtagatgtgccaggcatggtggatcacgcctgtaatcccagcactttgggaagctgaggtgagtggatcatttgaggtcaggagctcaag

SEQ ID NO: 11924 - DNA, 196 bp, Homo sapiens
aaaccctgtctctactaaaaatacaaaaattagccgggcatggtggtgggctcctgcagtcccagctactcgggaggctgaggcaggagaatcacttgaacccgggaggcggaggttgcagtgggctgagatcacgccactgcactccagcctgggcaacagagtgagactccgtctcaaaaaaaaaaaaaaaaag

SEQ ID NO: 11925 - DNA, 149 bp, Homo sapiens
gcctgtaatcccagctacttgggaggctgaggcaggagaatcgcttgaacctgggaggcggaggttgccatgagccgagattgcgccattgcactccagcctgggcaacaagagcgaaactccatctcaaaaaaaaaaaaaaaaagaaa

SEQ ID NO: 11926 - DNA, 763 bp, Homo sapiens
aaaagtttcagttctggggatgattttgttcctattcttgataccaagcgataaaatcaggctgctaagagaaaatgaaaaggaaatagccagctagtgtcattgaatcatatcccgaggcagtgagtttcttccagcacattttggcctcagtcctgaggctggaccttaactagtgaactgcaaactcactcaattatgcagtctgcttggtgcgatggaagtgaaaatgtcctagagagttgggtgctagtatgcattttgatagtctcctagcctgtgacccaggacagattccttgcatgcataggagtttgtcaccatgcaaaatctggctgttgttcttctgagaacatgggggagctggactgtcaacaatgagccatatcaggctgaaactgggaaactgttctgctccttcagagtcaagacaagccagaatgagtgtcaaatttccttcctctgtgcttcctcagatgtggtcagattcatagccttcagtctattctaattggtagctagcctggtgtggacttttgaccacccaccaatcaaccaactcccaccctcaccatttactgcacgagtaaagccacgcttcctaggaactaccattggtagagatgttactgagtcataggccctgagataggaatgatctataaaggccatccacgccagttcttgaacccttctacaacagtccagactcatctttgcccaatctctcctctgacaatgaaagcctaaggaccaaaaaaaa

SEQ ID NO: 11927 - DNA, 778 bp, Homo sapiens
aaaagtttcagttctggggatgattttgttcctattcttgataccaagcgataaaatcaggctgctaagagaaaatgaaaaggaaatagccagctagtgtcattgaatcatatcccgaggcagtgagtttcttccagcacattttggcctcagtcctgaggctggaccttaactagtgaactgcaaactcactcaattatgcagtctgcttggtgcgatggaagtgaaaatgtcctagagagttgggtgctagtatgcattttgatagtctcctagcctgtgacccaggacagattccttgcatgcataggagtttgtcaccatgcaaaatctggctgttgttcttctgagaacatgggggagctggactgtcaacaatgagccatatcaggctgaaactgggaaactgttctgctccttcagagtcaagacaagccagaatgagtgtcaaatttccttcctctgtgcttcctcagatgtggtcagattcatagccttcagtctattctaattggtagctagcctggtgtggacttttgaccacccaccaatcaaccaactcccaccctcaccatttactgcacgagtaaagccacgcttcctaggaactaccattggtagagatgttactgagtcataggccctgagataggaatgatctataaaggccatccacgccagttcttgaacccttctacaacagtccagactcatctttgcccaatctctcctctgacaatgaaagcctaaggaccaaaaaaaaaaaaaaaaaaaaaaa

SEQ ID NO: 11928 - DNA, 101 bp, Homo sapiens
tttcttttttttttttgagatggaatctcactctgtcgcccaggctggagtgcagtggtgccatctcagctcactgcaacctccacctcctgggttcaagc

SEQ ID NO: 11929 - DNA, 1174 bp, Homo sapiens
cagaggctgattctctgtaatcctaccctccccttctccccatcagggcccttcttagcactctgggtggttgctccaaccatgcacctggaagcttgggcttgggttacaatgctctgtttatgtgtttgtctcccctgattgcctgccagtgattcttccttctcatatctcagcacttaacatagttcttgatatatattaggtgataaaaattgtctcttcttttagcactggagccatgagatacccctgagaagtggtgagcttgtggcgtgaagagctgggtgacctcctcttccttttggtggcctgagccagagatgtcacttcctcacctgctcttttctgctttcatgtctcaagctgcctgggggcttctttttttaggtctcttacactcgactaatctgcgaatgggccaagaacccacaatggggaaaggacagactcttcaatacgcaggttgggaaaacaaaatattcacctgcagaagaattaaattggagccttgtctcacatcttatataaaaatcaactgaaaatggattaaggactttaacataagatgtgaaactagaagaaaacataggggaaaagcttcttgacattggtctgggcaatgattttttttttttttaatatatgatcccaaagctcaagaaaaaaaaataggtgaatggggccaggcacggtggctcatgcctgtaatcccagcactttgggagaccaaggcgggcagatcacttgaggtcaggagttcaagaccagcctggccaacatggtgaaacctcgtctctactaaaaatacaaaaactagccaggcatggtggtgggcacctgcaatcccagctccttgggagcctgaggcagaagaatcacttgaacctgggaggcagaggtggcagtgagccaagatcgtaccactgcactcctgcctgggcaacagagtgagacttcgtctcaaataaataaataaataaataaataaaacaaaaatacaaaaattagccaggcatggtagtgcatgactgtaatcccagctattcggtaggctgaggtgggaggatcaactgagcccaggaggcagaggttgcagtgagccaagatcaagctattgtattccagcctgggtgacagagtgagacactgtctcaaaaacaaaacaaaaaac

SEQ ID NO: 11930 - DNA, 142 bp, Homo sapiens
agttcaggagttcgagaccaggctggccaacatgatgaaaccccatctctactaaaaatacaaaaagtagccgggtgtggtggcaggcacctgtaatcccagctactcaggaagctgaggcaggagaatcacttgaacccgg

SEQ ID NO: 11931 - DNA, 8876 bp, Homo sapiens
gcgatgggcggggcaggcgcgcggggattggcgggatgcggcgcgccgcgcggtgagtggggtccagggaaacggggtcagctgggggtggcagttccaggccgcgaggccgggctcctgggtcggtgggctggtgtcttggcggacgtcccgcagctgccgcgtggatccgagccggggcacccgccgtgactgggacagcccccagggcgctctcggccccatcccgagtagcgcggcctggctgctgccgccatcaagcacgttcgagccaaaagctcctaacgagtcactcgttagacacgtgtgcggagcctgtgtcccaggccagtgctgtcccgtggagatagattgcaagccgctagggaattttttaactttctagtaggtgtacgaaaaaagtaaaacgaaacaaatcaattggagtaaatccataaatatattcaaactattatttcaattgtatgtgaaaaaattattgggatattctttgtactattcttagaaatccattgtgtgtccaacccaaacatcacagttggactcaccacatctcctgtacttcgtagccctaggtggctagtggcataagacacaaaaatctcagctctcctggagcttatggtctagttggagcaggcagacaatacatttaaaatatacagtttgttagaaggtaaatgttgtaaacaacaataacagttgaagtactggggagagttgcagttgtaaatcagatgggcagggcacaaggtaacatttgagtaaagatgtaagaacttgaaggagatgggcaagtgagctctataagtatacgggagaggggcaagcaagagttcagaggccccttgctgtggggagggatccaaggtggaggagtgggaaccaggaggggagaggaccagtggagcagatctcataggcagttgtaaggacttggggccttattcaatgaaatgaggacactttggagagttttgaacagagcagtgactgatttatgttttggttttggtttagttctattattatttaataataggcttattatttcacagaagttttatttaataaggcagacctcttgtctggaaatgagacaggtgccggagagctggatggaggcagatcgggaattccatttggggcaaactgaacttgattgagaccctggtagttgtccagatggaacaggacacctgagtctagggttcgggaagaactccagatgggacaaacactcctagctttccttttctctttttggatgaccgctacagggtgagacatcggtatccaggcacgataaatttccaagtggacacaatgtctggtgtcaactacagctgttctccttcttttcccagtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggtaagtgagagtttgggaaggtgcttcccccacagcatccctgaacttagaagtgttctgcaagagaatgggaacagtttatctaattgatcccacttcctgttaccttgggaaaattaacctctttttccctcagtttcttcttaagatagtaacaaggattaaattaagtaatttgtgggtttggagttagttttagttcagaggctggttggagatgaggacttagttctggcggtgatggcgattacttcactggcagaggaaaatggttttcctatcttcagtgcagattattcaggtatttgcctgtgctgtagccagagagcccctcagtgtggcaagcctggcgccaggcaccaggagccaagactggtgaggatgcactctctggtctcgaggggaccccctctgttcactcatgtctgtttgcctctcctcctggcccccatatttgctggccatgaattttcctgtcccttgggccctctgtctttcctaataaagtggcctgcccaacacaacccttgttctttgcccccatttcttccctggtgatctctcctgcagttggattactcttggtggtgaagcagggacccccatctccccctttgagtttatttgagttttaggtgctgctgcattcccccattcctaccacttacataagagtggctttccaggtaattttcaaatccatctcctattatatttttaaactgaggatttagtaggtgagaccaggtcttactcatttttactgtccttggcaccaggcaaaatggatctcagccctagttgcacattggaatcccctggggagctttgagaagcccatctcatcccatgccaagccaagatcaattctcgttataggcaggcaggagaaccctgggcctagaaatctagctagaacctcaaattcattagggatatgtattagtccattttcacattgctataaaaaactacctgagatagggtaatttataaagaaaagaggtttaattgactcacagttcctcatggctggggaggcctcaggaaacttaacaatcatggcagaaggtgaagggaaagcaaggctcttttacatgatagcaggagagagagagcaaggggaactgccaaccatttttaaaccatcagatcgcatgatggcttgatctcactcaccatcacaagaacagcatgggggaaatccacccccacaatccagtcacctcccaccaggtccctccgtcaacaccgtgtggattataattccagatgagatgtgggtggggacacagagccaaatcatatcaggatgttttctgttttgtttacctgagacaaagtgctgttcacctctcctctcccacataatcaggggctccctcctgcggctccggtagcttttcctcactttcctttcagccctcgggacaccttccttggctcctttcagagctcagttactacttgggcccaatgtcaatgccaccttctagattctttccggcagcacctcctctggtcgcacatttctcttccagttattggagctgtcaaaaaagctccccagtgatggacgatagcgatttcactgtgctcacagactggtcaggaaaccaaacagctgccacagtgaatgtgttgatagcagcggggcagcagtagcactcgctcacaggcctggtggttggtgctggcccccaccctgaatacctacatgtggcttctccatgtggcctgtgcatcctcactgaagctcagcctgtctctccaaattggtctttccactcacctgttccccaaacctgcccagaccttcctgctgtaggcttttcccttcacttggcacactctttcccttgtcttcccatggccccatctaagccccactgtcagctgaagtgttatattctttgaggggccacctgaagccaccttgcaatgagggcctccgttttctacctcagctcaccatttgttcacagcacttgtcactgtggcgagttacttgtctatggcctgttgtcgttctcctgcctagacccagtgggctgagtgggggcaagtgttggcttttatgtccagttttgatcttggtgccagcacattgcctgggtggaagcatgtcctactatcggttacagggatgtcattctgcccagtgctcaggggcatacacttggatcccagttgtgtgcccttggacacattgcttaacctctctgtgcatcagttgggtgataatatctactcctggcacattttcagcgttggctgagttacatgtacagtgcttaggccacctgggggagagtaagagtgggatacgtgaggatgtggagtctgttgcatttctgtctgctgctggcatccttcttgtcttgttttgagttgctcgcctctgtctgctccctagggcgtagatttgaggaatattcctggttcttcccaggcagcaggggctcaggctgtgctggagtcagctaggctaaggggctggtctggcatccgcgttgtcctgtcacctccttggtgttttctccaggcctggatctgtgctgtgtgggcacctgtattcctccctcctgccctcactgattctccatacctttcttctcgagagtgccaagcccctcccatgtgttcttgttcatacctaggatcccgggaaggggctggggaagacggtgcccaggtgccctgggtaaacaaagccacctgactccacgggaatggaatgggtggaggggatctgaggtctgcattttgagtatctctggtctcagaggatgaagcatttggtgggggttgggggtggggggtagggtggaagaatctaaagtcttaaaagaaaatggcagttatttgtgggacagggctgtgttgagacttggcatgcttctttttaagagtcagtgttgtaatttaggtataagtgaagcagtactttgtattagtttcctgtaggcgctgtaacaaagcaccacaaactggttgacttaaaacaacagacatggccgggcacggtggctcacgactgtaatcccagcactttgggaggccgaggcgggcagatcacaaggtcaagagattgagaccatcctggctaacacggtgaaaccctgtctctactaaaaatacaaaaaaaaaaaaattagctgggcgtggtggcacacgcctgtagtcccagctactcgggaggctgaggcaggagaatggcgtgaacccgggaggcggagcttgcagtgagctgagatcgcgccactgcactccagcctggatgacagcgagactccgcctcaaaacaaaaacaaaaacagaaacaacaataacagaaaaacacagacatttactctctggcagttctggaggccagaagttgaaatccagatgtcagcaggattggctccttctgaaggcccgaggggagggtccttcctggcctcctccctggtgttcctgggcttgtggccgcatcactccgctctgcccgtcttcacactccctcttgtctgtgtgtctgtctctctgttctcatgaggacacttggcatccagggcccaaccacacccagagtccctggtctcctgtggctgactcactttttactgtcaccgtgaagtccagggggtccttgtacttgatgttctctcctggcaaggccagggccctgtgattggcctctcatggagtgctgggcagggcctccatggcctctgtcgggcgggggggctacttcatctctgagtctgtacccctcgtgtcccaggcagtggagtgggagtgaagaagctgtgtgaactgcagcctgaggagaagtgctgtgtggtgggcactctgttcaaggccatgccgctgcagccctccatcctgcgggaggtcagcgaggaggtgaggcagggtgctacacagtggggccgccaggcagacctggcctcccactagaacacctccctggaggtggggttgtggggaagcaggttcagagacaatggactccagaggggtgggggctgcggtgccagctcactaacaccagagctttggtgggctctggccccaagattatacctcctgtctctgcattccagcacaacctgctcccccagcctcctcggagtaaatacatacacccagatgacgagctggtcttggaagatgaactgcagcgtatcaaactaaaaggcaccattgacgtgtcaaagctggttacgggtagggagcccaatgagaggatgtgggtgatgcaggtgaagagcccagcggtggtgtgttagggatggtgtgagtggggagcctggggggagtgggggggtgtggcctgggcacacgtgtgttcttgaggaggtaggtgaggctccaggcggtcggaggccatcagattgggtgagacctggctgggagatgggtctccccacctccatccaagggcagtgactccaggaagcaggcatgcatcctggagtcctaggtgagaattcaccaatgtggttgtggagaactggcttgttttgcccgttggggtgactggaaggagtggtagcacctggggctccctgctcaggcctgatgccactgctccccagggactgtcctggctgtgtttggctccgtgagagacgacgggaagtttctggtggaggactattgctttgctgaccttgctccccagaagcccgcacccccacttgacacagataggtgagcagcagttctcgggagctggaaccagctcatggtcagtggaatctttgagttgcacctaggaggggctgcctcccttctcggcaccctggaggaccccaccttctcccgcaggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggtatggagcccacctggctgcattcagccccagcccaggagcctgcaagcctgtaagaccctccttccccagggcgagtagggtaccctgtgaggtctcgcaggtcggtgggaagcgccctgcagtgactctggggcctcctgcaatggggctcctcatgcccaggccctcgctgaggatggtgggaggcttgaagggagtgagggtctatgggacaacaactgcatcttccagctggtggggctctactctcctctgagcctgggactcgcctgggcctgatggccttctgggcttctattccaggccaaatacctcaccaagaaaacccaggcagccagcgtggaggctgttaagatgctggatgagatcctcctgcagctgagcgtgagcgagctgggggctggaggggtgatggggattgcagtcttcaaagctgccactgggcaacagaaggcaggcaggagggcagggggagtggccggagttggtgtagggggctccttcggggccctgtgagctctccctgccctgtgccttccaggcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcaggtagctggcacagccacacttcagtctgacccagccttttgcctcaggaggcacaaagaagggaggggagggagggcccaggaaggtggcagggctgcagaggcccacctagcatctgttccttctctctggggcatccccacaagagcgccagatgagctctgggctgaccactatgggtggcacccaaagccaagagtcagctgagctttgccttgcagatttttggggacatcaggacagaacgtgagtgacattttccgatacagcagcatggaggatcacttggagatcctggagtggaccctgcgggtccgtcacatcagccccacagcccctgacactctaggtaacaggctcagccatacagggtgggagcagagggccaggaggcctggcaggaccctgaagtgcacagggtccccctgtgggtttgcacttgccagcattgctgagaactgtctgaggagaagttcagaggcttggcacctgctctggaagctactctggaatcttaattctaaggccaatggctgcccaccccaacgggcagcaacagcagggccaaggtcttgtgacaatgtctggaggtgcccctattgtcacactgggggtctcctactggcctgcaatgggaggaggggctgcagccccacatcctgtgcagagtgctagtgctgaggcggaaccctcctcagagctgccccttctcctccaggttgttaccccttctacaaaactgacccgttcatcttcccagagtgcccgcatgtctacttttgtggcaacacccccagctttggctccaaaatcatccgaggtaatttttgtcttctgggggcccaggctgatttgctgatttgctctcacctggggacaaggttcacagagaagaaaacctgcattgtggagtccccctggcccttgtgggatggacagctgaggtcttctgcacagctgccatttcactgtgggagccaagctgcctcgccagctgggcagggactggaacggctcccagcctgtgtgcctctcaaggctaatctctggtctcctattgtcactgccccactgtgtgccaatggggactcctgtttatttctggcagcttctctttgaggcaggacttacttggaacctacagtgggtcctatgtgacttctttgcaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 11932 - DNA, 10211 bp, Homo sapiens
cagtccgtgccatgagcttgttttattggagtgaccttggctccctccctctgcccctactccaacactgcagcaaccccatctcttacgagactggcaggtggagcaggagcctctacacagcctctggctcttaggtcccagtcatgtttgcaccccctcaaaggggcaggaccagcccttcctttcagtgtccataccaggggccttccatgtgctgatgggtgatgtgactgtggtcagcaggcttgggaagtgctgctgctgtagcttgagttgggctggggtcttggtaggacgctgatctcagaagtccccaaagttcactgtgtaggtctctactgttgtgaaggggaatgcctggccagtggctatctcctcctctttctcctcctcctcctcttcctcaaactcgggttccagctgggtctcaaactcaggctccaactgggtctcaaactcgggctccaccttggtcccaaactcgggctccacctcggtcccaaactctgtcaccacctctgtgtaggtctcagtctccgactcctcccagccagcggtggttggcggtatgaggccccagggctctatggtagtgctcagggtggtggcaggggcagggggcagcgtgggaggcacagtgtgggggcctagggtggtggtggcgttgaggcgccgcagccgcatctgtgcccgaagccgcaggcggtgttgtaggcgtcgctgctgcaggcgtcgctgttggggggtcatagggcgcgatgggtctatgtgtgggataggccggttcccgttcatggccatgatctcccggatgcgcttccagttggagcgagccaggatgaagttgcactgagtggccccgatgtcatagtcaacattgcaggtcttggcgctcggggtgtagccctccgcgtgggctgtcacgcggtactcacccgggttcaagattcgccagtaatcaccaccactggctgcggagggagaacgatccggctgccccagagcgcccctcccaggcccccaccctcccactcagtcctgcccccagccccgccctccccctctgagttcccgcccccagcaccgccctccctctctgaatttcgcccccaggctccccagactctacctgctcgctgagttcctcaagcccccaccctctctggcgggtcctccctcagaaagatggggtaaaggtgtgcacactaggtacctgtcttcacgccgtgattaatgccactcacagagatggtggcgttggcaatggggatgccttgctcgtccgtcaccacccccttaatgccgcggtgcacctagggaagcaggtgagggctgctggtcctcaggaaggtccaatgtggtccgctgctccctcccgcccatccaggagcctgtgcagcctcctctccccaggcattgccctagccaccccacctgctccatgaaggtgagcagcgcctccttgttgttctcccactcgcggggcagctcactctcatgagggaacttgtcacagcccaggtagaaggagagctccaggcagttggtatgcaggtaactgaagtcattgatagctggccggggacagatacagacccaaagtcagcccctctccggaccaggccccgcccacagcccctcccaggctgactcactcccggtccgggggttccacttggccccgttgacgatgcccatgccgccggtgtagtcctgggcttggcagcctccgcggtagggctcggtcaaggtgaggtgtgcggaggcgaaggagatggcaagccaccggaagatggcgtggtctggagtctcctgggcctcggagacctcgtcctcatcctccccccgggctgctgccatggctgcggccagcagctgctcctgggtaggcgtgcgggccatatcgtaggggtaggatactagccgctcgccgccgttcagatttgctcccagcacgaaggggttcttctccatccaggcaatgatggcccggacctccgtggatacctggagtggccagcacgtgtgaggccagggctgcagctccggccactatccccaacctagcccgatcaccctccatgaagcttcacaccagtactcgcacgatcccctgtcccccaacccccagagcctcagcgtctggagttcaggcaccgtcagccccacccccaagcccagaacaccaggaccccagggtccagctgctccctcctgccctttcagccaggctgtagcctcaccgtggcatctggcgaaaggtagcgttcagggatgggcaagttattgttggggacccggtaggggacccatttcctctcctcagctccccagagcacagagttgagatccgggaaatcttcaaagatgtcaaagccctcctcagtccacagtcccagcgcccagttcccaaactctgagccctgtggggagccagcagggtaggcatcggctacccacacccccacaacccccagctgcctggaccctggccagcctcacccttcaacccaccatctgcgctgccacctcgtagccatcagggttcagtgagggcaccaggtggatgcgtgtgtcctgcaccaggctgcgcacacgtgggttcccatcgcggtactctcggcacaggtactgcatgagcagcagcaacagctctcggcccagcacctcgttgccatggatcccagcagtgtagcggaactcgggctcccctgcaagggcgggagcctcagtgagcactcagtctcccgaggcccagggcagctgaggaaggacccagacccacctcatacccgagggtctgggggacagctggggctcctagggccctgtaagacaagccagaatccccagagaggctccggaacaggcgggaggcagtgagctctgcacatcagcagcagaggccagctgctggcccccacagaccctcacccagttcatgctccccagggttgtctgagatctccatggcatagatcttgaggcctcgtgagctcttgcccaggctgtaagtgcgggtgatggtggggcactcctcgttcaccaccttcatgagctggggcagagggggaggacgtggaatcaatcatgcaatccgtcccccgctgaccatgccccttccacttccagggcctgctctatggcgagggacgggcatgaccccttcacgcagcccccaggtactggcctccttcctaaggtgagggacagccagcatccctggaaccagtagggactgggcccagtgacagaagcaccaggcacacactcccgtcagccacagacaggtcccacccccagccccaggatatatgctcccaacctggcgcatgtccttgtagctgtggtgccggaaatccaggtcatcggtggccaccacctcattctgtgcgtagtagctgtagacagctgcaagggaggcggggttgtctttagctgggtgccggctggcccaccctagcaccccacctccactcagagcccctgccagccctccacactcacgggccacagagcaccccagcacctccaggcgcatgcacaggctgccattccaggtgagtgggtagatgcggatgaaacgagccaccaccggctctgggagctcactcagcacgggtgtgtccttgtccacgttcccatgaaaggtctggggagaggcaggcctcagagcagtactgccagcccctctgagagcccacccctcgcccagacaatgggagcagagccaagagcctgggcatggtgcccaccatttcctcatagccgttggtgtacatcacccatgtctggctgtcattgctgaagcccacgaagaaggtggtcacaaaatcgtcactgtggagtggacagtggtcagagcaagggtcttccccctcccaggccctcaggtggcctgagcctccctcttccgagccccaagaatttaagagctagcagggtggtgctgcacggcccaggtgttgagcctgggtcctatgcccgtcacatagccatgggcaggtgatctgtccctaaactcatgtgctatcaggacacaggggctgactgaccaggctgaggagtggggatgggcagggtgagtccctcactgatctttttggccttctttggctgggccaaagaagggcccactggaatctccttaatgggacacagagccatgcctatgtagccactcccctctgccaactatccatgagcctggccacgcactggatgctggagtctctgccctgggtgatgacgcctgtgaaccgggtagtcctcctggtgtccacctctatccactgggtcctggcatcgtcctcggcacaccacgcaccatcatagtagtcgtcctcagtggcaccggtctgtccagggggcaggggaggctgagcatgggcggaggagtcccttatcccagttgggagatgggcccatcccaatgcccacctgcatgttgagccggccgcgctgtgcccccaggccgtggcgcagcatggaggaggctcggatctggttgtcctcaatacggtgtgactccatcccaatggggggacactctgaggacgcgtaccccagaatggtggctcactagctccatccttccctccaccaaacccagaaccaaggagcccagagcccactcccggcacatcgggggcacagtcagagggcagctctggtcagctggtggctccctggtgccctgcaccagcccacctggaatcgactcaaagccaggccaggagctgtttccaatcccagcctgtgcttcccctccctgggcctcagctgccccatctggagaacgggctgaccatgcccagctctcaggggacacacgtgaaatcacaggtagagctcccccagggcgcagccacagatgtcatccagatggggaccgtctgcacaatggccctgcagggatacctgtgaaggtacctgaggtcctcactccccaccaaggccccaggtcctccccctaccacgcccagccactaggggccctggggagctgccaccctcctgaagcaggccagcctggggtccagggctggggcagccaagcgaggctatcctgggctcccggggcccctcccttctgggtcccaagaatctgagtaggaaagggttccggggacctgggtcctgtttgtgacattgggccagtcacttgtcccagcacccccatcctgtggcccccaccctcacccccttgtgccccccacttactgactttctccgtaggcgtccactcctcctccaactcctcgccctttcggggctctagggacaatgaagggaggacatggcaccaagggcccgggaggcaatcaggagtccagatgctgccccacagggacccaggccccaagccccagccacacacctttgtggtccttgcccttctccactgcccacttgtcggtctcctccttggggctgctgtcctcctttttgggtttctctggaaggtgcaaggtaggaggggccagtcagcctggctctgggctttgaggaccatgtggggtggatcaggcaggccccaggtggccttcagggcaggcctggtgtgggaagtccttggtcccactcactcagctcctccttctcttcgtctgtctggcgctcagcatcgggcttctggggcggaggaggcccaaagtaatagtccactatggggagggagagccagctgaggctgccctgaccctgctgcggggcctcagctcctgggtccacaggagctcagcaggacaggaccgcgccagaggggaggaggacgggagatgggggacagctgagttgggagagggtcttgcaggagtcaggagcagcccgagctcaggggcagctgagcaagaccctgctgaagtcaccagcccggccttccaggagcatctggcctggggaaaggactcgaggcccagggcatgggaaaggcctggagggacaactggcacctgtgcctggggttgcgggctggggggtgagatggggagacattggaggcactgatggggacctgggggcagggaaatggcgatgcacgggctgccacccaggaggaaagggaacctgagggctccagggacgcaggggcatgagcaacagggaggcaaaagccctcgggctccctgaagagagtggggcagtggccacgagccagcgggaagccagttagagcacaggactgggagggctggaacccacatgggtgacagggcagagtgtgtgcctagggacacccctgtgggggtcacagccaagcaggaaccagggaagcggccaaggaaagaccagcctgagggcagaggagacagggcagtggctggggtgggcacgcagggacagcagggacagcgaggtaaccacgggcacaggtggggttgcaaggtgggtgagttgccccagctggctcctgaccacaccccagccccgacccccacctgcctatgtccctcagactctggggtgctgggtactcactgtcatcgtagttggggatcacgtaaccatcaccatagtcagggggcagcgggggcagcagaggcttcacaggaggctctggggaggcggggaggttaggagggggccagagcgccgtggccatggcacctcctctcctgccccccatcctaccaatcctctcctccggggctggggccggggccttctcctcagggggctctggccagacccgctcgggcctcctccttctgcttgggggtggcctgggttgcttctggcgccgaatgtactcaactgagggggaggctggctcagagtggggcccaaggctgggatgggcccattggcacatcccccaggccaggggtccgacccaggtggggctggcaggaccctactcacagtcctcatagtcctccctctcgatctggtcattgtagtccagtgtgggttgctcggtctcctcctccggctctgaggggaaagcgctggtagctgcctgacaaccccacccaggcctactctggggaagccctcagtccaaccagccagggcagctggccccaaggccaggcggatgacggccactcaccaggctggtgctcccgtgcctccacatgggtctcctctcctggattctgccagttatttgagaggggcgcccctgcaacacaggagttccagaagcaggtgggcgggaggcctgctctgaccaccttgggagcctcaggccaccagccacccatagagcccacacagagcctgtggacaccctcctgaggccgagctcactccaaggaggcctgagctcctctggccttcagcatcctgctggcatctcatggggccagagagctgggcccaccttctggggaacctactgtgctgctggaggccctaccacaaagctgtccccagcgggagaaggcaggagggaactccatgggctcagagcccagggacatctgggcaggggcctgagggacagaggtcccacccaaaaggctgccaagccctctccctacccaaaagaggctacagcactgagggagcccaccaatcaaattgtgaaatttatagcaaaagtgaggttcccatccagtggggagctgaaggtctataggaagcagggccccagaaacctgcctcccactccctgcctccacccgagcaggcagtcagagccccatcaccccagaggagcccggcacaaacctccctcctggggtagctcctcggggccagggctggggggtgggggcagtggccactccagggtttctgagggagccagaatggggggcctcttccctgacgggggcttcttggtggccttgggtggcttctctttgggcttcttggtggccttgggtggcttctccttgggcttcttggtggccttaggtggcttctccttgggcttcttggtggccttgggtggcttctccttccccttcttgggcggcctgggggacccctccaaggactccttgggcaccttggggcctttgtctttcttgcctttcttccctttgtctttggtcttttccggaggcactgtccaagatgcagactcgtgtcaaatgaacagagccagctctgtgcccccatgaggcccctctctagatgcccagaacctgggcacagggactcttgtcagttcccagtgcggatcagcaaactgagaggttaagtcatttgcccaagtggcaaactgggatccggacccagattttctgtctgcaagtctggggctgtgaccaccaatctcaacctctctaaagactgagcgtagggttcccagttcccagggggaggccctcatccccccacctgccaaaacctcaataggggttccttactatccactcctccactattctgttctgggcacagaaggggcagagaggtgactgagccatccaggcctggaggagcatctggtcatccctgccaactgccatacaaaggaagggacatgggcccaagaccttcccctggtctcctacggggcaagaaaagcttcaaagaaaagggacacttggttgagtattgaagcccaaagaagaggaagtggtctcctttcgagaagtaaggggtttggaattgattggaaggatagggagtcctggggggttcagggatcacacagaggacagaaaagacaggtagggagcttgtggctgcacactcatttcagagtctgggagagggagcagggactggttgtgaggattccccatgggaatcctcccaggaccctaagcaggagctgcaagtgctgttgagaacctgatgagaggtggggagcatgagggaagtttggcagaaacacaggaaagctaccaaatgcagacagccaggggacgcagggctgctagagcggtgccccagagccaggagagcaagcctggaaggagagccagaggcaggaggggcacaggcagcccagggtgtgggaagcagccaggaaagatctagagctggggtggcaggggaggggctgctgacatcaggaatgttggatggtgccttggaatctcctgggagacagggatcacaagaccctctgccaccttccagagggccacgatgaaaacagctaagatttactgacaactgattatgcaagaggccgtgggttaaatgcttcagtgatgcatcacctcatctaatttcctgtactaatgtaggaccacccattgctcaccaccacctgaagccctgtgctcaccaccacctgaaactctctcacctacgtgagacctcctggagtaggagggcaaaggcaggagggagggacgacgtgaagctgtgccaccaacagggagagtggtcccattagtatggcagggggtgacacagcacagtcccctgtggctcaagcctagtacctgtcgcgtactggaggaatggggataagcgacccgtacaaccacagcaccaaccctagagccaccggcccccaaaagcggccctgccgcccgggtgctggatgtgcctccacgccagcgctgacctcggcctagcacagggtccctccaggcatctgggctcgcgtgcgcattagtaagccagccattcctcccctagcagactggggagtggccagaccctaccgaatccccctgttcccacctgagatgccagccccccacacccccgccctgccctgggctcttaccttctgcggccgtccctggccgcttccctggcttgccccccgcctgggcttttcggacccgcggggtgggctcgggaggcggcggggcctccacgtcgtcctcccggggctcaggttctagctctgacaggaagccctcgaggaactcctcgatctcgtcgtcggtcagcaccgtctgcgggcgccctccagggcacagggccagcaacgccaggaggcagctgagcaggggcgccccgcgcacggccgccatggccgcggcacgcgcggggggctccggggagggcgcggggggtcaggggctctgggtctctgggaaagggcggagaggggatcgagacgggtgagggaatccaggaaggggcgggagagaggatggggtgagcgagggaatccgggaaagggagggagagtggattagggtgggcgaggggacccgggaaggggtgctggggggctccgaagccagaggggctcaggggtggtcggggcgctccgaggtctggcggctaataggcgctccggccccgcgtggcgcactcccgcgcggatagccgtctcc

SEQ ID NO: 11933 - DNA, 1314 bp, Homo sapiens
caaccattagacattgaagtgatgaatcgttatccgtgctgcacttagaccgaggctatccagtagcttatttatggtggcagtgtatctcaccaaaacactatgctttccagcttccctttcagcgacccatgttctttcattgcttctggtcagtgaaatctaagcaagtattttttgggtgagtcttccaggaaagtgtttagggggtgtggttaatttttgttctgccaggaaaatgagtgggatagctggaatcatgatagtcatggcatctctgttaatgtttttggtgcctttgaacagaataggaagaatcccccatctttgcagatgagttagaaaatttcctcctctgggtagaaggaatccctcagaatacacagcccccactcacttcttggtcaggtgtcttcacagtaaataaactacacaactgtatggggtggcctggacagccatattggactatgaagcaggaaaggaagccatgctctaaagatagcaaacccaaggagaaaagcagcctggtccttgctgaccatggatgtgccatatcagccctgcattgactacttccagacttcctttatgtgagagaaaaataacatttattttgttactgttatttctgatttattttactagcagctaattgcttgtaaagttaagactacatgatatgatttgagaattgctatcattaattaattaagcaattgttccttgtgaattctgtatcagaaattctatgatgtactagagataaagacagaatttgcaatctaggatgtgaaagacagatgtgtacacatacaggtaattatagcataatgtcatatgcttgttcagtttgcatgctggatagagacatctaggcaaaaggttagtggggactgtgctttgatagactgcatgcacccagagggaaacatatcctaattcatctccacaaacggggtacctctttttaaaaatgcttcaaccaataataatgctttattatcatttagttcagtgattaccaaacttattttagcagccattagccttctttgaaagaataataatacagaaacacaacttattagttcagatgttttggagagatctaactcagattagatctaaaagagaatttgctggttaatttaaccacacttactgtaagagagttgggcacagcctgttaagggagtacatagcagggtttttagaaaaagcttcacagaggaagtgatgcttgaggtgaatcttgaaggatgattttaagaaaaggacaaaatgggaaacagcatactatgctgaggaaag

SEQ ID NO: 11934 - DNA, 1316 bp, Homo sapiens
caaccattagacattgaagtgatgaatcgttatccgtgctgcacttagaccgaggctatccagtagcttatttatggtggcagtgtatctcaccaaaacactatgctttccagcttccctttcagcgacccatgttctttcattgcttctggtcagtgaaatctaagcaagtattttttgggtgagtcttccaggaaagtgtttaggggtgtggttaatttttgttctgccaggaaaatgagtgggatagctggaatcatgatagtcatggcatctctgttaatgtttttggtgcctttgaacagaataggaagaatcccccatctttgcagatgagttagaaaatttcctcctctgggtagaaggaatccctcagaatacacagcccccactcacttcttggtcaggtgtcttcacagtaaataaactacacaactgtatggggtggcctggacagccatattggactatgaagcaggaaaggaagccatgctctaaagatagcaaacccaaggagaaaagcagcctggtccttgctgaccatggatgtgccatatcagccctgcattgactacttccagacttcctttatgtgagagaaaaataacatttattttgttactgttatttctgatttattttactagcagctaattgcttgtaaagttaagactacatgatatgatttgagaattgctatcattaattaattaagcaattgttccttgtgaattctgtatcagaaattctatgatgtactagagataaagacagaatttgcaatctaggatgtgaaagacagatgtgtacacatacaggtaattatagcataatgtcatatgcttgttcagtttgcatgctggatagagacatctaggcaaaaggttagtggggactgtgctttgatagactgcatgcacccagagggaaacatatcctaattcatctccacaaacggggtacctctttttaaaaatgcttcaaccaataataatgctttattatcatttagttcagtgattaccaaacttattttagcagccattagccttctttgaaagaataataatacagaaacacaacttattagttcagatgtttttttgagagatctaactcagattagatctaaaagagaatttgctaggttaatttaaccacacttactgtaagagagttgggcacagcctgttaagggagtacatagcagggtttttagaaaaagcttcacagaggaagtgatgcttgaggtgaatcttgaaggatgattttaagaaaaggacaaaatgggaaacagcatactatgctgaggaaag

SEQ ID NO: 11935 - DNA, 1503 bp, Homo sapiens
ctccacttgaatttgcttagggacctcttcctccatttgactaaactcccagtgccgtgcaatggggtcacttcttgtctttccacggtcatcctatgcactccttcacctcatcggagtctgattccttatctcatgctcagccttgtggcgggcacgtgacaagcatcacctcctgaatttctcatggcaccggcgcaaggtacaggctcttgacaaccctgtgttatgtgtcaggaaactgaaattgaaatgaattatccatggctaaatgcattatccatggctaccagcagggaaatggaaaatatttgaaccccagaactgttgatcgagaattctttcaagttttatatttggcctcttctccttaatttagatattcagtcctatttccctgatgcctacaatgtgccaaagtcgcttatacttctttgcctttcgagttgctgttttcttgtctcaaaacatcctactcttgagttctttgtgcggttaatattttgtcatcctttagttctcagctgaagtgtcatattctcaggtaggaattttctacccacttttccataagcagaatatccttagtttctgtctgctttcacagagtgcttactgcctatttttaaatttactacactctataattatgttactgatctggttactgtcacctgatataattatttaatgtgcctggcttagtgtatgtagttgtgcagtaaatattcattgaatgaataaacgttaaaggttatgaaactgtgacgtaaaaatcttatgaataaaaaatggaagatgggaaaagtcagaaacagcttcattacatgtgtaaaacacaaaccaattatgtccaaagaaaagcaaatattatttccacagaattaataatttaatattatgtgaagtcggggtcattgaatacttgtaaattggcaattgattctcgatatattcctttaaagttataatcttcttgaagtttaagggaagaaaggtgctatgagagggcacaatggatgttgaataataaatttttaaaaacactttattcttagaagtttcactttggtttatcttccttagttaaatttcctttgtagcaaatgtgtgtacccttgatcacactgaagaaaatttggatgttgacagcacatggaagcattgttttcagatatcttcaacttagcaacttttggatgtcaggctccaaaaacatcacaggagggaaaataccctgactttattgtttgatgaaaatttgtggattgtgcaattattttgggtttgtatgatttgcttttatttactttatatattacatacagtataaaatgtacactttatctactttttataagtcacaattttatgggttttgctttacttatagcgttttcctcaagcaattcttcagatactgagcatcagaaaccaagtatttggaaactgagaaatgtgagctgaacagctgagtgaatcagacagggccctaatgaaaac

SEQ ID NO: 11936 - DNA, 659 bp, Homo sapiens
acaaaatgattatgcctttatgtgttgtgtgtatcgtactaaacccagtgctgtgcatagaggaaattttacagtctatagtgttacataagtactggggccttgcataaagtagatatctggtaattatttgttgactactccatgtctagtcaaatggcactttaattttatgttttggaacagttcagtattaaggattagtaataggaaaaagacttaacattttaattctgtgaatttaagtcattgtcttctgaagatggagtactttaaaagctccaaggagttatctggaaaaaaaatgtaagcagctttccatcaaaagacattatggttaaggtttgtactgtaggcctggtgtggtggctcacgcctgtaatcccagcacattgggagactgagtcgggtggatcacgaggtcaggagatcgagaccatcctggacaacatggtgaaaccccgtctctactaaaaataacagaaatttgttgaatgtggtggtgtgtgcctatagtctcagctactcaggaggctgaggcaggagaattgcttgaatccaggaggtggaggctgcagtgagccaagatggcgccactgcactctagcctgggcgacagagtgagactctgtcccaaaaaaaaaaaaaaaaaaaatttg

SEQ ID NO: 11937 - DNA, 300 bp, Homo sapiens
tagctcatgcctgcattaccagcactttaggaggctgaggcaagaggattgcttgaggccaggagtttgagaccagcttgggcaaatacagggactctgtctctacaaataaaattatttagccaggcatggtggtgcacacctgtagtcctagctatttgggaggctgaggcaggactcaactccttgagcccaggaggttacagaaagctatcattgtgccaatgtactccagccagcctgggtgaaaaagtgaaacacctttctttaaaaaaaaaaaaagaaaagaaaaaaaagaaa

SEQ ID NO: 11938 - DNA, 167 bp, Homo sapiens
aaagaataagaaaaggataatctgatattgctggcagtctgcactcttgcctttctgggccaagacatgcttttccaaataaaatcaaggaaatagtaaaccactagtaaaaatgaataaagcatccaagagtttgcctcctgtcatgtcctgttttctcctttttg

SEQ ID NO: 11939 - DNA, 687 bp, Homo sapiens
agccgaggcctgaattgtgcaaagagtcaaacaggaatgcaatcattcaaaataaaacagtgtagaagtacatttgaatgaaacattatgggaataacaccgaaaaaatacaaatattttcttgagtctcatgtcttttggctcgtgacctgcggcatcagctggccaaagaggtcaatcactggcatgtcaatcacgcaggcctctggccatggtaacagcagtctgtcagccagtcctcactgctcctgtctttgctctcctgctgccagctgtggcccgaagcccgtctgtcggagcagccttggagccagggaaaaggaaccgtagggtgaagagaggctgtggggtgccatttatgtagaaactgggcgcctgacttggctcttttcccaagctgtccacctaaaaaatgctatgtcgaatatcaccaatgatcagaaataacagggcagacttcgactctaaactaaagcttgcagaaagtttgatgtatgtgtgtgactatgctatggatataaagcctgttatcattttgaaaagggggaactttgtaaggtaagtaactttccaaataagtgattaaaatgttgataagcttttgacacatgtggaataattttttgatagatagttggcctgaatttcccttatttttcttgggaaaaacaaagcggattactggag

SEQ ID NO: 11940 - DNA, 15462 bp, Homo sapiens
cgtagtttgcgaagccccccatgacagctgggtccacgatgccgttcaggagcatggagagcgggttgatgggcaggctggggtcatccaggtgctgctgcaccatgctgttgatcttgtcgttcgtcagctgcatggtctcaatggcattctccagggggctgatttccacctgcaaagagagaggagagcccgatgtcagccccacagctgcctccactcccagggtctcaccagaggagccacgtgctctggggcaggcttcctgctcctccgtgaacctttcttccaaacagaatttttgggtggctgggcattttattattattgtttgttcccagagatgaaaattccaaaggaacaaagcaaagctgctgctcagctctgggggcggggctgtgtgtgtgcatgtggctatgcacatatgtggtcatcccaggaaaacacgcagccttgagtgcttgaatacacctgcttcagaacagacacttccaatcctgttcttgttctctgcttgttgtgctgagggagaagatgttcgggaattttgaggaatctaagcccgggcagcctgcactacctgtccggttagggagggcaaaggaggtcaaggcagggctccgccatggcaccacacaccatcatgtgaaggaagagtgatgggcaggcgtggtggctcctgcctgcaatcctagcactttgggaggctgaggtgggcgggtcacctgaggtcaggagttcaagaccagcctggccaacatagcaaaaccttgtctctactaaaaacacaaaaattagccaggtgtggtggtgcatgcctgtaatcccagctactcgggaggctaaggcaggataattacttgaacccaggaggcaggggttgcagtgagccgagattgagccactgtattcaggctgggcaacagagtgagactccaaaaaacaaacaaacaacaacaaagagagctcatggcccctggggtcgggaggaaaaggctgcttggagcactccaggccaccctcacaggcttcatttgcacacttgccatggttaatgacaccttcagtgcaggaggtaggggactgaccactgtcctcctggctccagtgcgtgtctctcagggacctccaccctctttctctgagggccccacagggcctggcctggccgagtcccagcccagtgccctccagctcagccctaaggtgccagggcaacgtggctgggtctaaggcagggaccacagctgccctgaggtcttgcttgagcagaccaaacctcctcctcacactgggccacggggaccatgtcccagggtgacctcagcaataactttgctccttccaaaggaagcgtgatgggcccccacccatgcccaagagcccttggtatcttcatgtccggctttcttcctgctacagcctctagcggactgcctgggagctgggggtggggcagggcagagatgaacagcgaatgggcgattctgtccgtcagcaaccctagactggcactcctaggtggctgtggacataacagaggttgtctgcccactgatgtcactgtccttgcactgatggagggacagccttggggagattgtgatgcactggtgtggccagccacgtgcaccctgctgagagggccccttgtccggtgtcctggacagcaggcatagccatgctgtcctgaccccacaacttactttgccaggccctacgacatttcatcccgggcacacagcttcaacaaatgcacactccagggcagtattccaccaggactgactgttacctccctgttactaatctcatttgcactgagaaagaatcccttcctatttttattgaagaaggttagctgctgctcccacagatatcccacgggggttggtcccaggtggcacgaggagggcatcagggtttggtagcaggacgtgagtcctgccattctgggattatttgccttcctgccctcttagtctgttcaaaatggccaaagcagcccgaggagaagctgcatcctcacgaaaggtcagggctcccctctccacctccctaagctcctgcatccggcagctgttggctggcaggccccgattacaaagggctcatgggcagagggtgattaagaggatcacggcctgtttaggtggagggcctgctcttctgttgtctctcacatgtacaatgcctcactagctacaaagggacccagcaaagggagtgcatttttaccacctgacacataactcccacagccttctatctgtcaggcactgcctggctgctaggggcacagaaagggaactccagagcagaaagtgaccccaggaggggtaggtgaagagccctgggtgctttgagtataaagcagtggctctgactgcgggcaacctctcagagagtggcccatagctgcccatagctcatgctggtgtgggcaaaggagaaggctcggcgctggacacgcagctgggcagagagatgccggcccctagagacaaataatcaggtgtttcggggggactcattgaaaactaaatggcaagtgccaccccctcagtgagttcttgccaggtgaaaacaaaaggcactgagacacatgaacaaaaacgtacagatttcaatcagatgtttttatattgccagttgccttggccctgacatttcaatactgtcaataaatctgcagcccaactctggttcatgtaaatgaaactgtccaatagctcactgcaaatgtgagtttcacgtaaatgaaactgccccatctcaaagcaaagtttagctttgttgagagctggaaatcgttatttctttaaaaagggtcagggaggggtatgttctcaggctatttttacttgaaatgggcaaggactattaattaatagttgtttgtcatgtaaatggcaataaaaccatcaggaaaaaaatctttaaaaaagtttatgtagactggaatttgtcttcaacttttcacttggttaacacaaagcattgtcaaaacagcacagctatgactgaatttaaatacattgtaagaagaaatgaaatcttcattctggttttttgataagctagagttggtcgtgattacacagcatttccactaaaatatggctaggcgaggagatatcgatgctctcaagaacaggtggggtggttatgggaactgtagagtctgctgtgtgcacgctgccacagtgaccacggggcatgagcaggtgaagaaggcgtggcagactgtattgaggaagggaacggacaattccttctggggtggggccatccttaccatgaaaacagacttgacctcaaaccaccttaaaattccaggtaatttatatgcagttgtatatatggttctctcgatccacatattctgcaaaggaaacacacacacacaacacgggttagaaggatgtcagcaggtggacagctctgccctaagggggatttatagaataactccaaaggagtcaggtccttcagcaggacagggtctgtggtgctcagcacagggcatgtgtgccttcaggtagcacctcacaagccacgctctacctaacggtcgctcaggatacatcaaagtatcccctgtcccctagccaacattgcccaccactctggtatttgacaatgaaagtatactaggtgagtgagaaagatgtgtatactccaaaatgaggtatggggagcccctcttgagcaaacagattttgaggaaggctccaaagaagtcttacattagctacagtgttcataagaaactaaaaggggcaaatacatctttgggagactggatttaatcaaagtgacctctgatgttctgataaaaccagtcggtattttaaactttaaaatgttttgacgtaactaatatatgtttatatgagaacataaagatatggaaagagcaggaggaaaaaccatcccctacctgaagctgataacctatatgctttagtatctattgttcaagacttcttactaagtattaaaaagtgtgtctatgcatattttaaataaaaacatcatttgacaatgtgttctttgtaaaacagtatattacctattgcaggaaactgttctaacccaataaatacaattctactactctttaaggattgcacaaaaactccaatgcaggggtcaactggaaatcctttatcctactgcctcgttcgtactgtctagcttgcaacaatcttctgccattccaacctccctgcactgcagggtcactgagcagtctgagtgtcaacaggaatctagacttaagcagatgggataatggaatgccagtcattccagaaaactgggacaagcgtggggggctcacgtctgtaatcccagcactttgggaggccagggcgggcagattgcctgagctcaggacttcgagaccaggccgggcaacgtggcaaaatcccgtctctactaaaaatacaaaaattagccagatgtggtggcatgtgcctatagtctcagctactcaggaggctgaggcatgagaatcgcttgaactcgggaggcggaggttgcagggagctgacattacaccactgcacttcagcctaggcaacagagcaagactctctctcaaaaaaaaaaaattttcagaaaactgacttggatcttggaaagcatttatcccaaacttcttacgttccataggaggaaagggaaggagctggctgaagccataaggacacaggcaaggcctccgtgtcccacaccagtcctctttgccccatggggacggctccctcaggtttttgtcctggcaatggaaacaggtctggccctctcacatccacctctagaccagattccagtgctttctctcatgtcaacatgccctgagacggacctctgggttccatcctgggctttacggccagctcctcctcacgcaggccctgtctcatcttcctcctcgtcagtgccctcactccccagcacatcagtcaccccttgccaggtctgcagggatgagccacctcgcactgctctcggcctggtgggcagcttccccagccccctgcacttggagccaggctccccgctggaggggccgaggctggcttcccagtagagcaaaagacgttgcacttatctaaggctttgtggggcatgtgaaggaccaaatcctgcagcttccgaacactttgtccaagtgcccggacctcaacagggccattaggggatttcagggccatttagaagaagcatagcctctgaggctcagcatagctcaaaatgtcaagagccttcgttattcttagctctgcacccaactggccgcgcaccctccagtggctcacttgacctccttgtgtctatttctttatagtctaagaatatatctacttgccagatgggagaggtgtgagggaaattcaagaactgcctataaatcccacagttgagggactccatataaacactagcgttagtgcttatgatgacagtaacaggtgcagtctgctctgaaagccactgcccttagcgagggtgtccaggttggacgtgcctaggttctgcccgcactgttgcagacaatggacactgtagtgaccagtcctggaggaggtccagggtgctgggttcaccaacaaatagggtgaacataatcttcaaacaaccagcctgctgggactgcacaatactgcagatttcaccaactccaagctcctttgtgctccttggtgacacacaaggaatctggcctcggggctggaaggaacttccccatggctcttaagagctgagctaggagactcacaggtactgccctgaggatcccatgactggcagacccctgagggattgggagggagactgggtagccaccactctttacttgaggcaaccctgctggaagggttccgagctttgctctggtcaggagtagggtgttaattcacctttgacctttgcagcctagatgccttcggacggcacacaagagaagccattctcagcagagccggtcctccttgggggtccccgggctaatgcctccttgcaatacaggagtacagaaggatttccggaggtttcccaggcaagacggataaacattaacattttaaaaaaattatggcttatttgatgccttttcaacatggatccactcacttgagcccaggagttcaagaccagcctgagcaacatagaccccacctctatataaaaaaataaataaaataaaaatacaaatgaatccatgaaagcagtttgtatgtagaatttttaaaaggctctagggccaggcgcggtggctcacgcctgtaatcccagcactttgggaggctgaggcggggggatcacgaggtcaggagatcgagaccattctggctaacaccgtgaaaccccgtctctactaaaaatacaaaaaattagccgggcgtagtggcgggcacctgtagtcccagctacttgggagggtgaggcaggagaatggcgtgaacctgggaggcggagcttgcagtgagctgagatcatggcactgcattccagcttgggcgacagagcgaggctctgtctcaaaaaaaataaacaaataaaaataaaaaaataaagaaaaaaggctctaaagatgtttgctgttatttctacaactcgaatgccgtggtttgcaacaaggggcagatgttttattttgcaatgtctggaaactttatttttttgatggagtttcactctcgttccccaggctggagtgcaatggagcgatcttggctcactgcaacctctgcctcctgggttcaagcgattctcccgcctcagcctcccaaatagctgggattacaggcgtgcaccaccacgcccggctaatgttgtacttttagtagagacagtgttttaccatgttggtcaggctggtctcgaactcctgaactaatttgatctacctgcctcagcctcccaaagtgttgggattacaggtgtgagccaccatgcctggcctggaaatctttttgattggttgtcccaactggggtggtggcactggcacctagtaggcagtgttcagggatgctgccaaacatccctggatgcactggatggtccccaccacagagaataacccggtccgtattgctagtagtgctggggtcaaccctgcagttgtgtgttgtgctccactgaagttcaggtgctggatactgaatgaggaatgagcacccgggtccagatccagttcatgtgctgactgctgtgtcacctgcagaaagccacgtcagcaccccgcacctcagcactcggtgggtccatttttaactagagatgacaggcacctgctctctcacctggggctcgcagggaaggcagtgcgctactcatatgggagctccggcatttggacggcacagtctccttattaaatatctcagtgaccttagtcatattgttagtgaaatggcaattagtttttctaactttggagggggtaatagattaagatttctgcacataatacacaaagacatttaatatggctccgtggctgcctctgaggccacgcttctccagtggcagttctactggtggcggaatgatattttttgttgtttggtttggtggtttgtttgttttttaccgcaaattcattgtctgggtttttctctcccttccggattggccgagaatattcaaatcgctggacctcgttcaccctgtaaaaactgtacagagacagacagatcattagatatttaacccggcaaatagccaatttgcttttggacacggggtctggccttagaacatgtcactgcctcctgtaaaatgtccctaaccttgacctgaagccatcgccttggtgtcctctcccagccagggaaatgttggcaggtggaaaaattaacttgagtttttgcctcttccctgtccctgccaaccctcgagggaaaacagaagctgagtaagagtgaaatgagcaaaaacagaggaaaggtgaagcgaaggagagagaaaaaagcttttgtgttcaacgtatgtgtttattattattttaaaaaagtattacataccttagtttcagatctacaaagcacagattttgcaaccaccccaagagtgacacacaggaaacataagtaacctgcctccgcggtcggggtacgaggcaggctttccgcatgcacagggcagggcgtggagagactgagactgatttctcccctgcactgaaatgcaggcaggcttccacagcaaaagaaactactgcatctgagaaggctctaagcgtcactatttgcttaaggcctctgaaaaaaaatgttgcaacccttaaaatgtatgccttgcgagagcaatcatttgtaaataaacagggtcccagtttatttcccattattgctgatgcaaggtcaaagaaacgatgaaaggttaaagaaaccaccaaacttcaggaagcaaaatgaagctgatcctaaggaatatgaggtcatcaaagagattaatattttcaccagaacatggatcaaacagaacagaaaagtcttaatatcaaacacatctgctaaagcaggtctttctatgccattgctaagtcaggtgcgatacaactgacaggcagaaaatctcactcaaatatggacagttgactcaggaggtttaaaagccccctcataaccctacattatggaattgctgtgctgtaaggctgaagggttctcctgtgtgtcaccaggagcaaatgtgcaaatcccatttcccgccttctaaaatgcaaacattcaggccacactcacatgtatgaacttggctttgctgggaacaggcaggacttgtgcactgctgtgaagttccctaggggattgtaccccacagggcaggtctataaaggagaccagacggcctccactgccctcttaggtttttgctgtcagctgactttgggaaaggaataggctttgcacgctcccagcacatggattaacatctcctgtcactttttttggatgctgaaaataattagcttcccttgctcttcaaagaggacagaaagagcatttggaaagcgaatccatggccaaagtccgtcctttaaaaggtggaattattagcaagagatctgtacacagcctcttacaaccctcacgttgggtaagaaaaatgggattattaccttacaatctgctctgacactggcctgtgaaacttaggaggcagatcgagtttgggcttcactgtgaagcactgaatatctgaggtgagggggttaaggatcactaaggcagcatagacatcaaccatgagagaggccccccaccacacccaaccacccaaatgaatggcatcaccatggtttcagagttgatgaggttgtcttaaaggatacactggccaggagagtttttaatatcgtcgcctggtggagatgttgtcttcattttctcggcgtttggaaactgagttaagagccgagcctcaaaatcttcccggcgctcatactctttccctcggtaaatgaaaacttttccctgaaaagggtgacattcatttcataacaccacagagaaagggccaggaagagttcacatgcaatatgctggccttaaaatatgccttacgggttcttacaaaatgtcattaaatttaagaacaacttgtaatttttatttttttttgtacttgcgttggctttgttaatcaagaacacatggtcatcaagcatgtaagttaatactgtttaagaagcactcagcactgcgctactaacatctgtgatatgttttcatcttgacagtaacaactgatttaaaaactatatgaaaaaccaaatgagcactcagaagcccacactagaatgggcatgaaatggttagaagggggcaaggcagccaggacaagtggataatgatgtccacactttttcttgtttttgttttcttctcaggtaggccctaatgaagttgttttcattctgccataaggaatttaagagagcttgagctaaggtggggccccagcacctgcacacggccgccgggcgctgactcctgtgagacacagccgaggcgagcagaacccgaggggaagggatgcagaccagagccgagagctactaagttcctggcctcccccgagtgagtgactggcgatggacggagagcaggacttcccttcctgcattcagaatgtgtgtgcaggtcattattcatcaacacatgtcaagataaaacatacagagctcttcttggaagggctgggtttggtccatctcaaatgacacttttgtcacctccataaattccaagatggaatgtcagtccactggggttgttatagacggctaggctagactaggcagtccggggcggggaggggagttaagtaggtaagtgttcttccttccacgaggctgtcttgttgaggtcatttctgcctgagtgtgacacagtcctctgtaaatatacctgtaaggaacgttttccttgcaagatacaacaggtctccgtttttttcccgatttcaacacgtgtgttctgagtgtgaactcggtcacagaaaggggccaatgagtacctagtgtaatgctgctgctggttttggaagccttctgcctccccccacccatcctgtcccatctggggctgtctcaaccgaaatgaaaactgccacaaggagaagacagcgagcagaagccacaggggtacaagaaacagaagtctggggttgggggggtaacactttccaggacggggcgtggttgctgaggtgcttctgttctttgatcaggggacacgggggaagaacctccaggttggctgctcccaagtcagctgcagccctgccccatctgcagtcattcctggacaggtgccagagagggagacgaacagagacagagacagacagagaggacagcattttgctgcatatttttacacttaccccctaaagactaagattgaagtcaaattaaaatttgtctaactaaaggattttcaaaaggattaagagagattctatgacactgaatcaattgatccctgctgtggtcagaacgtttgtagtccccaaaattcagatgttgaaacctaatcaccaaggtgatagtattagaaggtggggcctctggaaaggctccacccttaggaaagtcatcagtgcctcagaaaagaggccccagagagctgcctgccctttccaccccatgagaacaggtggaaggcgccatctatgaggaatggccctccccagactccaaatctgctggcaccttgatcttggacttcccagcctccggaactgtgaacaatacattcctgttgtttataaagtacccagtctaaggtattttgttacagcagccccagtggactaagacagtccccttcccttgccccagcttattctgagttctcctaaatcgctaaaaaaagaaccagtttaagaattgaattctttttcactttgtgcttagatatgtcttagaagtaccattatggaagaaaaatgctctatttctccccaccgcccccccgaaaaaaaaaagtcaagcagaaaccagataatatgtcatcttaaatacagtctgagcaacttctaaggcttctatataaagccacgcacttccaaaattcagtaagatttaatggataacagactactatcaaactagcaagcatttttcttatgctttacatgagaaaacataataataaaaatgtatataaagactttaatagaaaaaagctagtgagttataggtaaaaacacgaataacattttctgaaaatgtcagttactttgcattctgaagtgatccttttgaacatgaaaacaagggggaaatgtacatatagtcaaagatatttattccttgtaaggtctataaatatcaacatgagcacaaaaaacagtgagaccaatttttagagaaaaacaaagcaaaagggacagctagtcagttcttggaggctcctctccagcagggcatgaagcacgcaaacattctgcccacgttttggtaactgccagtgtcattggcagattgacccctgccagctcatctgtgaagtgtgataaatatattgctgcagacccacagaatgatccaggtgtggcgggaaagtcagttcaatattaatcgagcctgttaacctccattcagacttttcattttgtccttttggtggtggagatgacccagcaccgcccctggagcctgctgtgtgtgagctcctggcacaacctggcatctattggctcgggagctgcaacgtgtcctccgcacccggcactgccctcacataatattccacgcaggctgctcccttgctctggattctgggataaccatcctgcacggatccagagttggtgcctacataccagaggtagatctccatccacaggggccacacgcaccatctaacaccaagcactgcacaaggctgcatggcttagggtccacctgcctccctttcctaaagatgtatgttccggagcacacacacactcgaattaaagcctttagcaacagtaagtggctttaactccaagctcattccacccttcagctttgttttttattgagaatgaagctaatttcaaatttgtctctaatttagagcttgtaactaagcctcctttattcattctttggaagggaagactttgttcagaatctgtgcttctgatcaaccgctgtctttgctgcacgatgaaggcaagaggagaagctgaccagcagtgaccaggagtgaccaggacagggccagacgcctccgtcaccaggcaggacactgagtgggcagccagcctcacctcctagagcaggccagaactgtggtgctcccctgtcaacagtgacatgcccttcctaaggggaggtctgtatcctctgggtgccgtgatgaagagatgtcacactattagtgactcccgtggagtcggaaacacaggaccccaaatgaacaacgtctggaaccaggggaatctcccaactggtttcaactgccccagacggctgtgctcaagacacagagcttctgcttcctaaagccagagcaatcacacatagtctcctaggataagagaaaaccaagtgtccaaaaaaaaaaaaaaaaagtcataagaaatatcaggaaatcatgacccactggtcaatggcatccaaagaatgtgttcttgagaaaatgtataaacaattctatggtaggccaggcagcactattaatatttatgtaacttctcctttggcctcatgtgaatactgggaaatgggcacctggcaggtgatcacggttactgcttcaattacatgtctgaaagcacatgcctgtctcagggatggagcctggtttggagtttctagcaccgtggccatacagatccatttccaatttcccatataattaaaaacatacatcttcatagcagcacattgggcggggacaacccaaatgttcatcagtggatcaatgaataaataaaatgtggcctctccatgcaatgaaataccattcagcctcaaaaaggataaagttctgacacatgctacaacctggatgaaactggaagacattcggccgagtgaaacaagccaaacacagaagggcgaacactgtacaattccactaatacaaggtccctacaacagtcagattcatagagacacaaagtagaacggtggctgctggggctggcaggagggagaatggggagttcgtgtttaatggatgcagaatctcagttttgcaagatgaaaaagttctgaaggtagatggtggtgctggccgcacaacaacgtgactgtattaatgccaccgaactacacacctaaaaatggctaagatggcaaatagtatcacatatcatatatcacacctcaattaaaataatacgtgtaaatctctgaaggagggtccttttacggaaaaatcagatagaaaggttatatgcaaccaaataaaatcctgtcaacccctctctgccccccgggctaaccaccgagctatggcagtgtagagagttgcacgatcccacgcggatgcaaactccccacccttcctcagaacgggaaggggattttctgctgggggaacaatcatggctcagattaggcagaaccaaactttacccgcaggaatgtggggaacccttgtccgtagtagccaacagcaaaatagtcaggcttgggcctgatcactttgacgatgttttcataaaactgagcctgttttttctggaaggaaaaaagaaaatgcatttcaggtttgagtattcaagcatgtgtgcctctggattcttcttgcgggctctttaaaagctctggcaacttctatagggtgggagggggagatggtgggagagggagatggtgggagagggtactgaggcttgcacctgaatttcatctcactccatcgttttgacattatttttcactcattctccatcattccgcaagggaatctgaaccaactagcccaaattcagcaaaaagttgtgacttatgggtgttttcaataaccaaagaagtgccatagaaatggctggcccttagtattttttaaaaggtataggtcagatagtgggatacgttcaaagagaatttaaaggaacagaatcgttctgttctaaattcatgacagacattcccacatcattaaggtgatctgctgaatacaaaaatgacaaggtggaggaggtagcaattagaaactaacagcattcccatggcagaagaaaggtctggtcattatctatccatccctctctcatagaaggggtcaggtttttttgttttttgagacggactctcactctgttgcccaggctggagtgcattggcgcgatctcagctcactgcaacttccacctcctgggttcaagcgattctccagcctcagcctcccaagtagccaggactacaggcgtgtgctaccacgcccggctactttgttgtatttttagtagagatggggtttcaccgtgttagccaggatggtcttgatctcctgacctcgtgatccgcctgccttagcctcccaaagtgctgggattacaggcgtgagccagtgcgcctggcctggggtcagttttaaactagtacaaatgttcacagactcctgggctgtcaagaccgctatacacaaggtcagcagttgtttacgtacaatttattcatagaagccttaagagtttggttataagagctgacttgggactaaaaagtaaatatttatgggccaaatatcaaccagcaaattaactaaaaccatcttcctaggcaaaacggagggacatggccaaggtcccagagtgcctggggtgaaccctaacattgacatggaaagagagattcctgaaaaaccagctgagattgcctgtgttcatttaaataaaaagaaataaagactcaccagcaattcgctgagttgctcataatcaaacatttcgttctcatactgctcggctagctccttgcccaag

SEQ ID NO: 11941 - DNA, 3842 bp, Homo sapiens
tttaaaacataaataggtttgcttctttaattccatatgtgcatttacactcttctttattagtggataaatattagaaaatcatctctcagacagagtggctgagggcgggcccctccaggggctccggcttggtgtgcagggtgaggctgtccctccagggctcgtacaccagcgtggaggtctcggccctcttgatggtgaacttataggatcggttgggcagcaggtttcggacgtcgaaggtgcaggcagccacggggatgacgccacactgggcgcactcctgctgtgtccgcgggtccagcagcctgaagcgcaactcatactgctccgatgtggctggctggatggtgacgaaccagcgcagccgggcccagtcctggtgagccgccgacgcctttcggtcaaacacgacaggcatcttggtgctcagcatgagccagatgtgcgggatcttggtggcactgacatcagacaccaggcggtgcttgacgtgtagccgccccggcaccatcatggtcaggaagctgtccatgacggccgacacgtccgccagccgccgctccaccagcgcccagtcggccaggaagggccgtgggtctggcgaccggagcagggcatccagctcagcacggccatggtcgagctgttccaacaggtccccgagcagcaggagctggatcttggtctgagctgtgcccaccttcttcatgcgctggaacttccaggggtcgatgagctggaacaaggcgctaggcagcaccagcgggttctggtcgcccagggccaggtgcttgggcaggacctcgatgtagtaggagcacttacgcagcagctgcatgcgggcgtggtggcgcttgagcaggtgcggactcaggtccgaggtcaggaactcacgcagggcattgcggcgctcggtgtaggtcttccacgcctctggttccagcagctgctggtcatctgcctcctcctggtccaggaaggactggggattgcccagcttcatcttgtccaggcccaggcctgccacatgggtgctcattatccgggagctggggggagggctgggtgtcagctgccaggcaggctggcctcccctgggctgtggcatgttcgggggatggattcagcccactgaccccatgctggacctctgtccttcttcgggggcacaactcgatgggaagaggctgcctggagggctggatgggcagcctacagatctggacacagtttatactgaggggcaaaaacctctactgacaaccagtggcctgtgggacaggacagggaagaactaggactgcggacttctggccagaaccgcctgacctgtggccttgcaagggccccagttcctaaccctgctgctgaaaggggttgctggcacccctcggggccgtggagaggggacggcgtggtcctaagcagcacaggatccccctcggggacattcgcgggccatcctcccgctccggttctccctggggacgctccacgcctcaccgcagttgtagggcacagagacaggcctcaccaaagacgaggccagctggctggtcagcatgggaggagggcgcccaggcctgggcccggaggagcagccctcctcccacgctgtgggccctcgctgtggacccgggatcctgtccctggtgagctcatggactccacaagtgacactccatttcccagatggagcctgaggctaagaagcttggttcttgttctcatccagggcttgagcccagtgctgagccgagtctgaccctctgtccgtgggtgcaccggctgagtgcagctgtggccccaggctctgccgcagctccctggagagcaagccgcacccctggttgctgccccggctcccagcaaccctggagatctcaggttgtcacagccacttgggccttggacgacccacaaatgagagctaagcagttgctgagttccccagggccacacaggtacgtggtgaagtcatatctgcccgggaagggttgcccttttgggcgtgaggcagatatgacttcacgagcgcactcctcgggaatccctcgagaacaggcccctgggggcagcagggagtgtgtctggggtgaggtgccagctgagagcaggaccccaggaccccaggcctaagccctgctcttgctggaggctggggcggatttcaccgctggagggaaaccgtgcctctgtgacgtgtgagggatgttttctagtctccagcagctgcccaggtggaacacccagagaggctggtcgtgaacccggaaaggtggttctgagcccctcgctgcttcctacacgccccggtcccaggcccgcttccctgagaccaccaggtgcccgcactctaccccctccaccacactccccttggctcccctggcccgggcccacctccccggccgctctgcctgccccttaccttctcgagacccccagccctcctctcccggcccccgccgccgccccaggaccgcgcccacttgccctgcctctgaagcggagccgcgcgcggacttcccagagcccagcctccctccgcactccgcgggttgccctggggaccagcggcctttgtgacgctgcggcccgggggcggggcgggggtggggacccgggaccccgagccgagtaatcttccatccgcttcgcttcctggagagccccagacttctgggggcccgcgtccccgactgaggggccacggcgggtggctggtccaagagccaggctccaaggggggttcccgtcccggagcccttccgcgggcgcaccactccccacgcacccccggcttcgggcggggcgcaggagcctcgggtgactgggagggagttcctgctcaaccccccagtccgagcgcactcctcgggaatccctcggaggaatttgggagagaggcagtggccggtgaccaggcggatggaccacccagcgcctggacagaggagaggggcggcttcccccgccgcgggctctgcccagcaaggccccgcccattacagatgccacccattacaggctcctcccaccgcaggctccccccaccgcaggctcctcaaccacaggctcctcccaccatgggctcccccctcccccgcaacggcccctcccatcataggctcctcccaccgcgggctccccccaccacggcccctcccaccacaggctcctcccagagcaggctcctcccaccgcgggctcccctactacggcccctcccaccacagggtcttcccaccacaggctcctcccagcgcaggctcctcccaccgcgggctccccccaccacggcccctcccatcataggctcctcccactacaggctcctcccactacaggctcctcccaccatgggctccttccacctggggctgcccaagctcaggcaccgacctgactctggataaatggggtctccatagctccagggagccccgcaggggagctctgaggccatctggtcccgtctgtatctgttcagttgggctcagggcctctgggatccccccgttcccccacagcacaccccagctagctgggggtctcctggggtcacaatcttagacaccccaaggtgcccctccttcaccttcaggaagatgctggaggaagacaccctttccatcctcctcatctccacccccacggaggtcagtgctggggcctcttccaggatgggcgtctttgagcccctaccaggctgttctgtaacttgagcctcccccctcctcccggtgaccccaccctggaagagctttcccttggtgcatggaggccccaggggttaggcctggcaggaagtgggtggatgtgggtggtttttt

SEQ ID NO: 11942 - DNA, 3841 bp, Homo sapiens
tttaaaacataaataggtttgcttctttaattccatatgtgcatttacactcttctttattagtggataaatattagaaaatcatctctcagacagagtggctgagggcgggcccctccaggggctccggcttggtgtgcagggtgaggctgtccctccagggctcgtacaccagcgtggaggtctcggccctcttgatggtgaacttataggatcggttgggcagcaggtttcggacgtcgaaggtgcaggcagccacggggatgacgccacactgggcgcactcctgctgtgtccgcgggtccagcagcctgagcgcaactcatactgctccgatgtggctggctggatggtgacgaaccagcgcagccgggcccagtcctggtgagccgccgacgcctttcggtcaaacacgacaggcatcttggtgctcagcatgagccagatgtgcgggatcttggtggcactgacatcagacaccaggcggtgcttgacgtgtagccgccccggcaccatcatggtcaggaagctgtccatgacggccgacacgtccgccagccgccgctccaccagcgcccagtcggccaggaagggccgtgggtctggcgaccggagcagggcatccagctcagcacggccatggtcgagctgttccaacaggtccccgagcagcaggagctggatcttggtctgagctgtgcccaccttcttcatgcgctggaacttccaggggtcgatgagctggaacaaggcgctaggcagcaccagcgggttctggtcgcccagggccaggtgcttgggcaggacctcgatgtagtaggagcacttacgcagcagctgcatgcgggcgtggtggcgcttgagcaggtgcggactcaggtccgaggtcaggaactcacgcagggcattgcggcgctcggtgtaggtcttccacgcctctggttccagcagctgctggtcatctgcctcctcctggtccaggaaggactggggattgcccagcttcatcttgtccaggcccaggcctgccacatgggtgctcattatccgggagctggggggagggctgggtgtcagctgccaggcaggctggcctcccctgggctgtggcatgttcgggggatggattcagcccactgaccccatgctggacctctgtccttcttcgggggcacaactcgatgggaagaggctgcctggagggctggatgggcagcctacagatctggacacagtttatactgaggggcaaaaacctctactgacaaccagtggcctgtgggacaggacagggaagaactaggactgcggacttctggccagaaccgcctgacctgtggccttgcaagggccccagttcctaaccctgctgctgaaaggggttgctggcacccctcggggccgtggagaggggacggcgtggtcctaagcagcacaggatccccctcggggacattcgcgggccatcctcccgctccggttctccctggggacgctccacgcctcaccgcagttgtagggcacagagacaggcctcaccaaagacgaggccagctggctggtcagcatgggaggagggcgcccaggcctgggcccggaggagcagccctcctcccacgctgtgggccctcgctgtggacccgggatcctgtccctggtgagctcatggactccacaagtgacactccatttcccagatggagcctgaggctaagaagcttggttcttgttctcatccagggcttgagcccagtgctgagccgagtctgaccctctgtccgtgggtgcaccggctgagtgcagctgtggccccaggctctgccgcagctccctggagagcaagccgcacccctggttgctgccccggctcccagcaaccctggagatctcaggttgtcacagccacttgggccttggacgacccacaaatgagagctaagcagttgctgagttccccagggccacacaggtacgtggtgaagtcatatctgcccgggaagggttgcccttttgggcgtgaggcagatatgacttcacgagcgcactcctcgggaatccctcgagaacaggcccctgggggcagcagggagtgtgtctggggtgaggtgccagctgagagcaggaccccaggaccccaggcctaagccctgctcttgctggaggctggggcggatttcaccgctggagggaaaccgtgcctctgtgacgtgtgagggatgttttctagtctccagcagctgcccaggtggaacacccagagaggctggtcgtgaacccggaaaggtggttctgagcccctcgctgcttcctacacgccccggtcccaggcccgcttccctgagaccaccaggtgcccgcactctaccccctccaccacactccccttggctcccctggcccgggcccacctccccggccgctctgcctgccccttaccttctcgagacccccagccctcctctcccggcccccgccgccgccccaggaccgcgcccacttgccctgcctctgaagcggagccgcgcgcggacttcccagagcccagcctccctccgcactccgcgggttgccctggggaccagcggcctttgtgacgctgcggcccgggggcggggcgggggtggggacccgggaccccgagccgagtaatcttccatccgcttcgcttcctggagagccccagacttctgggggcccgcgtccccgactgaggggccacggcgggtggctggtccaagagccaggctccaaggggggttcccgtcccggagcccttccgcgggcgcaccactccccacgcacccccggcttcgggcggggcgcaggagcctcgggtgactgggagggagttcctgctcaaccccccagtccgagcgcactcctcgggaatccctcggaggaatttgggagagaggcagtggccggtgaccaggcggatggaccacccagcgcctggacagaggagaggggcggcttcccccgccgcgggctctgcccagcaaggccccgcccattacagatgccacccattacaggctcctcccaccgcaggctccccccaccgcaggctcctcaaccacaggctcctcccaccatgggctcccccctcccccgcaacggcccctcccatcataggctcctcccaccgcgggctccccccaccacggcccctcccaccacaggctcctcccagagcaggctcctcccaccgcgggctcccctactacggcccctcccaccacagggtcttcccaccacaggctcctcccagcgcaggctcctcccaccgcgggctccccccaccacggcccctcccatcataggctcctcccactacaggctcctcccactacaggctcctcccaccatgggctccttccacctggggctgcccaagctcaggcaccgacctgactctggataaatggggtctccatagctccagggagccccgcaggggagctctgaggccatctggtcccgtctgtatctgttcagttgggctcagggcctctgggatccccccgttcccccacagcacaccccagctagctgggggtctcctggggtcacaatcttagacaccccaaggtgcccctccttcaccttcaggaagatgctggaggaagacaccctttccatcctcctcatctccacccccacggaggtcagtgctggggcctcttccaggatgggcgtctttgagcccctaccaggctgttctgtaacttgagcctcccccctcctcccggtgaccccaccctggaagagctttcccttggtgcatggaggccccaggggttaggcctggcaggaagtgggtggatgtgggtggtttttt

SEQ ID NO: 11943 - DNA, 4742 bp, Homo sapiens
gccgacatcaacttcagctgctgctacctctgcatccggctcgaggggctgccggctcccacggccagcccacgccctgggcccagcagcctcggccctggcctgaatgttgaccccggcacgtatacctgggtggcccacgggcagacgcaggactgggaccaggagcgccgggcagaccggcaggaggctcccagacgggtgcacctcttcgtccaccacatgggcatggagaaggttccggaagaggtgctgaggccgggcaccctgttcaccgttgagctgctgcccaagcagcttcctgatctgtgagtggcttccaccagcagaggctgggctgggggaccgccccgggcccctcacttgcaggaggggggagctcgtggggcagcagcccctttcctgggagtcctgttggttttccagtgtctgccttcacccccagccgcaaggaggaagccgtgcgtggactagaggaggcgtccccgctggtcaccagcatcgcactgggccggcctgtcccgcagcccctctgcagaggtaggtctgccccacccctccagcttcccctctggcccccagccccaccctgcatgagtgctcagggaggctgccccctctcagtgatccccagcaggttcctggagcggcagacctacaacatccccggaggccgccacaagctgaaccccagccagaacgtggcggtcagggaggctctggagaagcctttcacggtcattcagggcccaccaggtagggcccatgccgggggagccgcaggctgccttgggccacagggacccacagggtgggctacaatctcctattctctggctgcaggtacagggaagacgatcgtgggcctccacatcgtattctggtttcataaatcaaaccaggagcaggtgcagcccggaggccccccccgtggggagaagcggctggggggtccctgcatcttgtactgcggcccctccaacaagtcggtggatgtcctggcaggtgcgccggggtcggcggtgggggcctttggggagctggcacgcggggcaggactcacgtcccccaactaccctcaggactgctcctgagaaggatggagctgaagcccctccgtgtgtacagtgagcaggctgaggccagcgagttcccagtgccgcgtgtgggcagcaggaagctgctcaggaagagcccccgggaggggaggccgaaccagagcctcaggtgtgcctgctgtctttggggcttgggcggagtggggccgagctgtccagacagtcctgtgtaggtgggtctcactgagctctgcccccgtgatggccctgcgtggacagggctcactgtgtcctgtcccccaggagcatcaccctgcaccaccggatccggcaggcccccaacccttactcgtcggaaatcaaggcctttgacacccggctgcagagaggggagctcttctccagggaggacctggtctggtaagtggcaggggccagggggtggagctgcctgcagcatgggggccctggggtgacaagcagtgtccccggcaggtacaagaaggtcttgtgggaggctcggaagttcgagctggaccggcatgaggtcatcctctgcacctgctcctgtgcagcctctgccagcctcaaaatcctggacgtgaggcagatccttgttgacgaggcaggcatggccacggaacctgaaaccctcatccccctggtgcagttcccacaggccgagaaggttggtcggcggggggtgtgggcagcatgagcaggcgtccctggcacagtctcccacctggggtgccctgtgtgtgcagacgcgggtgtcgtgtggggctggggtccctctgggtctaggggtgtcagggccaggcctgcctattcctccaggtggttcttctcggagaccacaagcagctgcggcctgtggtcaagaatgagcggctgcaaaacctgggtctggaccggtctctgttcgagcggtaccacgaggacgcacatatgctggacactcagtaccgcatggtgagcccgccccactcagcccccagcccacctgcagcccctggggggccacaaccccgcgtggcagcctctgaccagcgcacatccttgcctgcagcatgagggcatctgtgccttcccctctgtggcgttctacaagagcaagctgaagacgtggcagggcctgaggaggccgcccagtgtcctgggccacgctggcaaggagagctgccctgtcatctttggccacgtgcagggccacgagcggagcctgctggtgtccacggacgaagggaatgagaactccaaggccaacctggaggaggtggctgaggtggtgagtgtctggtgcctgtgagtcagggagggctttctggaggaggtggctgaggtggtgagtgtctggtgcttgtgagtcagggagggcttcctggaggagggcaggagagacaccagggtccgctccacctgccccctcggctcctcaggtccgtatcaccaagcagctgaccctggggaggaccgtagagccccaggacatcgccgtcctcacgccctacaacgcgcaggcctctgagatcagcaaggcccttcggcgagagggcatcgccggggtggccgtgtcctccatcaccaagagccagggtgaggctgggggctcgtgggtggggccgggagggtgggcgcagcggcagcagggcctcacctcccatcccgcagggagcgagtggcgctatgtgctggtgagcaccgtccgcacctgtgccaagagcgacctggaccagcggcccaccaagagctggctcaagaagtttctgggcttcgttgtggaccccaaccaagtgaatgtggctgtcacgcgggcccaggaggggctctgcctgatcggtgagggcggggctgggctcttccagggtgggaacacaggtgaggccagggctgggctagggagctgccgactcctgcctgaccctgactccgacctgaccctgactcctcccacctgaccctgactcctcccacctgactctgactgactcccatctgaccctgactcctcccacctgaccctgactcctcccacctgaccctgactgactcccacctgaccctgactcctcccacctgaccctgactccgacctgaccctgactcctcccacctgaccctgactcctcccacctgactctgactgactcccatctgaccctgactcctcccacctgaccctgactcctcccacctgaccctgactcctcccacctgaccctgactcctcccacctgactctgactgactcccatctgaccctgactcctcccacctgaccctgactcctcccacctgaccctgactgactcccacctgaccctgactcctcccacctgaccctgactcctcccacctgaccctgactgactcccatctgactcccaccctcacaggagaccacctccttctgcgctgctgccccctctggcgtagcctcctggacttctgcgaggctcagcagaccctcgtgcctgccggccaggtgcgcgtctgcaggaggccaactatgccttcctgaagagccctctccacctgcaaggtgccaggactgggagggaaagtccagggcccccccaccctccccaccaccctccgccatcagcctgcctgggccagcctgcctcctggcctcaggatctccctggggcaggaagtgggtggacttggaggaggaacggcaagggccggtccccacactcttgctcctcctgggcatctggggacaggaacacctctcagggtggccaagaggggcttccttgggaccagtgcaaggaagttctgctgtccctgggaagtctcagaaccaggaaggaaaccctgtggaggctgccctttgacctttggacgccacctgtaatcactctggatggtgtctgtggagttcaggtttattttctatttaaatgaactaaaagccagcatcctgccgggcgtggtggctcacgcccataatccagcactttgggaagccgaggcgggcagatcacctgaggtcaggagttcgagaccatcctggccaacatggtgaaaccccgtctccactaaaaatacaaaattagctgggcgtggtggcgggcgcctgtaatcccagctacttgggaggctgaggcaggagaatcgcttgactccaggaggcgcaggctgcagtgagctctgatggtaccactgcactccagcctgggtgacagagcgagaccctgtcttaaaaaaaaaaacaaaacaaaaccagcatctgttactggaacagagacctcagcccaagctcaggacaaggaggcctccctgggagagggggcctttctcccaccatcaccgcctgtgtccttcaggggctgctggagggcagcccaaagccaggggcccaccccgccccaccccaccccaccccaccctctgaaatgtgaaaagcctgcactcttcctgtgggctgcgcagtgggctcgggggttggggggtgccggggcgatgcttccaccctggactgagtgttcggggcagcctgctcggctgtatgtttctcgcacgctcacccgcttcagtgcggctctgtccctgctgccgcctccagtcctgagggaggggcttgccccaccttctacattccaatttttatatctttgaattatgtgattagatattaatttaatgataaaaccactctgaaagctcttctca

SEQ ID NO: 11944 - DNA, 192 bp, Homo sapiens
aaaaatacaaaacactagctgggagtggtggcaggcgcctgtagtcccagctactcgggagactgaggcaggagaatggcgtgaacctggaaggtggagcttgcagtgagccgagatcacgccactgcactccagcctgggcgacagagcgagactctgtctcaaaaaaaaaaaaaaaattagctggacgtg

SEQ ID NO: 11945 - DNA, 217 bp, Homo sapiens
gatcgagaccatggtgaaaccccgtctctactaaaaatacaaaacactagctgggagtggtggcaggcgcctgtagtcccagctactcgggagactgaggcaggagaatggcgtgaacctggaaggtggagcttgcagtgagccgagatcacgccactgcactccagcctgggcgacagagcgagactctgtctcaaaaaaaaaaaaaaaaaaatta

SEQ ID NO: 11946 - DNA, 4742 bp, Homo sapiens
gccgacatcaacttcagctgctgctacctctgcatccggctcgaggggctgccggctcccacggccagcccacgccctgggcccagcagcctcggccctggcctgaatgttgaccccggcacgtatacctgggtggcccacgggcagacgcaggactgggaccaggagcgccgggcagaccggcaggaggctcccagacgggtgcacctcttcgtccaccacatgggcatggagaaggttccggaagaggtgctgaggccgggcaccctgttcaccgttgagctgctgcccaagcagcttcctgatctgtgagtggcttccaccagcagaggctgggctgggggaccgccccgggcccctcacttgcaggaggggggagctcgtggggcagcagcccctttcctgggagtcctgttggttttccagtgtctgccttcacccccagccgcaaggaggaagccgtgcgtggactagaggaggcgtccccgctggtcaccagcatcgcactgggccggcctgtcccgcagcccctctgcagaggtaggtctgccccacccctccagcttcccctctggcccccagccccaccctgcatgagtgctcagggaggctgccccctctcagtgatccccagcaggttcctggagcggcagacctacaacatccccggaggccgccacaagctgaaccccagccagaacgtggcggtcagggaggctctggagaagcctttcacggtcattcagggcccaccaggtagggcccacgccgggggagccgcaggctgccttgggccacagggacccacagggtgggctacaatctcctattctctggctgcaggtacagggaagacgatcgtgggcctccacatcgtattctggtttcataaatcaaaccaggagcaggtgcagcccggaggccccccccgtggggagaagcggctggggggtccctgcatcttgtactgcggcccctccaacaagtcggtggatgtcctggcaggtgcgccggggtcggcggtgggggcctttggggagctggcacgcggggcaggactcacgtcccccaactaccctcaggactgctcctgagaaggatggagctgaagcccctccgtgtgtacagtgagcaggctgaggccagcgagttcccagtgccgcgtgtgggcagcaggaagctgctcaggaagagcccccgggaggggaggccgaaccagagcctcaggtgtgcctgctgtctttggggcttgggcggagtggggccgagctgtccagacagtcctgtgtaggtgggtctcactgagctctgcccccgtgatggccctgcgtggacagggctcactgtgtcctgtcccccaggagcatcaccctgcaccaccggatccggcaggcccccaacccttactcgtcggaaatcaaggcctttgacacccggctgcagagaggggagctcttctccagggaggacctggtctggtaagtggcaggggccagggggtggagctgcctgcagcatgggggccctggggtgacaagcagtgtccccggcaggtacaagaaggtcttgtgggaggctcggaagttcgagctggaccggcatgaggtcatcctctgcacctgctcctgtgcagcctctgccagcctcaaaatcctggacgtgaggcagatccttgttgacgaggcaggcatggccacggaacctgaaaccctcatccccctggtgcagttcccacaggccgagaaggttggtcggcggggggtgtgggcagcatgagcaggcgtccctggcacagtctcccacctggggtgccctgtgtgtgcagacgcgggtgtcgtgtggggctggggtccctctgggtctaggggtgtcagggccaggcctgcctattcctccaggtggttcttctcggagaccacaagcagctgcggcctgtggtcaagaatgagcggctgcaaaacctgggtctggaccggtctctgttcgagcggtaccacgaggacgcacatatgctggacactcagtaccgcatggtgagcccgccccactcagcccccagcccacctgcagcccctggggggccacaaccccgcgtggcagcctctgaccagcgcacatccttgcctgcagcatgagggcatctgtgccttcccctctgtggcgttctacaagagcaagctgaagacgtggcagggcctgaggaggccgcccagtgtcctgggccacgctggcaaggagagctgccctgtcatctttggccacgtgcagggccacgagcggagcctgctggtgtccacggacgaagggaatgagaactccaaggccaacctggaggaggtggctgaggtggtgagtgtctggtgcctgtgagtcagggagggctttctggaggaggtggctgaggtggtgagtgtctggtgcttgtgagtcagggagggcttcctggaggagggcaggagagacaccagggtccgctccacctgccccctcggctcctcaggtccgtatcaccaagcagctgaccctggggaggaccgtagagccccaggacatcgccgtcctcacgccctacaacgcgcaggcctctgagatcagcaaggcccttcggcgagagggcatcgccggggtggccgtgtcctccatcaccaagagccagggtgaggctgggggctcgtgggtggggccgggagggtgggcgcagcggcagcagggcctcacctcccatcccgcagggagcgagtggcgctatgtgctggtgagcaccgtccgcacctgtgccaagagcgacctggaccagcggcccaccaagagctggctcaagaagtttctgggcttcgttgtggaccccaaccaagtgaatgtggctgtcacgcgggcccaggaggggctctgcctgatcggtgagggcggggctgggctcttccagggtgggaacacaggtgaggccagggctgggctagggagctgccgactcctgcctgaccctgactccgacctgaccctgactcctcccacctgaccctgactcctcccacctgactctgactgactcccatctgaccctgactcctcccacctgaccctgactcctcccacctgaccctgactgactcccacctgaccctgactcctcccacctgaccctgactccgacctgaccctgactcctcccacctgaccctgactcctcccacctgactctgactgactcccatctgaccctgactcctcccacctgaccctgactcctcccacctgaccctgactcctcccacctgaccctgactcctcccacctgactctgactgactcccatctgaccctgactcctcccacctgaccctgactcctcccacctgaccctgactgactcccacctgaccctgactcctcccacctgaccctgactcctcccacctgaccctgactgactcccatctgactcccaccctcacaggagaccacctccttctgcgctgctgccccctctggcgtagcctcctggacttctgcgaggctcagcagaccctcgtgcctgccggccaggtgcgcgtctgcaggaggccaactatgccttcctgaagagccctctccacctgcaaggtgccaggactgggagggaaagtccagggcccccccaccctccccaccaccctccgccatcagcctgcctgggccagcctgcctcctggcctcaggatctccctggggcaggaagtgggtggacttggaggaggaacggcaagggccggtccccacactcttgcttctcctgggcatctggggacaggaacacctctcagggtggccaagaggggcttccttgggaccagtgtaaggaagttctgctgtccctgggaagtctcagaaccaggaaggaaaccctgtggaggctgccctttgacctttggacgccacctgtaatcactctggatggtgtctgtggagttcaggtttattttctatttaaatgaactaaaagccagcatcctgccgggcgtggtggctcacgcccataatccagcactttgggaagccgaggcgggcagatcacctgaggtcaggagttcgagaccatcctggccaacatggtgaaaccccgtctccactaaaaatacaaaattagctgggcgtggtggcgggcgcctgtaatcccagctacttgggaggctgaggcaggagaatcgcttgactccaggaggcgcaggctgcagtgagctctgatggtaccactgcactccagcctgggtgacagagcgagaccctgtcttaaaaaaaaaaacaaaacaaaaccagcatctgttactggaacagagacctcagcccaagctcaggacaaggaggcctccctgggagaggggccttttctcccaccatcaccgcctgtgtccttcaggggctgctggagggcagcccaaagccaggggcccaccccgccccaccccaccccaccccaccctctgaaatgtgaaaagcctgcactcttcctgtgggctgcgcagtgggctcgggggttggggggtgccggggcgatgcttccaccctggactgagtgttcggggcagcctgctcggctgtatgtttctcgcacgctcacccgcttcagtgcggctctgtccctgctgccgcctccagtcctgagggaggggcttgccccaccttctacattccaatttttatatctttgaattatgtgattagatattaatttaatgataaaaccactctgaaagctcttctca

SEQ ID NO: 11947 - DNA, 858 bp, Homo sapiens
aggtgagaggagaagcaaagaagtggaacaaagacttccaaattaaagagaccacttaagaaaaattacatcaatgtttatactacttataatgtacctcatttgggaaggaaaggctgttagctgctacttgttaccacctgtcaaagcctctgtggcaacagtattgacatttaatccttggaagttctgaagtttttacaaacttggtggtgaggttgagttgatttgttttgcctcaataagaaatgttgatatatggtggctggtaagatggccgaatacgaacagctccggtctgcagctccgagcgggatcaacgcagaaggcgggtgatttctgcattgggtacccggctcatctcactggaactggttggacagtgagtgcagcccatgaagggtgagctgaagcaaggtggggtgttgcctcacccgggaagtgcaggggattggagaactccctctcctagccaagggaagccacgagagactgtgctgtgaggaatggtgctctccagcccagatactacgcttttcccaccatctttgcaacccacagaccaggagattgccttgggtgcctacaccaccagggccctgggattcaagcacaaaactgggtggccatttgggcagacaccaaactagctgcaggagtgtttcttcatactccagtggcacctggaactccaacaacacagaaccattcactcccctggaaagggggcagaagccagggagccaagtggtctagcccagcagatcccacccccacggagcccagcaagccaagatccactggcttgaaattgtcgctgccagcacagcagtctgaggtcaacctgggacactcgag

SEQ ID NO: 11948 - DNA, 13578 bp, Homo sapiens
aaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaaggtagaactctttgcttaattattgagcatattttttaccccgttatgatagtgcttctgaaccctgactgcacatcagaatcatgtgggaagctttcaaaatactgatgcctaggcagggcgtggtggctcacgcctgtaatcctagcactttgggaggccaaggcgggtggatcacctgaggtcaggagttggagaccaacttggccaacctggtgaaacccggtctctactaaaaaatacaaaaattagctgggcgtggtggcaggtgcctgtaatcccagctacttgggaggctgaggcgggagaatcacttgaacccaggaggcagaggttgcagtgagccgagattgcgccgttgcactccagcctgagcgacagagcgagactctgtctcaaaaaaaaaaaaaaaaaaaaaacaaaacacaaaactgatgcctgggtcctaccctatccaaaattttgctacaccataggccaattaaatcagaattttggatggggtaggacctaggcatcagtattttgaaagcttcccacatcatttatttatatctccaaatcaccatagggtatataacaattgtgctttatgagttactttcttgtttggaattaagcacttttgaaagtgtctcaatggaagcagccagttatactataaccttaaggatatgtactatatgtcaagatatttttgttaaatgaaagaaacaatgaataaaaatatatttagcgacacccctttttgttggttaacaagtagtgttgtaaggcaagatcatatgatacatctactgaatgcacattcattttactcatacacatgtttatttaaagatgtaggaaagcagttctggctcagtaactattggaacattttaatttagtacacaggtcaaaagcaatattcatttatttgtttggtagataaaatttcaactggaagtataaagaagaaaggatgttacagacaccatctttacctactcttcaacccctcaagctaacacaaaatagaattcatgttggtagggagggagaggaagtttaaaggagttccctttgctcattattctcctttctgttcgagcttgaacaatatggtttcatgttcttctttctggattagccagcaaatggagaaagtgattcagaaataagtctctgagaacttctccaagctgagtttatgtaaaaagtttgatttaatttacaaataaccacataacatattctttattgcacttggaaaacagtaagaaattaaaggcagttaaaacctaagtgacaaaacagtaggccagaatatgaatttgagtagtctgtgctaatctatgtgtattttcaaacatttgagtgacagaagtaactttaacaccagaagcttttgcgcttacagttgataatactctcattctagtgacacacttttcattgaatcctaataataaaactatgaaataaatttaaaaacaaaacacccatgactctagagagaaaattactagaattaacccttctttcaaatagttatattttgaatcagttcaaataatgtctaaggactataaattggcagcaagtcaggatcttttacttctaatcaaaatatccaaattattaacatcccaattgtttatattttattgtgataacagcccatggcattatgaaataaaaaagaaattagtactacaccttaatttgttttgctgaaaacttaaaaaattttacttccaaaatgctagatagttttctagaatgtggttttgatagaatgcaaagaaaacatgatctggtacatttaatgtagtgaggttgcctgatataaaattgttaatatccatggctattttggggagggccacgcaaatgagattctcattgtcctttggttcttcatttctttttaattgttaaataatcttgaccataagctgcacatggactggcattttcaattcttttgaccagattgatttcttattttaaaaataagtttatttatatattttttttctttaaaaatgcagaacttcgagatcaaattgtatctgttcaggaggaaaagaagattttagccattgagctggaaaatctcaagagcaaactcgtagaagtaattgaagaagtatgtatctcaggcctgaaaggcaagggctttagcattttcaaggtgtttggggatttgctaagttaagaacttaatattataagccaatttctaacatgagaaccatgtaccaattttaatcttctctcctcaatttcagacataaaaaaaggtagaggaaataagatgatgaagattcatgtacccactagctagcttaataaataaaattctgaaatagcatggacatgtttcctgttgttcccccagtttttgctatgtaaggcaaatttgtaagaatagtagctactatttcaagtcatatattttattgctgctggtagagaaagaagagcatgttttgcttttccggtgaatgactggttcaattgggaaggactgtccctctgtgcatctccaacacaggcatttatgataggtggtaggatgggttcaagtggttgtttacagaatctttcttttctggtgttttgttttgtttgagacaagacctaactctgtcacactcaggctggagtgcagtggcatgatcacagctcactgccgcctcaacctcccaggctcaaatgatcctcctgcctcagcctcccaaatagctgagagtacaggcatgcgtcaccacgcctgcctgatttttaaaaatttttatagagatgtgggttcctgtatttcccaggcttaccttgaactcctggacttgaatgatcttcccaccttggcctcccaaagtgctgggaccaccaatgcaagccgctgccctggcctctttttccttttgaactgtctttcagaacaagaccctcacaattgccttttatttgcacgaggcttcaaggatttgccttcacagtcttgattctggatttaatttgtatcagtggttcttagattctgtagcccagcacttcccaactgatgtgccaactgcagcttgataaagtgacttatgagcatgccaacgtattgatcctgtcagtgagcagcctcatccagttacctcagtttgcacacacatattgtcattttcttggaggccatgatgtaaaaaaggttggaaagcagtgtctgccaacttcccagcctgagctccttttattattgtggcaaaacattgtaacgaatgggaagaaggaagatgatattttggaaaggaccttaccgttggacaatgtgtaccagttactaatttaaaccaaaaccaaaaataaagcctacactaaaagaaccagttaatagattatctggaggtgctgatggattcagagccactttcaggaccattatctttgtttcttagtgtgctctgttcctcagctgtgattatttactgatgattctctcgcttcccacttacaggtattattggaagacacttcaacaattacttatattatggctgatacacacatctgagaaggcataatgaacagaataatggggctgagttcagtggctcacgcctgtaatcctagcactttgggaggccgaggcaggaggatcacttgagcccaggagttggagatcagcaagacctcctagcaagacctcgtctctcaaaaaaatttttaaaaatattagccaggcatggtggcatgtgcctgtagtcccagctactcagagggctgaggtgggaggattgcttgaacccaggagttccaggctgcaatgagctatgatcgtattaccaccctccagcctgagtgacagactgagaccctgtctctaaaaaaattatttttaatgaacatccatatacctgctacccaacttaattcacagaatattagcatggtgatgaaagccctggtgtaactctttctggttgcatactccttgctccctgcccagtttccctaaacaactgttattctgaacttggtgtttatcatgtcagtgcatatatttacatgttcactacaatacatagtattttgagtgtttttaaatattataaacatgcctgctttctaaattcaatatatttgagatttatcttctaccttgatatatgtagctttactttatgttctttttttttaaaaaaacttttctatagtattctctttcgttgatagacatcaaaagttacttcagaaatttaaatttttgtgggagtatttatatgtgttttatttaagccaagagtcatcagagttcaaagtcttattttaaaagttcatgttcatcttacttaagtcaaaaataatcagcatttttattttattgtattttatttaaattattatactttaagttctagggcacatgtgcacaatgtgcaggtttgttacatatgtatacatgtgccatgttggtgtgctgcacccattaacttgtcatttacattaggtatatctcctaatgctaatcaacatttaaaatgaataccaaaattgagtatcggatcttgactaaatgattcttgtattttctgggtgatctttagttggatttttgcattaaaaatatgaatcatggctgggtatggtggctcacgcctgtaatcccagcacttcgggaggctgaagcaggaggattgcttgagcccaggagttcgagaccagcctcggcaacataggagaccccatctctatattctttgtttttttttaattaaaaaaatatgtatcatatacattggatggctagcatactgttatgtttaggtgccagtgccaactggaatatataaataagttctgtaccaggtatacatcctaacttaaatagctatccttgaagctttaaagaagagctttaataaaaagtcctaacacattgaaaccaatttctgctttaaattgtaacttcatgttgaaagttgaacagcaattgagtatcacacattgccatatgtcctgttttacaatttttggtgttttctcccctcaaaatttcacatttttaggtaaataaagttaaacaagaaaagactgttttaaattcagaagttcttgaacagagaaaagtcttagaaaaatgcaatagaggtaagtctgtccagtctttttttctcaaatacgtatgcggtgtgttctgtttgcatatattgtgtgtcattttacacctgtgcctaaatatgactgtaaataaaatcttctcctatattgtgattttctagcattgtgtctctcccatttccattgttttattacccaacttagagtctggggacatctaaaagtgatttcacttgaggaacaaggaacccactcattttgaaacttcaaaccgaaatactatttctgtcttacatatatccagggatcatggcctttttagctctcccctcagcatttatatgtttggtaggttatttagtaaatctcaatccagaagaggttaggctgtctacataaaacatgtaacattatgtgatgaaattttaaattaagaggatgtggaaaaagggataaaggaaagtaagagttagattggtatacaaagtgcatacttgttctgaggtcttgcacatttcctgcctgtgtgtttgaaatctggttctgagctgtctgacagtcagtgcaataagagattgatgatcatttaaatgaatcacatgaaaatgaacctaatgatcaggaaaagcagacctgctctcctggtgagagggaagtgtctccagtggctatatccagagaaaactttgtgtactttgggcaacagtgactttatccatctagttataaaacacagcatcagctctcatcggggctgtttcatgtatctcccagtttaagacaaggaagtgatgccaaagtgtagttctgcaaaaataattctggaagtggtaagaagaacttaatatactttctgttctctctttttccctcagtcactctctttccttgtttagaagctgcaacactaacaggaaacctttgcgacccagggccttccctattgttattggtggtagctgtcaatctttttgtgattcatcaactgggaattttttttgtaaataaaggaccttgtagttaaatgtgggcaatatgctggattgtaacatttctccaagtctttctgtatttaaagatagaaatggtgtagaattttcagtcttgattcactgtgctaggaaaagggttctgcaaggattaatcatgtagatcttgccttcagagagtcccctgtctaggaagagagaaaaattatataaataaatacctgactaggaccaacctgatttctttcagattccaagtcagaagggccaggacacgtgaaaattccctttttattatagtgttctggacatagaaaagagagtcaattatcttgcctgggccttcagatcgtcatagtgttctttgttttcttcatgaaatttcttgtttaaataggcttgaaaatcatttagctctcagggacctataattcacaccaaaaaatcaccactcttattgctttacttattagtctttcatctgaagaggctgtagattgagtacagagtttgaaattctatgtcattacgcagcaaaccagtccttaagtcagttaggattgaagtgccctggtggagcagtgtgtgaaggcagctgttaagagagccttttgaaagattttgttggtatgactcagctcagggtggaggtgactcaccagaagtggatggacagtgtgctgtctgcccagcttgtgcctaatatctaatggtatcgtcactccctctgtcctgtcattatcactatttaacaaaataggccactgaatgttgaaaatagcaaagaatttatattacttttatttgacaggaccttttgaagctttcggtcttgcagtaactccttggtacaaagctctgattctttggttctgaatgcatctaaggctgtttctctcctttgtaaatatggagaacacttaaaaataacttatatgtccaggcgcggtggctcacacctgtaatcccagcactttgggaggctgaggtgggcggattacttgagatcaggagtttgagaccagcctggccaacatggtaaaacctcgtctctactgaaatacaaaaattagccagatatggtggcacgcacctgcctgtaatcccagctactcaggaggctgaggcaggagaatcacttgaacctaggaggcggaggttgcagtgaaccaagattgcaccactgccttccagcctgggcgacagacatagtgagactccatctctcaaaaaataaataaataaataaataaaacatatatatatattatatatataaatcattttatatatttatatataaatcattttatatatttatatataaatcattttatatatttatatataaatcattttatatatttatatataaaatatttacattttatacatatgtatatacatatacataatttatacatttatttacatttaatattatatataatacatatatcttttatacataaaaatgtatatattcaggtagtatactttttttggtggaaaatttagattcatgtaaggaaagaaaaaaatctcaacctttacaatccagagataagcactagtaccattttagtgtatattcttccaatcttaaaaaaaactctctctacatatatacatattaaatgttttgttaaatatgtttatatatatatttatatatatatggaagacagaggaaataccagtaaaaggaatctctttatacttgctggtaccttacaaacccatgaacatccctctctactcttacccctcccttgaattcttattatttcctttctttcatttgcagttttgccaaatatgtctatatctctaaacagcattgtttaattttgcatatttttgaactctatgtaaatggaatcatttttcctgtaaccttctgcaactttttgtgtttgtgagattcatgcatgtggacaggcatagctgtggtatgtttgttttcactgctatatactattccattagatgactacactaaaattattttaagtagtatcctattggtagactttgggctgtttccatatttctgctattctgagtcatgctgttataaaaaatgttagacatgtcatctggtgcacatgtccaagagttgctttaagacacatgccaaatgtcaaattttatcttcagttttttttcactgcataccaaatttaataaaaccatgctttaaaatttttaccagttgcctcttggatgggtgtaagaagtgtttttactctgcatttccttgattcctaatgaagatgagcatctttccacatgtttattggccttttgtatattttctattctgtgaaatggctgttgatgtgctttatctgtggcttttaaagaacaaaaatgaattcactttgcactaatttttgcaatctatttttaaaaatacatcacagatgtctttccatttactaagtatgcttctacaatataattttgatggcagaataatatttcttgtactacaatttactcattcttctgtgttagagtattatgtcatttcacttttatcagcaatgaggtagagagcatccttgcaaccaaatgtctgtatatgctcatgtgttacaatcttagcatatgcattcctggaagtgggattattcaaagtgtatgaatagttttagatttttgattcacgttgccaagttgctctccaaaaaggttttatcagtttgtatgccaaccaggaatgcatgagggtacctgtatgctggtatgaaaaatcttttcaacactgtttttcatccatattcctgattatttgtgtgacttattgtctgggttttttttttcctttatcttcttaagtgtccatgttagctgtagaagagtatgaggagatgcaagtaaacctggagctggagaaggaccttcgaaagaaagcagagtcatttgcacaagaggtgggtatcttgtaaaaatcttattttttttcttgagacagagtctcgctctgtcaccaggctggagtgcagtggcgcaatctcggctcactgcaacctccgactccctgattcaagcgattctcatgcctcagccccccgagtagctgggattacaggcacacgccaccgtgcccagctaatttttgtatttttattagagatggggtttcaccatgttgaccaggatggtcttgatctccttatctcgtgatctgctcgccttggcctcccaaagtgctcccaaagtgagccaccgtgcccagccgtaaaaaccttttgaatttttgttttgtaagggaccttgcagacgacatatcagacaaattcttgaggttgaataagaacttaccagtttgaattaaggatctgctggtttagggaggcagatatagaatagtatcaagttcattgtcaaaagatctgggctcaaattttggccatgtcagttactagttgtagtagtgtatgacctctgagcaattcttcagcctctcagggcttcacttttaccatctgtaaaatggacaataatacagacctgaccaagtggattttaatggcaaaatttaaaaaaagtgttgtataaactataaaatgctatgtaagggaaaggaattgcatttggagacaacccatgacttgtgatggaaagtccaacttgggtacaagatgcctgtacatttcaaataggcttaaaatctgggatgtatctccatataccatctcagataacagtattatggtatcagtatttctcttcagccattgtgcagtgctgtcattatgccaggaagttcttccactggctgtggaacactgccatgtagtacattcattatctcagcgtttcaccagcctactgatcttcctcttatgttagagatcagctttgaatctcttgttccggcttacctgttgacatgcagtcgttgggtcttccatggccctggggctcatccagggggatgaggagttcaccaatgggctaaactcaaaagctggtctgcaatgagatctccatcctgtgggtgtagtttgaatttgtgtgcatactgtaggttgaaggaagatagctcaggaaatgtaaaacagtcctaggtagaggtatccaaggcatagaaggaagacaaagcatggcattaggggaatgacatttgaaaatccaatgatggttttgtgggggtctttctgtgcttgagcatagctgtgctagcagtgaactctaccgaaggtttaggccaagtagatctgatttgaaatattatgattcgttttatttagagagtttaatgaaaggtgagtaaatatttttctcttattacttggaagaaagaaaaaagaattgaagtgtgtcagagctctctggaaaacgttggagcaatataaataatgcagtgaaataaacagtggagggggaggggaagcagggataatgtgaagatgcctttattgcaaaactggaaaggtcggctgattttgacctgaatagcaggtctcatttcaagacatgttcagttttccatctgttgtttgcacaatgatgttagaatacaaagcagctcaaagaaaaacttgaaggccatgtggtagcagagaagacagatggaagaagcaaggttgcagtaagaagacaaaaatgaatgattgactctgctgttcacctggtcttcagtcttagtggttggtggaaacaataatgctgacatgttaacccagaatgagaaggtagaagtttgaggagagaaagaaagcaagagcaatggtacttacgttattggcagcataaatatttgcagtggcactcaacaattttacaatatctagattcaatctacacaatagtgagaagaaaacttttttttaaaaaatagcaccacgttggaactagtatattttcctttttacaaagtttatgcattctcaggttttcaacaggtaagtactgcacaaagacacataacttagtttaacaacagagtcccattcttttgcattttacttaccacttagggcatgcagcaaacatcttactgtgccagacactgtgctgacattgggaatccagtggtgaagaaagcaaatgtgagccctaccctcttggagcttatagtctagagccttagaaatcaatttttaaggttaatttactttatatttttaattaaaaaggagtatgtgtgccttgcacaaagatacaaatattttctaaatgtataaaataaaaattgaaagttaccccccattcttaactcccgctagttcatttaaaaaacaaaaccaaaaacttaatccccctcaacaagaaaactatcagttgtcttcataactatattaaaattttaaatttcttcaacataattaaattttttgaccaggcatggtggctcacgtctgtaatccaagcactttgggaggccgaggcggggggatcaattgaggccaggagttcaagaccaacctggccaacatagtgaaaccccatctctactaaaaatacacagattagccaggcatggtggcaggcacctgtagtcccagctacttgggaggctgaggcacgagaatcacttgaacctgagaggcagaggttgcagtgagccgagattgtgccactgcactccagcctgggtgccagagcgagactccatctcaaaaaaaaaaaaaaattactgtaatcataatggtcacccaaaacaattcattttaattaaatcactggtctgaagtttaagatactgtgatgaaatattgattactctttcttagaatgctgaagctgcatctcacccttctccagccaagtgtacatgcacatactcttcctcactgcagtctctatacctctcactctcacacaaatggaagaagaatgtgggtttcatgtatatgcaattgtttatttacctgtttgactttgtaatgtgttttaattctgcagaagaaccctgtcgtagttttgtaggcttttcataaatccctaggcaaagaaggaaagcttctgacctttttttccctttcataggaagacatactgggaagaaaatgttagtgttttagtatactgtattcatgacttgactttgatgtggaagtcgatactgatcaagagcttaaggattgtataaatcattaaagctgtggtcttgccacatggaggttgatggaaaatatttttgtcctgagttttatttgctgactttttctgttacatgatgggtgaagttgttgaacaaactaatatgagggctttagcaaatcattttgcagttcagagctttcagttaagttataatgtaaattttaaaatgctgttaaaaatctgaaaaggtgaagctctattataaaattggtaggccagatttcagagtttacaaaaacatttcatacttggaatcactcactggccaaattgggtagagtgttaaggaaaagaaataacaggtaaatagaaatcaatattattttcaatcatgtaaagttgtgaggatttgatgaataacatataaattgcttaatacagtgctcaataaaatatactgtctcccttctcccctttacccttctactgttaactacttttatcactagggagaaactaattagtttaaaacaaaacattagatctagcaaatagtagaggaacttagccagatggttaagagcttgggcatgtaaatcagatatgggtttaagtcctggtcttgtcacttacgtgtgttcttgggaaagttgcttaacttctttgagcctcagttaccttattagtaaaattagatgatagtagtgtctacttgatagtgttgttttaaggattatatgatataatgaatgtaaaatgattcccaccatatctatcacatagtgtttagtaaatgttacctattcatagtagaagcactttaataggattgatgtaaggattaaaataatccatataaaatatttagtggagtacacaaggtaaattcttgagaaatattagctactactattaatattaatgtatcttaaagcaataataaaatattaaaaactgaagagtaagaccagcttattgtataaatatcttgttggggcaggagtaaaggtattaaagattatataaaaggaatgaaatcatagcaatcactacttctaaaacttatagaagtcagaatttgcctttaatgatttaataaaaattccatgtacttttcttttgctgaagttacagttgaggaggtatgtgagattgattgatatatacattcttgtaacaaacttttgcagatgttcattgagcaaaacaagctaaagagacaaagccaccttctgctgcagagctccatccctgatcagcagcttttgaaagctttagac

SEQ ID NO: 11949 - DNA, 270 bp, Homo sapiens
agattgaccaaggttgaaatgaaggaaaaaatgttaagggcggccagagagaaaggttgggttacccacaaagggaagcccagcagactaacggtggatcactctgcagaaaccctacaaaccagaagagagtgggggccaatattcaacattcttaaagacaagaattttcaacctagaatttcatatccagccaaactaagcttcataagcgaaggagaaataaaatcctttacagacagacaaatgccgagagattttgtcaccgcc

SEQ ID NO: 11950 - DNA, 1621 bp, Homo sapiens
gtcacaccgctaaattatgaaagaaataattatcaacactttctaattacctaacaaagtaatttgggattcaccgtggggctggcgggatggggaaccaacatccacttacagccagggtggtgtacgccacaccgcgagggactggctgtattggtagtagtggcgatggggtgggggctcttgtgcacttttttgtacctagcaccccagaagacagaaggagcagcggcagatcttgcctccactagccctgccccctaggcctggtggcgcgcgctttggccactggaggtgaggaagatcctgggtggcaacgagagacgtctacacatagataagggagcctaccacaggcctgggtttgctgcgggtttcggtgtcccccagggactcctaaactctggaagtcgcgctagacctcaggaggccggaaaatgaccacctggcgtcggtggctccagcagatctgagcccctaggccccctgggctccacgctgagccgcgctctcggggcgagtgagcccggggctctccgcgcatggggagtggagaagggagggggaggaggaggaaggctgggagggaaagaggatgtgtgtgttgggggagggggcggtgcagccgcctttcctgggaggagaagcgcgggttcctggctctccacgcgcactgctttaatcagacccgtgcagcctcgagctggagtggccagctgggcctggagcaatgcgagcgggccccagggagcgacagcggcgttggcgcagcggccgagtgagtgagttcgcagggagggcccctaagccccgactccagggatgcggcagagcgtaccggggaggcgcggccggataggcgctgcgctaggcacaaggctcttaggagaacctctgtctgttggccgcctcgggcgcccccagtgcgcgactccgcgctccagaggcagaggtcagtctcctcctgagccgccctagctctgcgccgaactgagtggcagcgacgagaagcggtcccgggtgtccggtgttagggaccgctgaagggtggggacagtggtaggggggcggcggcgcggagccgctggttggttcctggggaggaaagcgcgcgagggaggcgggaggccgatgagccgcgggccgcaggggccccggcgcagacgccgcagcccattgtgcttcctgcccggcgcgctctgttgcagaggagccccggccgggaagtgtggatgcgtctctcccgaggccgggccgcctcgcccgctctagtccagcggagcccgagcgcctcggaccaatccccagtgattatgcaagacagcggaccaatcagctccgccagctcatgaatatttatgaccttcgctgagtcaaagctttgaaccgagtttggggagctcagcagcatcatgcttagacttttcaaagagacaaactccattttcttatgaatggaaagtgaaaacccctgttccgcttaaattgggttccttcctgtcctgagaaacatagagacccccaaaagggaagcagaggagagaaagtcccacacccagaccccgcgagaagagatgaccatgaccaccatgccagaaagtctcaacagccccgtgtcggg

SEQ ID NO: 11951 - DNA, 4937 bp, Homo sapiens
tacacactcacttgttgtctaaaagtggctttgtttgaatgctgtacaaaggtaaatgactcaaacgactgtgttggatagatatgtaccttctctcttcatatatccaaagacagtggttgcaggcaacagcaaaaattaaaattattacagcataatgaaaacacatgaatgttattatctgactctaaatattactgactttttctttttcagagaatattttaaagtgactttgttttatcttagtatgcctgaaaaacttatctaatttaattaaatattttttggtcacttttaaagccacataactcatcagaatggttttcaagtctgtccacattttgtgggacatggaataggatcttactttcatggacatccagaaatttggcatcatggtaagaaagttcatttggaggctgtttcttgatcagagatcaagatgtggcagctttgaccctgaagctcttcctctgactttgaatctgcattatcaaccttgtgtttgtgtgtgtgtttatgtgcagggggcatgggaggggggtctgcttaattttaaccgggacattactgtgttactggattagagcccagctgtttcaatcccaaaataaggtttattttgctctctgtcttctcctgaagggtgcatggctggaaggcacaagggatgtttgtgtagaaaaagttactgaaaacaaaacgccactgcatcagtgtcccagcagcatgcacatatgactgtttctgtttttctttttctacccccttttctagctgctgactgttgtggttaaacttcattacatcctacacagcgttgacagctgatgtatttagcagcatgtactccttcgtgatttctagattatgcccacccttgtcttccttccccagaatctcttgtttttcactgcctgggtgtgcaccctatagtgagaagacaggggtgggcccagaggggtgggaggatttggattgaggtaggaggcagctcagtggagcaccctcaaggcaggtccacacctggacggggatcaaaggaaagttggtcctggggccttgacctgtgcccctatggacttgattggtccatagaaggactactctttcggacccatgccctcgaggatcgctggacacccagcaggtccaaaccctctttggaccaaagagcccccacctaggcagctcaagaggttcaggtgagagtgcagaaacggcttgtcagccttgtgccctacctggtgccaatgtctggagtgaagctatttgaagtcaggcccctgctccccacaacctgcaccaaaggaggcttccctcctttgcatccttccccaggacttctttgagtgaggggtgtgggcaaggcccaggacccagtagtaggctgggagacctagtagcctgggggacagggagagggggcgaggaagcctgacgtgtctgaaacaaccaggctgcccctgccaggccttggaaaactcttctgggggagtcttgacccagagcacagataatgcaaagactcaggcccagtagccccgtgtttaactcctggtcactatccaggactccagaaatctccacccttccttctctaaaagaagagaaataaaacgaccaagttttttaaaggggcctgacccctgtaatctgttttttttttctgtcctccccatttcctattctcaccccccatgttttttgttttgcagcaaacgacagtgatctacccatggaggagggcatggcattcactataggtaaattgagctcctcttccgagtgagtgcgtagctcctggtggaagcttttgccactggcctaggcccggcagtccggtgaaggaccaataaagccaatcagtgtaatgaaataattcggatgcactggaaatctgattaaataatatcctcaagccccatcttcctaaatcagatacttaccgacacatttaggagaaggcagccatccaacctctaattctgttaccagcataatgtggtgttgggttttttgttttgttttgttttttcattaacacccagtaactagacacgattatgtcccttgctccctgtcagcaagtggcatgtgctctctggtggcccgttcctggctgatcctgtgattggtatcaccaccaaattccagtcacctagggccgtaaagacatcctgtttctgactgtgggacttaatggagaagcaattagagtgaaataagaaaattgttatttgctgatgaatgaacatctcgagcatgtttttaaaatttaaatatttttttaaaaattggtatttataagagggactggtgtttgggtggttattatccacggggtcctaattaaagcttgattaaaatgcccttctttctctaaaaaattacgaactaggcaacttcatacattttgaatggctcagtgtttcctcttccaactgtttagtttgtagtatactatgtaagcaacatcaattatcaacccttgcaagatgacaacatgagcctgtgggggaagcacttgaggggagggaggagaaacttctcttttttaataatcagccggaaacaatgtttaacaagaatctgatgaggtcactgcagtaaatatttttcctcttacagagccaatcatcacggagggatcccctgaatttaaagtcctggaggatgcatggactgtggtctccctagacaatcaaaggtgtttgctttctgctctgttgcttttaaattgtatgggaaaggaagattggtccgacggcgcgcttgtggcccggccggagcttgcgtgcgcgttctgacggctgggtgctgtgttacaggtcggcgcagttcgagcacacggttctgatcacgtcgaggggcgcgcagatcctgaccaaactaccccatgaggcctgaggagccgcccgaaggtcgcggtgacctggtgcctttttaaataaattgctgaaatttggctggagaacttttagaagaaacagggaaatgaccggtggtgcggtaacctgcgtggctcctgatagcgtttggaagaacgcgggggagactgaagagcaactgggaactcggatctgaagccctgctggggtcgcgcggctttggaaaaacaaatcctggccctggactcggtttcccagcgcggtcaacgcatctggaggggactggaggaaacccccttgttggaagagattccaagagaagcacggttttctctttcccttgccctgactgttggagtaaaaaacctcttaaatccattgtatcagaggtccttacctctctgacagttacaatgatctttgtatctgaactttgcacgtctgccgaaaaatccgaacctgttgactgggatttttaagaatccgtttctcccttttgtgtattccatattggccggccccaaggatgctcgcagaagccagcccccaaccccagcccttccgtatctttcccctccatcgcggctttgcgatgaaagattagcccgcgaacagaggcattgattacaaacatgtccttggcagtggactctgggcctggccattcttcaggtttctgtcaatccagaaacgcgactttcctggacccctgcggctcttcctcccccgcccacatccagccctccaaggccagtccagaggtgaagtttgaggccctccccccacccaccccacacgcacgcacgcacgctagaccgtttgctgcactaggaattcgagcttgggccccactcgcccaggtgtgaacagtggctgattagtgggcggtctagtctctaaaatgacccctccccagactggcccttctcgcatcgggacccgcgcttgcacgctgcaggagccgcaaacgtcagctgttctggaaaccgagagggtcccagagagaggagatacgggcgcatttgagagcaagggcctacttggccgggactgaagcttgcgagttgagctccagttcggccggcagttccatcccgcttcaggaacaggaatccaagggcccacgctctgtctgccaagggccattcctgcccggagcaccctcctttcccttgcgcttgctctccggtacctgttccgcacctgagctcaagggcagggagaggccgggcctctggcagtccacgaaggaagccgtctgccttcggttatgattttaggaacaagtccaacgagggtgttcaagcagttaatggttgtgctaactcttgtttctactgaagcgggttttgcaaagctgacatcccttaaagataacttgggctttcggaagcggcaaggaaatggcacctgtagttgccaggacaggtggtgtcctcggccaggactaagagccagctcatctttgtaacattcataatacgggaaactgaggaccaggtggctcggaaaagagatgagttccagcttttacctaacacagggttctctcgtcgtcccccaacccctccagctcggcttctttgtgtccagggttgtagatttttggatagaggtgtttctgattctagtgagtctgagaactggaaaagaccaaggaggggttgatgatttacaaggtccatagaaaaactttttgtgtggtcggaagttggccaagcagaggcccacagcctgatgctactgccccccacccccccaaagatctgaattccctaaagatcaagagggttcagctggccttgggagatgtttgctggagaatgacttcagttttctcctaaggcaatcagattgcaaccattagcattgtatcttatctgcaaatcagtttactccgaggttccccaaggatagttttattaggaccacaggactttactaaccactgaggtaacacgctgcttgtgcagcaattattttgaggtggaggtatttatgggacaagtttataattccatttattaaagggactaacctaaa

SEQ ID NO: 11952 - DNA, 4334 bp, Homo sapiens
  misc_feature (3714)..(3714): n equals a,t,g, or c
agttctgtcaggccaagcagaaggcagccttgctggagctgctgcatgaactctacaatttcctggccatccaagctggtgagtaagtcacgtaagtcctgagattcctcttgtgagagctatgggcggctgacccggttcatcaggcttagttacactgctgctggccagcgagacactccctggttgtctctcagaaggcatattcagaagccgagtctcaccttctcgcctcctcactcaggcacatcttttataagccttgtgtttgaacaaaacatatttgattcttgctcctctttaagggaggtcctggcatgtgaacaggccttcctgcagctgttcttccttcttggggatgcccactacctaatgctttgggggtctctgttggcatgggaaggggccaagccccaggtgttgtcaggatctgtgtccttcaccctagagggaccctctgaaccaggtggttggctgggcccgggagaggcctcttgcctgtgcaagtagcagatagtctgtgtagtgggccctggtgtcacatctggtcctgatcaccatgtggctgtgggacctcggacaaagtccctgatcctctcagggtcttcatctccctgtctgaccaagggctcttgggtctgtctgttctctacaaatgagagtcaagtgctgtcctctaaaggagggcattctcagcacctctgtgaaatgcccctgaaaatgcatccagaagatgcatcccctactgttttatttggtgaagttattccttgaggccagagataccacctgcattattatgtcctgcccgacgcctggcatccaggaggctctcaaaatcacttgcagttgacataggtgaatatcagcatgtgcgccttgtgttaaatgcgctggacacaagaaccagacagagcagttctatcttaagggatattcaagaggcgcctcttacctgtggggtcagaggacaggtcttaggattgtgaggtcaacccttgtctaaggtttcactgggaaattagggtcgggtggacttctcctgggccctcagtcctcagggtcaatctcatgagcatcagctcttctgcctcctccctcttgaaagtgagagatgagatggtaggggaggcatccatgagcacttggaggagaaacaggtactggggctcctgctcacagcatcataggaattcctctgtacggcccaggtgcttgggatgtcaattctgacctaagagagtgttccaaacctttgtgtctcaaatgtggtccaaggacccatagcatctgcatcacgtgggagctcactagaaattcagaatctcaggtctcatgccaaacccagtgaatcagagtctgtatcttaagatccccaggggatttgagtgcaccctaaagttgagaagcactgctcgaaattgggtcctagtagatatttctcctccatcctaccctccatatgtggtcttgccttatgccctcaagggccctggcacctgttgccctccgacaagcctggggggccgccttgaaggtacatatctcattgagacaggagtgtgcctcacagaggctccctagtagtcctcaaccccttccatgcctctcctgttagggatccgctgtgggctgggcactgtgcaggcccttgcagtgagatgactcagctccaggtcctgcctgcagggcccaaccccggcttggggtctactggaagagacaggccacctacctccctgaccactgggtgatataaaatgtgattagacaagaaccaagaggccagaagttctgggaggcacaatgccttttagctggagcagtcaggagagcgtcacaggaggtagcatctgtgccaggccctgaagcccaggtaagactggttacatgtatgtggggaaggacaaggcaaagcggcaggaaattacatctcgagtgggaagcagcaccttcatggaggaaggggaagatgagagaatgaagtttggaagtgttggttgggccctaccatagatggccttggatgccaggccaccagagcttgatctggcaggcagtgagggccagagaggctttgagcaagggagtatcatgctgagagccaggtgccaggaaggtgaatgcggcagcagcttgagtagcacagttaagcagaatcattttcaagtgttattgacaaaacaactggattgggaaagggagaggaggaaccgaatcgagaggccatctacgtggtccaggcaggcctggcaagggcaggaagagtcctagtgggaaaaggaggatgctagaagccacctgtgtctcaggggacccctggggtcaagatcaactttgaagtaggaggatctggctgtgttaggggaaggcgacaggcttcagttcagtttcaaagttttaaaatatgaccttcagctgctcccttccccagcatgcagaaacacactcactggccacccgaagtcccccaggctgtgctgggtcagggcagtcaggccacgcacacgtgttaaatagtgtatgcgtgcgtggccctgcaccctccctgctctcggggagtcaggcaaaccacagcacaggagcgaggaccaagggctatggcaggtcaccaaatctggggccatttcatcaaacaaaaggcccccaggggctgagggcttcccaggggagatggcccctgggctggaccggggaggttgggcaggactaagtgggaggctgcccagctccattcctatgggagcaggccctccaaagccactcgggggagctgccccttggcgtgctgtgctgaggccccactgcccagcacacagacatcctcttcctcctaggggcccctcaagacaatagacctggcattccaggtcgcctgcctgtgtcatgagtcagaatccccgtggtgcccatggcctccctgcctttcttttttctcaggctgtgtttatttatagtgccattccggtaccttccgaagctatctgtctgattcttttagggatcaattgcaaagagaccttgctattgggcagctttttagtcatttaatgcaaaatgccacactgctttgcaggtcaggttttaatgatctggaatcgatccaagctaagtggcttttgatcttgctgcagagtgaagatgccccacagaagccaggagccgctgggcaacatgctccttattagagctgatggcttgattcttgctgcattttttagtctgtttcagagtgatttttcctttgtgtttgagcatgtgtggttttttttctcctaggtaattttgagtgtggaaatccagagaatctaaaaagcaaatgcattcctgttatggaagcccaagaatatatagccgtaagtaggcttcagtgcttatacattcctgggagggcctggtgctttcctattggtctttcaagccctgttggggtttttgttttttgtttgctttgtggcttttgtactaggctaccttaagtaaaggtttggttaatggctttttgtgctagactaccttcagtaaggcagccatggtagtgactgccccagagccaggccgccatgtgcagtggggcggctcactcctgactgctgcactgtaggtgtgcctgttacctgcttctcccttggttcactttgctcgtcttgccttcggctttcaggagaaacatgctgtcccttctccccccgtatgattaccattcagactgcncaggggccgtctgatttcctgtgtggcctcaggatggtagattatagaactatggagctggtattccaggtcgcctgcctgtccagtaacttaggggtcatctggttccatttgcatttcacagatgaagaaactgaggcctggagagggtcagggacttgcctgaggccagaccacttgcaccggccactgggctcacccacccccagccacaacgctgttattcgctttaccctaagatgagctgccagctctctggcctgatgcttccatcctcgagagaatcatattcttttggccgcctcagacccgcactgttttcctgcttgtgcttccgcatcacctcctctggttatagcctcttccttggctttcatcaacccccgatttccttcctgccactttgctgtgcttttagcagaacagggttttggggctgtggaggacacgggagagggcttccttaatccagcagcagaataatgttccagctgctccgcccagacgccgaactaaccttctcccgcgccctcccacagaatgtgaccagcagctcctccgccaagtttgaagccgcactgacctggatactgagcagtaacaaggacgtgggcatctgg

SEQ ID NO: 11953 - DNA, 499 bp, Homo sapiens
ttttctgcacttcccctcctcgggagctagtttttatttgtagatgaaattattctttctgtatgttggttttacttactatggaaatcgcataaggaaatactggattttattctgaccaggcagtttctgcctcatttttatcactggtgagcactgttagaaaaggtagcaaaccctttcatgaggctgaaaggctgtatctggcggctcagcccagggggaggggcgtgtcagccaacagccaggcagccttgagagacctgtcccctgctggcagagcagcatcacttccccacttcccactctcggtgtttgtgggggtctctgttcaggttatagctcttgatattaaaacgtctctagagttttgttcttttcctctctaatccacccaaattactaattccatcagcactgcatccagcagaagcccctcgggcagctccacctcaagctggataactggatgcatggcacgattaaaatttgttggctt

SEQ ID NO: 11954 - DNA, 977 bp, Homo sapiens
taactttctgtaagacttctcagtgctgttagttttgtcttttaattagaaaaaagttccatggtttctatttcttggtccttcacatctctaaatgaatcagacccacaagtgaatggcacatttgttccctggccttctctgatctggacacactcaggctccacttgagtgagcccagacaggtaccctccaggtcctagctacagatgcgctccgtgggcagacggcattcagcacctgccagcgagggcttcagacgcagatatccctatttgtaaccattcagaccttcatcagagcatcagaaagcaggggctgggccatctcaatgcaggctttgtggagctaagatttcatggggcacccttggcctttctggagggtggacacaggaacaagcaggtggggacgtgtttcttggctttggtgaggctcttgctgaaagtcttattctttgcatggctccaggcttaccgagatcacagacgggcatttgaatttcagattcatgttctttcccttttcggtcgttgaagacggtgacactttgtgtttttctttctgcctttgtgctgctgaaaacgtggggacaggctgggagtgggtgtgttgtcttaatcaggccgtctcgttgtctggtaccgtctgtcctcctgtttcctttaggtggtagcagcctctgctgagtggtttgtgtgagttcgcactgaatcctaccacaatccttactcagatgagggctctgagattccacctaacgggagacgagatggcagctgctgacattctgccctgtctgcaagctctcctagctcttccagctctcccatctctgcaaactccgacagcagttgctcttcctctgaggaagctgagcgactgcatcatcccccgaccacgtcgcctctgctcagccctcttaatggccgtcattccaagggaaaggcaggagccaggagcctctgggatgcagc

SEQ ID NO: 11955 - DNA, 864 bp, Homo sapiens
gaattcattagtttaactggccaatacttgttgagtggcttacaagactatagtagttaaaagcatgagttttgttttatcacttaaatcctggcaaggacttattaaccattcgactctgggcagggttacttaatatctctgcctcacaacattttccgtatctctaaaatggggttgttcaacaagaaatatactcaagtttaacatggcaacaatgttcaccaaaatcactaccagtttcgtctttggtctgtctctggcattgcctatttcaacacgggcatgatcaatgtgcatgatcaatgacaatgtgatagcaagggtctccatcatatcaagacattgttacaatgtcagtaatacaaagcagtttggaatttattgttaataacataatattcacttccaaaaacaggtaagcaatttagatctaatctagggtgaaaaaacctacttatgggctttatacattgaagatgcatcccttagttgaatattatgacagaaaaatgttatcaatgctgacattaaaaactgttattatgtgccaattattaggaaattttaaataatttaacaggataagattaatagttaaaccgaacactaagaaagagagtattagctacttgacgaagaacattgtatattttttgagactatgaatttttataaaatgtcaaataatacaaagcaaaatactactaaaatgagatattataattctcatctttatggaactgcttagttctcatactcataacatatataaaataataattaagaattacagaggccaagcatggtggctcatgcctttaatcccaagcactctgagaggctgaggagggcagattgctc

SEQ ID NO: 11956 - DNA, 864 bp, Homo sapiens; identical to SEQ ID NO: 11955

SEQ ID NO: 11957 - DNA, 864 bp, Homo sapiens; identical to SEQ ID NO: 11955

SEQ ID NO: 11958 - DNA, 630 bp, Homo sapiens
aagttccgggatacatgtgcatgccgtgcaggtttgttacacagggaaatgtgtgcgtggtggattgctgcatccatcaacccatcactgaggtattaagcaccacatgcattagctatttatcctgatgctctccctcctgtggccccgccccccgacaggctccagtgtgtgttgttcccctcccaaaggtatatttttttacctggaaagtaaaaaaggtaatttactttataaactcaaacaacacttatcaaactcttccagaagcatccagttcccttgcaagttgtatttggttctactttttgactacaggttacaaattaaacatcatcattatgaattatataattttatcttatataattattattaataacaactgatgtgccagacactgtttgaagtgctttacgatgttattcaggttctcacaaccaccctgtgaggcatgtcctattatcatctgagatgaggaaactgagaaacagaaagttaaggtacttgtccaagatcacagaggtgtgaagcagagaggccggggcttacagccatgcagtctggctccagagcccacatcagaaacactccttaagcccaaagcctgagtaaagcacgtgaggactt

SEQ ID NO: 11959 - DNA, 630 bp, Homo sapiens
aagttccgggatacatgtgcatgccgtgcaggtttgttacacagggaaatgtgtgcgtggtggattgctgcatccatcaacccatcactgaggtattaagcaccacatgcattagctatttatcctgatgctctccctcctgtggccccgccccccgacaggctccagtgtgtgttgttcccctcccaaaggtatatttttttacctggaaagtaaaaaaggtaatttactttataaactcaaacaacacttatcaaactcttccagaagcatccagttcccttgcaagttgtatttggttctactttttgactacaggttacaaattaaacatcatcattatgaattatataattttatcttatataattattattaataacaactgatgtgccagacactgtttgaagtgctttacgatgttattcaagttctcacaaccaccctgtgaggcatgtcctattatcatctgagatgaggaaactgagaaacagaaagttaaggtacttgtccaagatcacagaggtgtgaagcagagaggccggggcttacagccatgcagtctggctccagagcccacatcagaaacactccttaagcccaaagcctgagtaaagcacgtgaggactt

SEQ ID NO: 11960 - DNA, 1490 bp, Homo sapiens
aaagaatgaactgtttatgaaagaaaccttttgaaagacagaatatttttgcctgtgggccaaagctgaggcaggaaaacaaagggctctttcaaaggcttagaatatgatggaggatggattctgactttccaactacaaaaataatgatgcttttagcatcaatacctgcattactccagggagttgtaaatatactttacagacacaggctgggcctttccaactttttacctcagtgctctttgaactccttaaaggggagtaatgttggccccaatttgcacactgagaaactgaggcagaagaaatctaagcaatttgtcccatgccaccagataacttataagtgaagtcaagaatagaacaaactgaaactgaatgcttccatgacacaggagcatctgccatctggaatagttccttctttttctctagttgatctctttcttttctgcttttatctttcattttctgattcattaactcttagctcttgtcaatgaattgaggccagtgtgagtgttgacatgtccatcagaaagtctgtgttggtccaggtgacaaagaatctacagcttgtatcagccagcctgtgcaggttgttgcagttcctttgaacaatattactagcaaaactcatcttgaaaacaatattctttcatcctaacctattttgtacttccagaaacactactgtaaagtacagatgctccttgacttacaatacagttatatcctgacgaacccatcataagttgaaaatatcctagttagaaatatattttatgaacctaacctattgaacatcataacttagcctcacctaccttgaatgtgctgagaacatctatattagcctataattgagaaaattaactaacacaaaggctattttattatatggtgttgaatatttcatgtaatttattgaatactgtatagaaagtgaaaaacaaaatagttgcatgggtactcaaagtatggttgctactgaatgcgtattgcttttgcatcgtcatgaagttgagaaagtctacgttggaatctacagcttgtgtaaaccagcttgtgcagcttgttgctgttctttgaacaataagatattagcaaaacttatcttgaaaacaagataaaccatcacaaattgggtattgtgtgtataaaattttacatttgtacatttaaaaaatatccggtgtttggctttttaaaaaaataaatggtacctaaatagttcttaatttccccttatgggtagtctcctagctgttaaatgtacatttatttactcattcatttttttatttgacagctatttgttttgaatttacttttggcacagcactgggctttgtaatgaatactgtacaacagatcaaaatcttatagaagattttaataaagattttataaagattttaataaagattaagtctttaagatttaaaaaaattttaatttcttttttttttttttttttttttttt

SEQ ID NO: 11961 - DNA, 402 bp, Homo sapiens
gccaggctggtctcgaactcctgacctcgtgatccacctgcctcggcctcccaaaatgttgggattacaggcgtgagccactgcacccggccaaaatttttaattccttaagagtaaaaaagatttaaatctttaagattttaaacatttttaatttcttaaggttaaaaaagatttaaatctttaagtttaaaaaataaaccctatttaaggaatgggaattagtgtctggttggttgcttttgtccagttgaagaatagccaggcacaggctcatgcctgtaatcccagcactttgggacaccaaggcaggaaaattgcttgagggcaggagtttgagaccggtctggaccacataacaagaccccatctttacaaaaaagtttaaaattatctgggcat

SEQ ID NO: 11962 - DNA, 1429 bp, Homo sapiens
gctgggttccaggttcccagggctggctgtgagctactcaagggcagggctgtatctcgtttcctgctatgcctttgtgcctagcacagtgccaagcacacggcaggtatctgaacagtgtgggaagagaaaaggtggaggggagatggttgggggtagactgtgagagtggaggtggctcaacgctcccacccccaacctcacacacagcacccttagcccaggcactgatcccaggagtctaagaagctgattagaactgcccatggctgcagctaacctcggaactatgccccaccacctgctgtcgtctccctgcccccactcctacttccctctctcctgcctccccaggggtccggggcagcctccccctcccccaccccatggtgagaaatcccaaagactcctgggcctttctctgctgcccggctttcccgcctcccctttttctttctcttccttctgctttgcctcacattcaatctctccctcccccagcctggtgaatccaaactgaaaaaaaaaaaaaaaaaaaaaggcccacacaacagcttcaacagtgaaaaataaccaatttaaggagtaatcgctgctgtaatgattgtctaagccctgagtcactgcagaaaatcggactgaagctctgggactcccaggctccctgagagtgtcatatgggtttttgtttttgtttttttaaatatccaggacctcagtgtctccatctgtaaaatggaaggaatattatcagcccaaaggaactgattgttaatctcctgattttccctggggctgggaatcagaggttaaggtggtccacacagttggcttgggaatcaccacgggacacattcttctaccacaggacccatgggagaaatgtggtgcctggcaggtgctgagagactcacagcttcgagggtctctgggaaaggtttctagagattgtggtgtttaactgagctgggaaggatgaatgggtgaatgagagctatgggaagtgatggagtgatggaaagtcagctctggaagagactagacacctcatcttgccctatgctctcattttacagatgaagaaactgaggcctgaagggcttcaggaactgctcaaagtcattagtggcagagcccaaattagtggcagagcccacattagaaagcaggtgccttgactcctgctccagtgctctttctttctttctttctttttttagacggaatcttgctctgctgcccaggctggagtgcagtggcatgatctcagctcactgcagtctctgcctcctgggttcaagtgattctcctgcctcagcctctcgagtagctgggattacaggtgcccaccaccacacccagctaatttttgtatttttagtagagacggggtttcaccatgttggccaggctggtctcaaactcctga

SEQ ID NO: 11963 - DNA, 14206 bp, Homo sapiens
aaggcgtccatgatgcatttgcaaacctccacccgcacactctctttttggaacatgtccagaaacggcagaaatttttcctataaataaagcaagcactctatatgcaaatgacacaagttattggaaggaaggaatctgtgggtctctttttctgtggagttcaaagaagcagaacagaggttcatctctctgagtcgggtcagatgaggactcctctgaaatcagggagaggacctgactgggcttgtaaaaagctgttactgggccgggcacagtggctcacacctgtaatcccagcactttgggaggctgaggcgggtggatcacttgaggccaggagttcaagaccagcctggccaacatggcgaaaccctgtctctactaaaaatacaaaaataaaccaggcatggtgatgcatgcctgtagtcccagctacttggaaggctgaggcaggagaactgcttgaactcgggaaggcggaagttgcagtgaaccgagatcactccactgcactctagcctgggtgacagagcaagactctatctcaaaaataaacaaacaaacaaaataaaaagctgttactattaaaacaacttatatgcattccagggattggtgctgggaccagttaacattttggtgagccatccaggcaacctttgatgaccacaagcttttctgggcaaggcagacttcagtctttttgtgattatattgatgagcaatggaagaagagtcagagtagagctgttcacagatggcctcgaaattggaccgcctggctctgaatactaacctcggtgactgtgtggctgtaagcaagttactctacctcttcctgcatcagttttctcatctgtaaagtgggaatatggtagttgctcccttatctgcggttttgctttccatagtgtcagttatcctcggttaacggccatccgaaaatattaaatagaaaattctagaaataagcacttcattcattttcatttttatttttattgcattttatttgtttgaaacagagtttcgctctgttgtctaggctcgagtgccctggtgcaatctcggttcactgcaacctcagcctccccagtagctgggactacaggcatgcaccaccacacctggctaattttttgtatttttagtagagacagggttttgccatgttggccaggctggtctggaactcctggtctcaggtgatctgcctgccttggcctctgaaagtgctgggtttacaggtgtgagccactaagcccagccccattcatttgaaattgtgcattgctcagagtagtgtaatgaaatctcacgctatactgttctgtccctcccaggttgtgagtcatccctttgtctagcgtctccacattgtagatgctacctgctcgttagtcacttagcagctgtctttgtcatcagattcactgtcatggtatcacagcatttttgtgttcaaagaacacttattttacttaatgatgctcccaaagtgcaagagtagcaatgctggcatattgttataactgttctattttagctattgttgtcagtctcttactgtgcctaatttatatatgaaactttaccgtaggtatgtatgtataggataaaacatagtatacacagcagtcagttctatctgcggtttcaggcaactcctgggagtcttggaatgtatattcctcctggataagaaggcaatactacagtgataactcctacttccccgtggtggtatgaaactaatgtgaggcaatacatgtaaagtcccagaacagtgcttggagtgtggtatatgtcgaataaatattagctgctatgattaaaataaaaaatcttacaatcttgtgagcacatgtaaatggaacctggaagagggaagtgaagggagagacagagaatgttactatacagggaataacctagattccctacttgcccagggcactgaacaaactcgaacagacatcgcaggatattttaaatttttgagggaatcatggtaaatctcaactgtcagacactgaaacaactactagtcaatgtatttcatagtttcaacattaggctgtgtgattaaaaagcaagtgccctgtgaaaatcactgtggaagagcaaagtaagagaaggctgtccaaagtgttttgaaggtttgagaagttgtgtaatgcccttacttatacatatcccataagtaaggaatgaaacagaaataatatttttctttcagtttttgtgtattattttttcaaatacggcttaatctattaggacataaatacttaagttgatcagacttaactactttataaaaggaactgctgaatatttcttttggcctggggcatcatgaaaacattactgagacaatgagaacctctgagccaggtacaaatttccaaagataattaagaaatcctacttaccactgagaaaagaactgagaagtcatggaagtgggcaataactttcttaattattaactgaagctgtaaaacaaacaaacaaaaatattatttttaaaaacttaatttttaaaaatttctttctggtttacattctctcaggaaaacctaaatttttttttaaaaaggcaatcacctttcataatttgcaattattactacaataaggtaagcctggattgttcaacaaatggtgaactgggcttagggtaggctctgtctcaagctgagtttgcccaatgactctgtacatcctacttcatagtcctggggaagtaactgagtctcagtctcagcttcctcatctgtgaattggagatcaaagcagtaaggactcaatggaatggttcgtggaaggtcctgagtgcagtgcccgcctttagaaagttctccattaatgtcagctattgttattccttgaatagtgggcaaactttttctataaacgtcctacagtccaccacaactactcaacactattgcagtgcaaaagcagccattgccaacattaaatgaatgtgcattaaatgaatttgtgccaataaaactttattcacaaaaacaagtggcaggctacatatagcctatgggctgtagttggccaatccctattctacatcatcgtgtggccctgtgtttcttgattattcactggagaggatttggacagagtgtgctggtagagttaaaggccaaggtattacccaaggatggtggcacagtctgtgaggtctgcctcaaaaatgcccagatactgatggttaccgcccctcactctgcgatgcacagtccagactgaaaggctgacagggccttggtccaggagagccaagaagatgcggtttctaaataaaatagaactctccacctctggttgctatcaagaaaatgtactgacaatttgtttacactaaaaaaactgctgtttcaataatttccaaagaaaatctctcatgttctaaaaacagaacatgaagaacgttatgtgcccatttcataattaggcagcttactaggtcagtcaagcaaaaaactaataaaggacttcaaaacttcatcataaacaatgctccaaggcataccattgtaagacactgcaatgctgtctggttaaaatagtttctgaagcataaagcacctaatccctttagaacaagaaattttttgttaacacttaagcacagctacacataaactgtgattttaaaagacaggatttttttccccttaatatttcattataaaaatgctcaaaaataaagaatattgaaagaattatacaaacacgcatttattcaccacctagattttacaaaagccagcaatttaatacatttactttatcatctcacttatccatccatttaatgatagaatttgtaaacaattctatcattgttttattattatttgttttattattattttttgagacagggtctttctctgttgcacaggctggcatgcagtgtggcatgatctcagctcactgcagccttgacctcctgggctcaagcaatcctcctgccttagcctccagggtagctgggaccacaggtgcacgccaccacacccatctaatttttatatttttttagtagtgacggggttttgccatgttgcccaggctggtcttgaactcctgggctcaagcaatccgcccatcttggcttcccaaagtgatgggattacaagcgtgagccacttcacctggctttaactttttattttgaaataatttcagacttgcagaaaagctgagagaatagtactgagaactcccatatattctttacccaaatccatcaatttttaatattttgccaaatgtgctttgtggttgtctctatgcaaaacatactattttttccctgaactatatgagagtagattgcatgaatcatgcccttaccccttaacacttcattttttatttcctaagaataatcatattctctgacatttccacttgctgtcatcaaattgggaaagttaacactgatataatgaaatctaaactaatttgatctcatctatcacccatttccaagctgttgattgtctcaattagtcttttctgacattattttttccatcttctgtgcaggatccagtctgagattgcgcactgcattccattttcacgtctctttagtctgtgttagttcacaagttcttccgtctgtctttgtcatttagggcaatgatatatgtggggtttttgggttttatttcattttatttattttatttttagtttagttcaattagagacaggatctcactctgtcactgaggttggagtgcagtggtgctatcatagctcactgcagcctctaactcctgggctcaaacaatccttccagctctgcctcctgaatagctggaactacaggcatgcaccaccacacctggctaatttctttctttttttaattttttgcagagatagggtcttgctatgttgcccacactggactcgaactcctggcctcaaataatcctcctgcctcagcctcccaaagtctggaattataggtgtgagccatggagcctggccatggtgatatttctgaagaattataaaatgcttctcaatctgcgcatgtgtgacattcccttgtgcattctcaactgaaatgctatacaggtgatgctgtgtctttcttagggtactacatctgcaggcacatgatggccttttgctcctcattggtgagatgaactctcattaactggactgtccactgtctctgctgtatagtcactattttcctcattgcaattgatacctgctcagtaggaagacctcttgagatatgcaaatatcctgctcctcatcaaactctcaaaatctctctcctcctcaatgcatgcaaaactcttcttcccagggttagcatacactgataattcttacctaaaggaagacaattcttgtctttactgggatggctacaaaatggtgatttttccaattctaccatttctttcacatttctcaatccgctcatctatttatctattcagcataaggatggactcttggattcctattttactcaatgggctataatctgttactgttctaattccatttgatcctcaaattgggagcaagtgagagccccttcaaaagctgctcttatacccttttcacatgggtatttcacattagtgggttttttttttttttttttgagaccgtgtctctctctcacccgggctggagggctcactgcaacttcagcctccaagggtaaggtgattctcctactatagcatcccaggtagctgggactatagtgcatgcaccaccacgcatggctaatttttatattttttgtagagatgtgcccagactggtcttgaactcctggactcaagtgatctgccctccttggcctcccaaagtgctgggattacaggcatgagccaccacaccttgcctcactgaactctttagaagcacaatgtgacctaatgtattcaacttatcatcaaataattcagagaaaaaaatgtacacacatacatgtatatatgtgtggaatgcgtgaatgataaagcatatgtagtaaaatgttaacagttggccgggtgcagtggctcatgcctgtaatcccagcactttgggaggctgaggcgggtggatcacgaagtcaggacatcgagaccaccctggctaacgcggtgaaaccccaactctactaaaaattcaaaaaattagccaggcgtggtggcacgcccctgtagtcccagctactcggaaggctgagacagaagaattgaaggtggaggttgcaatgagccaagatcgcaccactgcactccagcctgggcaacagagcaagactccgtctcaaaacaaaacaaaaacaaaaacaaaaaaaaacaaatgttaacagctagtaaatctggttaaagaataataggaattctttgagctttcttttaactttccaataagcttaaatttatttccacataaaaaaattatgcttaagcccaggaagtcgaggctgtgccaagcggtgatcgcaccactgcactccagcctccgtgactgagcgagaccctgtttcaaaaaaaaaggaaaaaacaaagttgatttaactaaaaatactcgcagtttacttactggtgacaacaatgaagacaacgcttattgagcatttaccacgtgccaggccactgtgtgagggcttcacttcatcctcacagtaactctcaggtagcactattactatctccatttcacaggtgagaaaactggggcacaacaaggttaagtaactgatcaaagggcacatggctaggatatggcagagctatgattcaaacacaggattatgtgcctttatagcctgacccatacaacacgcctatttaattcaacagaacaaaattcctaacaatgttgaaatgagaaatgcaaatctgttacctgggggtaggaatcttcaaatgcacgatctggagtcatgtgcttgatgacatctgccaaaacggtattcacctctcgtttctaagcaggaaaaaggaaccaaacctgaattagacactgtatggcaactgctgaccatgttcctgggggaaaggactaacgtattcagaatatatcacacaccttccaggaaatcaatttcagtattctgctgaaaataacggaagggaggaaatctcactcatatcacccggtctagtaccacagccccacacctagtcaggactaaacgctcttctcaaaagttctggggctttacattgtctctgctttcccagagtgatggttgaatcggccgtgcctctctccacctgcctgtcccaggccctccctcaggtgcctgcagagagaacagtgaagcactgcggaagactgcaggctcacccttacaagctgtctgacctaactgctcactgttcacttttgtcacctatagcaggagtcagccaactgcagcccaatccagcccagggcctgtttttataaggcccacaagctaagaatggcttttaagtctctataattaactgctgatttatagaaaatacaaaaggcagaagagcacgccagacaccatcacaaggatgcaatgggaaaaatccagtctttgcaactctatagagcaaaagacccaatttcttcaacaaataaattacagggaaagaaaggggaaggagagaaggagacagtttgagagagaacttatacatcaaaagtatcctaaaatgtctattgcaatggagaagccttattttcaaccagatttcaacaaataaacttaaaaaaaatgagacaattggggaaatcagaatattgactggtactgatgatattaaataattagtaactcggctgggtgcagtggctcatgcctgtaatcccagcacttcgggaggctgaggcaggtggattgcttgaggtcaggagttcgagaccagcctggccaacatggtgaaaccccgtctctactaaaaatacataaaattagcggggtgtggtcacacacacctgtagtcctagttacttaggaggctgaggcaggagaatcacttgaacccaggaggcggaggttgcagtgagctgagatcatgccactgcactccagcctgggtgacggagtgagactccatctcaaaaacagaagaaaaaaaaaattagtaacttttttccttagaataatgtatttagatttggtttaaggaagtgaaccctgcaacctgggcaacatggcaagaccccatctctacatctccacatgtgcctgtggtcccagccactcgggaggctgaggcaggagcattgcctgagctcaggaggtcatggctggagtgagtgacgattgcaccactggactccagtctgggcaacagagtgagatcctgtctgtcaatcaatcaatcaatggaatctttatatttttacaggtgtgctgaaatactgacagatgaaacgatacaatgtctgagatatgcttcaaaatattccaggggtcaggggacatggtaatgatataaatcaaacaagatctgtcataaattgataattcctgattgatgggtacaagggagtgcatatgttttacatttccataataaaatgtaaaataaaaataggaccaaaaaaaaccacaaaaatcaatggaccaacatttacctaatgctcaaaacgaggcaacatcaattttggtgttagaggccaggatggtgtctaccttcacctcctcaaaggctgttgtgacagggagaggcagttctgggggttctgcggggtcacttatttcctatttcttactctggatggtgattatatggtcataccttgtgaaaattcattgagcagcaaacttatgatacgtgcacttttttgcatgtgtgcttggcttagtctgtttgggcttctctaccaaaataccataaaccaggaagcttgtaaacaacaaaaatgtaattctcacagttctggaggctgggaagtccaagatcaaggcagatttggtgtctggtgaggacccattcctcacaaacggcatcttctccccaagtcctcatgggatggaaggggacagtgagcaactcaggacttattttattattatttttgttttgagacagagtctcactctgtcgctctggctggagtgtaggagtgcaatcttggctcactgcagcttctgcctcccacattgaagcgattctcctccctcaacctcctgggtagctaggactacaggcaggtgtcaccatacccacctaatttttttttttatttttagtagagacggggttttaccacgttggccaggctggtgggcttcttttattataagggcattaatctccttcataaggactctgcctgccatgacctaggctccacctcctaataccatcatcctgggggctaggatttcaacatatgaattttgggagggcacagacattcagaccatagcaatgccacacttaaatttttagggcttggccaggtgcggtggctcacgcctgtaatcccagcactttgggaggcagaggcgggctgattgcgagctcaggagatcgagaccatcctggctaacatggtgaaaccctgtctctactaaaaacacaaaaaaattagccaggcgtggtggcaggcgcctgtagtcccagctactcgggaggatgaggcaggagaatggcgtgaacccgggaggcggagcttgcagtgagccgagaccacgccaccacactccagcctgggcgacagagcgagactccatctcaaaaaaaaaaaaaaaaaaaaaaaaacttttaggacttgattaaaataaacaaattactctggcaagggttttgaacccacttctatcttcttctaaagtctctgctctttgagaagcccagtattcccctaactgtggttctagtctgtgcctagggaaagaaatatttgcttaggaaaaaaattacatgccagtcaaattgtttgggaaatgctgcttactagactctgatgtacagtcgcaatgcactttagcatgtaagcatctaaggtatcctatggtaaaaaaaaaatggtttaactttgtgtaatgctgcattttccaaacttaaatgtaaacatggaacagttattttttgttatagtacacatattaatgctccatcacgctttattatgaagaatgcaatttttataaattacaagagcaagtaccgttgtcaaatgcctcaatacctaaactaggctaattcactattataaacatgaaaaaatctaattctttcaaaaacaataccacagtcacacataccgtgaaatgcttgcaggtgtattccacccacacttcggcacaattaatgtagtcctacaaagagaaaggaaaacatcttaacattaagtacaacatagtatgcattacagcaaacaggaggcttcagctggctctgttcaatggttggaaacgggaatttccttttgctaattactggcttaaaggctgatcttttatttaggaatatcctactaacgatattttcaagcctaaatcttacgaactgttatattttggatgcccactataaagttaactgatttttcataaagtttcaaatatctgtaatgttatgcattttttttaagttgtattttttatggcagttctgaacgcatgatcatgtaattttatacttttagcacatcttaaggctgtgagaattgaatttttaaaaaatcaaagaaattacatctttaaagctatccattctccattacaggtaaacaaataatacaattataataaatagatttctttagggaaaaatgtataactaatgaaaagataatttttattttttagttcaaatagagacaggggtcttgctatgttgtccaggctggtctgaaactcccagcctcaagtgatcctcctgcctcagcctcccaaagtgctgagattataggtgtgagctaccatgttcagcttggaagggtaattttttaaaagagcagatgccaaaacttggacaaaaagtggttgatttaaagtttaaatggcaggccgggcaaagtggctcacgcctgtaatcccagcattttgagaggccaagatgggtagatatttgagacagcctgaccaacatggtgaaaacctgtctctactaaaaatacaaaaattagctgggtgtggtggcacacacctgtaatcccagctactcgggaggctgaggcagaagaatcgcttgaacccaggaggcagaggttgcagtgagccgagatggcgccattgcactctagcctgggcgacagagcaagacttcatctcaaaataaataaataaataaataaataaataaaaataaaaataaaatggccactcacctgtgggttcttcagcttagtgatgactttccaagcttcgttgagaatctgaagtcggtcactctcaggaggatcagccaaggccaagtttaatcccagtgatcgaaaaagaagatgctaagaaacatgtcaaaccatcatgttatggaaattttaaatcaaattaacttgaagctcaaagaaaagaaaagagaaaaggttgtaatgtttaatccttcttggggctaatcttccaacaacctccttctaaagttctatcacacatatctgccccagctacactgagaggctcacacagagttagctccatctgttggtctaatgtggggccataatattctactggacaaagtttttcataaataatgaatgaagatatatccttttgtttgttttgagacagggtctcactctgtcaccaggcttcatgacataatcatggctcactgcagccttgacctcctgggctccaagcaattctcccaccttagcctcccaagtagctgggactacaggaatgcaccaccacacccagctaagttttgattttttgtagagatggggtcttgctgtgttgcccaggctggtctcgaactcctggcctcaagtgatcctcctgccctggcctcccaagtgataggattataaacatgagccaccgtgcccagcctgatatattcttaaatatgttagaccaaagtctttcttaaatccttcatagtgagccaatctgatagatttagggctcatgggggcctgaagcatagcaatcacacagtgtctgacaatcccaacctctaactcatcttccattgcgttcctcagaaacagagccttcgcctgtgttcctgctggcccatgctgttcccaaaaccggactgtctctcaagagctatcagatacacaccgcttatttgtgtcctactgagcatgaagtcaagagcctaccttggggaaaccagattcatcacactctttaatcatgccaatgaaatccatagaccttgtggcgatgaactcagcccggaaggcagacatcacagaattcaacagcaaggcactgcaagacacagatccccaagtcagcctggcttctcctcaatcaaagttgctttaatttttgaatatatattgccaggaaggaagactaacagctctttagcggtagggttggggaaaaacaaaaaatcagagtaaaaaggtaaactggagagactaacacagtgtcctgtacatatctgcaactcaataaatgttgaattaactggatgtttagatggatggatggctagatggcagggtggatagacagatcagcaagtgatccagttcatttaaggagaagaagagcgagcattcaataagctggtgcactaatgagacagaacattaagtaacgatattgatccatgttgtaaatatatatccacatcgtttatgcaagagttttggtttttttgtttttttttttttgagatggagtctcactttgttgcccaggctggagtagtgtcacgatcttggctcactgcaacctccacctcccgggttcaagtgattctcctgcctcagcctcccaagtaactgagattacaggcatgcgccaccatgctcggctaattttatgtatttttagtagagacagggtttcaccatgttggccaggctggtctcaaactcctgacctcaggtgatccacccgtctcagcctcccaaagtgctgggattataggcatgcaccactgtgtctggccagtttatgcaagagatttcttagtaaagagatcttatgttataggcaccaggcacaggggacacagtggtaaacaaagcccatgcaaggctgtttccatgtatctaccactaaaaggaaagcagagagacaacctcatattcgtgagagtcagggagatcaatttcatcctagcccaaccacctaccacagccccatggggaaataactattattattactttttttcttttgttttttgagacagcgtctcactctgtcgccaagctagagtacagtgtcatgatctcggctcactgaaacctctgcctcccgggttcaagcaattctcctgccccagtctcctgagtagctgcgactacaggcatacaccaccaagcccggctagttattgtatttttagtagagatggggttttgccacgttggccaggctggtctcgaactcctgacctcaggtgatccacacgcctcagcctcccaaaatgctgggattacaggcatcagccaccacgcccagttgaaagaactattattactcccgttttacagatgaagagacagaggcacagagaggtcaagcaagcggcccaaggtcacagggctaagacagaacagagccaaggtctgaggccaggcaaccggactccagcattctaaacctccatgcagtcctgcctctctctcttcagctcatacccaggtaagcaggccaagctcaaaaatagcagccaacgccattttcaaactcatgctttatgaatcttaaaatacttacttgtttcctagtttcttacacctttccatcatctcggtcagcagagcctattatgttaaaaataataataattaaaaaatcaggttggaggagctaaagtaacatttctaagagatttccaaagtcgaactctaaaatgaatgtagccacatgtccattaagataattctcagtgtctggtagggatggggaggcttggggagaaaaaaattcactttcatggcatttagtgtaataaatagaaggagggggccgggtacagtggctcgcacctataattctagcattttggtagaccgaggcaggtggatcacttgaggtcaagagctcgag

SEQ ID NO: 11964 - DNA, 147 bp, Homo sapiens; identical to SEQ ID NO: 11905

SEQ ID NO: 11965 - DNA, 610 bp, Homo sapiens; identical to SEQ ID NO: 11907

SEQ ID NO: 11966 - DNA, 610 bp, Homo sapiens; identical to SEQ ID NO: 11908

SEQ ID NO: 11967 - DNA, 612 bp, Homo sapiens; identical to SEQ ID NO: 11909

SEQ ID NO: 11968 - DNA, 375 bp, Homo sapiens; identical to SEQ ID NO: 11910

SEQ ID NO: 11969 - DNA, 873 bp, Homo sapiens; identical to SEQ ID NO: 11911

SEQ ID NO: 11970 - DNA, 375 bp, Homo sapiens; identical to SEQ ID NO: 11912

SEQ ID NO: 11971 - DNA, 641 bp, Homo sapiens
cccacctcagcctcccgagtagttgggattacaggtgctcaccaccacactcatctaatttttgtatttttagttggccatgttggccaggcttctcttgaactcctgaccctcaaatgttctgcccaccttggcctctcaaagtgctgggattacaggtgtgagccaccgcaccaggcctaaaattaaatggattccggttgcaggtctttggctcaggctgttttccctgatgtttctgcaggtcagttacttatggactgatgtttctgcaggtcaattacttatgtggttgtgcagatggccaaccacagtggccggttacttttctcagggcacctgccttctagaaatgtatcctctctcctctcccttttcctctttctgtcagagaatagcaggggttgtggaggaaagctgaattctaaattagtcatttcgataattaataaggctagctagaggtttgatgagaaaaaaattgctgcttttttttgtaagtgtaatgtggttagatataaagtatccaaaatttagacagatctcaaaatccaaaattttatttttccctcaaagccatgcttaagtttactcagaataaccacagcatttttctgaggctctgcaaataccttctcgag

SEQ ID NO: 11972 - DNA, 641 bp, Homo sapiens
cccacctcagcctccctagtagttgggattacaggtgctcaccaccacactcatctaatttttgtatttttagttggccatgttggccaggcttctcttgaactcctgaccctcaaatgttctgcccaccttggcctctcaaagtgctgggattacaggtgtgagccaccgcaccaggcctaaaattaaatggattccggttgcaggtctttggctcaggctgttttccctgatgtttctgcaggtcagttacttatggactgatgtttctgcaggtcagttacttatgtggttgtgcagatggccaaccacagtggccggttacttttctcagggcacctgccttctagaaatgtatcctctctcctctcccttttcctctttctgtcagagaatagcaggggttgtggaggaaagctgaattctaaattagtcatttcgataattaataaggctagctagaggtttgatgagaaaaaaattgctgcttttttttgtaagtgtaatgtggttagatataaagtatccaaaatttagacagatctcaaaatccaaaattttatttttccctcaaagccatgcttaagtttactcagaataaccacagcatttttctgaggctctgcaaataccttctcgag

SEQ ID NO: 11973 - DNA, 967 bp, Homo sapiens
cacatagtgattttctcctgtgctttgtctccagggacattggctgctgtcttctgacccaccctgtgtggctttggcgtctcctgtgacctcccagtatgggtcttggcctcatcctgcctctttgtctttctggcccaccacccacagcttgaatctcaggctccaacagttgcctgacccccagattctgatgacagcctacctacttgttcttcaggccctcaccagactcactgcccagacacaccacacaggagaacatgaaagggtgaatgaatctttcatcatttgatgaccaagttggcattcttttacattccagccaccagaggaaggtgtattttaacacaattgccctcacatcctccttaacaggatttacataagtttattaacacatatgtttctacaaaatcaagttttgagaaccatttttatacactgatctgggacattttggggatatgaaattaactttagcacacacagcaagaagaaaaccgaacaacaaattctacaaacaccaaatttgctgtgaaatttacatttcagaatctctcaagaaatagtgcccagcagcaattcttactgttttcactttttcccccgtcttcacatttttatgtttgacagtgccaacatattttctcaacatttattctgaaaggaatgtactttgtgaattccttaaatgcaggatgattctgattttattggcctaatagctcctccttatgcgtgggttagtataacagaatgcatttgagacctgctatactattttaaattaagacatttcatgtagcacatagtattttaaaatgaagaacattgtcttggaaagcacacaggctaactgctattttcttgatgcaagaaatatttaaattctctgtgcttcagtctatacaatcagttttccagggatgctgtgtatataaaacgagggagtgtattaagagta

SEQ ID NO: 11974 - DNA, 88 bp, Homo sapiens
ttatttttttttctgagacagagtctcactctgtcgcccaggctggagtgcagtggcgtgatcttggctcactgcaacctctgcctcc

SEQ ID NO: 11975 - DNA, 52616 bp, Homo sapiens
gcggcgcgggcgggagggcgaagagcagcggccgcctgaggggagcccgcgcctccgccgcctgagaggaggtcgagctgccgccggggcgatgctggaggagctggagtgcggggcgcccggcgccaggggagccgccacaggtcggttcgggcccgcgccgaggggaagggggggcgcggcgcgcggcctggacgggccgaggcggcgatgggaggcggacgggcctccgggcgccaagcctggtcctgcgggccgggcgttcacaccctggggccttctcatccccagcgagggcctggcgtccccaagggcacccttgttgacgttattgttgtagccgcgaccgtattgtttgtttccggcgcttttgcgtcagttcgtccctccaggactctctggggcggtgggtcggaggggccgagaggggaaactgaggcccagggaagcgaaagggcttgccctgcaggttactggatgcgtttgtgtcccttgaccatgttggaccttgcagcgggtggggaaactgaggcccaaggtcgcacgggctcggggaccagttaccgatgccgctgagggtcggggtaagcccgagtaagaagaggcccagatggtagagatggccaggagggtgggactcccgagttcttgctccttcctgatatgcaccgtgacttcctcctccgtgtgccttggaatggggtctttggagcccaccacaggcctcctgaaacgtgggagggtgaaccaaggaagaccagactgtccctctcccttgctggactctgcattacataacgctttggcagcacttggcattacgctttggcacatagtaggtgctcagtaaataacgtgaacgaatgaagggctagaatggacgccagtccagtttctcagcctcagcagtgttgatatttgttgccgtcctgggcacggcactgcagggtgttaagcatcatccctggcctccgccttttgcaggccagtagcagcccctctcaccatgccttagtaacagccagaaataccattgccctgtgtcccctatggggcagattccgccttggctgaaaatcatggctgtagttccttctagcctgtgggatttcccggagacataaaattaatacaaagttggtactgtcgtggagctgtgatgttttaagtcaggatgtttaactttatttatttatttattttgagactgagtcttgctctgttgcccaacctctgcctctctggttcaagcgattcttctgcctcagcctcccaagtagctgggattacaggcctgcaccaccatgcctggctaatttttgtattttttagtagagacggggtttcaccatgttgggcaggctggtctcgaacttctgacctcaggtaatccacctgcattggcctcccaaaatgctgggattacaggcatgagccaccatgcctggccaggatatttaactttaaaaaaaaaaatcgctactcgctaggaccatgctatcatgaaaggaaagtatattttagtgccaaataaaattagaaaggatgtaatcgcagaataaagagcagttagtaactttatacacacatatgtgttaatcgtgtgtatctttggatctctggattgggagtgtcccgttttatatacaagattttttaatgagggtgggtcctgtttttaatgaggttgtttctgttccacttgcaccaaagctagtgactcaaagccacacaaatagatttttgtgattgtctcgaaaataaagttaagtgactaaaaatcatatccttcagttagggggtagaaatccatggcttttggtaagtggacacttgagaatgatactgtctttatttctttgaagtggctagaaaggaaacatgaattttctcagtaccttttcttattcactaagcttggggcggtgggtgaggggtggtttcatgtatggacgatggagttttttaggaagccccagtctgcttttaaaaagtactcacttttatgtaatgcttacaaaacatacgtagattaaccaaaataactaaactaggttttgccaagccagatctcctggtaagtgtgagcttcctaaacttactctgtttaaggtatttatctaaagactcgcttctatttatgatcacaaagcatctgctttgatattattagatggtttcttgagattttttttgcaggaaaatattttgtcttatcttctcttgacagcacttcagctcctgcctggcaagctcaaagtgctttaaattgtggtaccttcatgaattctctttaaaaagaaaaggatcccttttctgattttacagatttggtggtggtatgggggcttgggttggaggaagatgtttggggatcatgggaatgaaataggtaatctgatgttttctctcctccctacttttactcattccacttccatttcatgaaacagttccggttactctcttagttggctttctgatttattccagaccctaaccaggtaccataggtgcagcatggaacaagtctttctgctgtcatagagttggcattttgtttccagagagacgtaataaacacgaaagtttcagattaaatgccacaaagaaaataaaacaagacatgacagtgtctagggtaggatttctcaacctattaacattttgaggccaagcgccgtggccagcactttgggaggctgaggcgggtggatcacgaggtcaggagttcgagaccattctggctaacatggtgaaaccccgtctctgctaaaaatacaaaaattagccgagagtggtggcatgcgcctgtagtcccagctacttgagagagtgaggcaggagaatcgcttgaacccaggaggcggaggttgcagtgagctgagactgtgccattgcactccagcctgggcgacagagtgagactctgtctccaaaaaaaaaaaaaaaattttttttttttggcccatataattcttcattgtggtgtgctgtgcattgcattgtgggacatttagcagaatccctggcctctacccactggatgtgaatagcatccctttgagccctccctgcatcatgacaaccaaaaacatctctagactgtgtcaaatggcccccgaggacagaggggtcagaattgcctccaccttgtacataattggctctacatatgtatttgctaacttgattatttgcagaatttaacagtttaccctttgacacttttatttgcagccatggattgcaaagatagaccagcttttccagttaagaagttaatacaaggtaattatttggaaatgggttaaagagttgttcgtagtttatagtcttccttgtctcttgttggagacctcagtggaagcctggagctagaggggagagaaacagtccttcttcagaccaggaagctgggaaaatgcttttcacacagtaatgtctcgtggggttcccacaagtaaaccccgaggcctccacttatgcacaattggtgttttgtaacttgcagctgggagctctcctgtatgttgtagggagcgtagcagcatccctggcctcttcccaccggatgccagtaagtgcatcctccaagtcgtaacaaccaaaaatatctctatacgtggctgatgtcccctgggaggtagaactgccccctcagagaaccactgttgtcctggaagataaatgctcccaaatccttctgcataaaacggggagtgtgttcacccttgggccagatgagcggttggattgtaattttttttttttttttttttgagacggagtctcattctgttgcccaggctggagtgcagtggtgcgatctctgctcactgcaacctccgcctcctgggttcaagcaattctcctccttcagcctcccaagtagctgggattacaggcgcgtgccaccacacccagctaatttttctatttttagtagagatggggttttaccatgttggccgggatggtctcgatctcctgaccttgtgatccccctgcctcagcctttcaaagtgctgggattacaggtgtgagccaccgcacccggcccagattgtatttttagaaactacagttttgggtttttcaaacttgggctgggtgcagtgttgcatacctgtaaaaccagctatttgagaggctggggtgggaggagtgcttgagtccaggagttcaaggctgcggtgaattataatgacaccactgctcttcagcctggatgacagaggaagactctgtctcttgaaaaaaagggggacgccagatgctaggctcacacctgtaatcctagcactttgggaagctaaggtgggcggattgtctgagctcaggagtttgaaaccagcctggccaacatggtgaaaccccgtctctactaaaatacaaaatagctgggcatggtagggggcacctgtagtcccagctactcaggaggccgaggcaagagaattgtttgaacccagaaggaagaggttgcagtgagccaagggtgcgccactgcactccagcctggtgacagagcaagactctgtctcaaaacaaacaactccccccacaccccccccaaaaaaaacaggtttttatttggtctattacatgatgaaatagttaataaaagatgcaatggcattgaagtaagtgaacataggttctttgggaaattcactctccaaagtgtttctgtgttcctcctaaccagcccgaagcctggcagactctgggagaacagtttgattgatgagaaaagcctaacagagcctagggtgctgaggccaggaggaaaaaaaaaaaaccctgtccacaaatgtgtctatattttctacttgagaaccagatgcagttattatcaaatgagattttcacccattaaaaataaatttggaatatgaactgcatctgaaataaacaaatgtctcttgaaattctggcgatggctctgctaaaaggcttgtcaggattttgttttttaagttaggatgttgaagcggggcatggtgactcacatctgtagtcccagcaccttgggaggtggaggcgggcagatcacctgaggtcaggagtttgagaccagcctggccaacatggcgaaaccctgtctctactaaaaatacaaaaattagctgggtgtagtagtgcatgcctgtaatcccagctacttgagaagctgaggcaggagaatagcttgaacccaggaggtggaggttgcagtgagctgaggtggcgccattgcactccaacatgggtgacgagcaagactgtctccaaaagaaaaaaaaataagtaaaattaggatgttagaaaaggatagaatgaaaagatagcaccccccaccccctctttttttttgagacgaggtcccttttgcccaggctgcggggtagttgcaccaccacagctcactgcagcctctacctcctgggctcaagcgatcctcctgcctcagcctcccgaagtgctgggattatagatgtaagtcagtgtacctggcttcagatagcccctgccccgtcttttttttttttttttcttttgagagtttcgctcaggtcgcccaggctggagtgcagtggcgtgatctcagctcactgcaggctccgccccccgggttcacaccattctcctgcctcagtctcccgagtagctgggaatgcaggcgcccgccacctcacccggctaattttttgtacttttagtagagacggtgtttcaccgtgttagccaggatggtctcgatctcctgaccttgtgatccgcctgccttggcctcccgcacccggcctttttttttttttttttttttttttgagagggagtctgtctctgtcgcccaggctacagtgcagtgttgggatctcagctcacttcaacctctgcctcccaggttcaagcgattctcctacctcagcctcctcagtaactggtattacaggcgtgtgccaccatgacctggctaatttttgtagttttagaaaagacggggtttcaccattttggtctggctggtctcaaactcctgaccttgtgatctgcttgcctcggcctccccaaagtgctgggattacaggcgtgagccaccacacccggcccagatagtccctttttaaactttaaaattatctcccacccccatgtcccaacaaatcagtaattttcaagctcatgagtggttgtaactttaaacgttcactagagatggctttctgtctttgtttcagcccgtctgccgtttaagcgcctgaatcttgtcccaaaggggaaagccgatgacatgtcagacgatcagggtacttctgtgcaaagtaaaagccccgatttagaggcctctttggacaccttggaaaacaactgtcatgtgggttctgacatagactttagaccgaaacttgtcaacgggaagggtcccttagataactttttaagaaatagaatcgaaaccagtattggccagagcacagtcatcattgatttgacagaggactcgaatgagcagccagacagtcttgtggaccacaataaactaaattctgaagcctctccctccagggaggcaataaatggccagcgagaagacactggggatcagcaggggttgttgaaggccattcagaacgacaagttggcatttcctggagagaccctttcagacattccttgcaaaacagaggaggagggtgttggctgtggaggtgcagggaggagaggcgactcccaggaatgttcgccacggagctgcccggagctgacgagtggcccgagaatgtgccccagaaaggagcaggacagttggagtgaagctgggggcatcctgttcaaagggaaggtgcctatggtggtcttgcaggacatcttggctgtgagaccaccgcaaatcaagtcccttccagccacaccccaaggcaagaacatgacccctgagagtgaggtgctggaatctttccccgaagaagactctgtactcagccattcgtccctgagctctccctcttccaccagctcgcccgaggggccgcctgctcccccaaagcagcacagcagtaccagtcccttccccacctccacgcccctccgcagagtgagtatctcccatggagtccctgcacatcagtgctcacggatctcagagcgctgtcagtctccactgggtcacccaggtgttttgtggcagagtgagcggggccacgggctgggtcctgggactcgacgtggagttcttcctggtatcaaaactcacagtgttcagttctgcattcgttgtgatgcccctgggacttaattcatcaacagtgtacctggtgtactgtgtgaataacaccctgctgttttgccttcgttgttcacatctaatcagtgatagcttagccgttttagggaattaggatctgagctggtgctgtaacccctcacttcagattcgaggtccagctttctctgtgcccttcctgtctaagcatagaaatgtagggacggggctgcaaagacactgagcactgaagtggcagtgagacggcaggaagcatgacttggggaattctgtagggtcagcacagccagccatcttaaaaaccttacctggggccaggcacagtggctcatgcctgtcatcccagcactttgagaggccgaggtgggaggatcgcttgaagatcacttcaaaaccaacctgggcaacatagacaccatctctatgaaaaaaaattacttttttttttttttttttgacagagtcactctatcacccaggctggagttcagtggcgtgatctcggctcactgcaacctccacctcccaggttcaagcgattctcctgcctcagcatccctgatagctgggattacaggtgcgcaccaccacacttggctaatttttatatttttagtagagacagggtttcactatcttggccaggctggtcttgaatttctgacctcaagtaatctgcccgtcttggcctcccaaagtgctggaattataggcatgagccactgcacccagccctgcaaaaaaatttttaaaagttatccaggcatggtggcacatgcctgtagtcccagccacctgggaaactgaggcaggaggatcacttgagctgaggagttggaggccgcggcgagctatgatcacactgccgcgctccagcctgggtgacagagcgagaccccatctggaaccatttttaaggaccccataagggggacttttgcatggtctgtctctgttattgattttttattagcacaatggtgtccttaaggtcttagggaccaaactgataaaatcagtcacgagtcccacggtgtttagtggtgtcttttgattttataattttttactttttatcttaagtatgtagaaccagaagagacagtgcctttttatgtttttggttttgtagcacttttgtttgttcatgttgggtctttatatgagagtagtagatcctgagatgggtcatttaatctgtacctgtaagcaggtacagtagaccacctggaccataaaccaccaaccttgttcgctttcgggattttgagctctaaggaaccatttatttatttatttttgagacagagtcttgctctgtcacccaggctggagtacaatggcgccatctcagctcactgcaacctccgcctcctgggttcaagcaattctcctgcctcaccctctcaagtagctgggattagaggcacccgccaccatgcccagctaatttttgtatttttagtagagacggggttttgccatgatggccagactggtttcaaactcctgacctcaggtaatccacccgccttggcctcccaagtttctgggattataggcgtgagccactgtgcttggccaagagcatttatttttctgaatgacttcatttcttgtctttcacctgagaagatgaaaaaggaaaaaatggcttcctctttaggtttatgaaatgttgtaaaaatggtgcaaatctttttttttttttttttttgagacatggtctcaccctgtcgcccaggctggagggcagtggcatggtctcagcctactgcagcctccaccttctaggttcaagcgattttcctgcgtcagcctcttgagtagctgggattacaggtgcccaccaccacgcctggctaatttttgtatcttttcagtagagacgggtttcaccatgttggccaggctggcctcaaacttctgacctcaggtgatccgcttgcctcggcctcccaaagtgctgggattacaggcatgagccaccgccccagtcttctactttgttttatatgtgctggtttgttatataggtaaactcttgtcgtgggggtttgttgtacagattattttatcactcaggtactaagcctagtaccctcttctaagttactaaatgtgccagactggcatgtacacatttcagcttctacctaagccaccactcaatctcccaaaatcagagttgaagtctctccccattgggcatcctgtagtgtacattcgatcacttgaatttcttccaggctgctgccgctttgcaaaatttcgtcctgtgatgtgagccatttagcaagaacgggacacatggctgggcgcggtggctcacacctgcaatcccagcactttgggacgccgaggcgggtggatcacctaaggtcgagagttcaagaccaggctgaccattatggagaaaccccgtctctactaaaaatacagaaaattagctgggtatggtgacgcttgcctgtaatcccagctacgccggaggctgaggcgggagaaccgcttgaacccaggaggcagaggttgcggtggcctgagatcatgccattgcactccagcctgggtaacaagaacaaaactccgtctcaagaaaaaaaaaaaggacaggacacaagcacatgtttccattaagtttgtttccatgtccacagcttagtctgcaaactgggaagtcccctcgttgggcatcatggtggcacaatcctgcccgctttctaaaacaactgagcacatgaacccagtgtgcaacatttaggaagccctgcatttaggacgctagatcttgttctgaacacagactcgaggttttgggatgcacttgaaggcaatattatcccaacttttcagataatttacaagtggtaaaggcttcaggctggcccagagcctatggcagaaagcggccacaaccacccgcagagggcctgtcagtcaccgaagctatgagggaagcgattatcgggaggcctcctcatgccctgatggcagggatccctgagatcccagctgagagagactccatccccaacccctactttatctccgaacctttaaggagtcctgcatttctggtttggttggtttgcttgcttcatagttggtacctaactcttttttattttttattttttttgaggcggaatctcactcttttgcccaggttggagtgcaatggcgtgatcttggctcctgcaaccgctgcctcctgggttcaagcaattctcctgtctcaacctcccaagtagctgggattacaggcacgcgccaccaggcccagctaatttttgtatttttagtggagatggggtttcaccgtgttggacaggctggtctcgaactcctgacctcgtgatccgcccgcctcggcctcccaaagtgctgggattacaggtgtgagccaccgcgcctggccagttggtacctaactcttaacacctttccttgccgtgacgtccaagccacccccttcccacaacccctgttcctctggggaatacactgtttttgcactttacctccctaccagcagctctttccagattgcaggggcgagctggtgggaagcttgcagattgtttcgcactgccgtgtaatctgtgtgcttgtcactggggtctgttcttccttgagttggtacagtgaaatatgcattgagagtcccagggcagtcattgccactgtactttgtgggctggcttgccttctttattatttcttctttaaaataaaagaaaatgggagtttgttccgatacaggtcctgctgtccctttgcagggagcttcatggcgtgtttttgtttgttttggtttttgttgttgttttagtactgcaggatctggagaatctcactttggagaaacaatgatttaaaaagatccccctttagatactcccagggtcctttgaatagctgaagtgttcctttttagtattagagttttctaccatgtgggaaagaaccatttctgaagtttgcaatcagacttgtgatttagcctcttctgttagtgatcgagatgattatttgacaaatgatcatgttggtgcagttgtgttactggaatctttggcttgcttctgtgcccagattgctggaacttctttccatatacttgaaattacatttgtaataaattctccatgtttaaaagaaatactggtctaggtgcagtggctcaagcctgtaaccccagcactttgggaagccgaggtgggaggattgcttgagcttaggagttcgaaaccagcttgaccaacatggtgaaactccgtctgtacaaaaaatacaaaaaatagcggggcatgggggtgcacacctgtagtcccagctccttgggaggctgaggtggaaggatcacttgagccaaggaggcagaggttgcggtgagtcatgattgcaccactgtgctccagcctgggcaacagccagaccgtctcaaaaaaaaaaaaaaaacaaaaaggaaaaagaatggaaaccttgaagccctctgttctcccaggaggttgccattattatcatcatcatcaccttgtgtttttctgtgtcctgtatatccagagagatctctaggaaacacccagtatcattttgtttccttgtgtatgacatatactgtaaatatctgtctttgttactcaggggtgtcttagatgttttttatattgggatggaaagatggagctctttttaacagctgcgtgatatcccatggtgtggacatgctgtaggttacagagctgttttctcagttctgttgtttctgtgcttggctttcacaaaatgattgttcccttgagcttccttctacaagtggccttgggctgttaaggagaatgaggtcttggtagctcaaggcaatgcgtgcgttcttattttcccagcttgcactctctcatgcttgggccaattggaggttttctcttttcccccctgcctccgctcccctgctgtcaggttttagcggcttatctggtctgggcttagaaattagataccctttagtataaaatcagagtccataggctctgagaggattatctgagaaagggtgcaggaattttcatgcccacacatagtgagctctgtcgcgactccttgggattgtcggtttttgtgttttggcttccttctgggatcctggatcacgtttttggcagttgagggtgctgtctgaccgggctccagctgggtagaatgtgggagtgttgcatagaattttgagagtgagatctataaacacttgggtcaaatttcaagaagataaagttctgtcagacttcaaggtccatctgagggtttggcaaagcaaaaaagataccagttttaaattaagcagtaattgctctgttttggttgttggatattactgagcgggctcttgccagtcacatcaagtctgttatctctggactcacagcagagggggggcattgtaagaggcaggagattctgcagctgagcttcaggcatgggcaagactaaggaactgaattccctgccaccccaagaccacattccgtattataatctctgaacacaaagggcagccctggagagctgcggctcccatattctgcagttaaatccctcagcgtgggggagaggcacacagccttggcaggcagagtagatgctggagagacagatgctttttctgcagcatttggtgaggctgcctcgggctggcatttctgttgccacattctcagcaaagactgaacaccctggcctgatctcggtggtgaaagagctcctgccaacacgggcagccttctcacaacggctcggcctttccctaaagaaaggtttagtccagaaaggactcagtgggacccaggtggaaaggctgtcttgagctcattcatctgaagcttttattctgtgagaggtcctagtcaggggttcagctttcccagataaagaaatcactgttggccgggcgcggtggctcacgcctttaatcccagcactttaggaggccgaggcgggcggatcacgaggtcaggagatcgagaccatcctggctaacatggtgaaaccccatctctactaaaaatacaaaaaaattacccaggcatggtggtgggcacctatagtcccagctactgggcagactgaggcaggagaatcgcttgaacccgggaggcggagcttgcagtgatccgagatggcgccactgcactccagcctgggcgacagagcgagactccgtctcaaaaaaaaaaagaaatcacttacataattttgttgacccctcagaccattgccaggaaaatgggcctttggtttttcagtcaacttcagtcttacactgcaagtctgcaatgaacccggagaactatttcttcccactcttaagcgtctcttcccattgctcttcacttctactagtttggttttcaggattccctgccccggtgggagatagcttaggccaaagtccagactccctgtttgtcttccttcctgggaccatttaggtggatggtgagtcacaccatggatcctattggtaattcctagtagctcatgctcagtttgaaggtaggtgatagaaaatattgtgccctagaaggtagaagtcctagaaaaccccagcaagtttcccttttgtcttaagctttcactccacattctaaaaagcagagttggctgggcgcggtggctcacgcctgaattcctagcactttgggaggccgaggcgggtggatcacctgaggtcaggagttcgagaccagcctggccaacatgatgaaacccctatctctactaaaaatacaaaaattagccaggtgtggtggcacacgcctataatcccagctactcaagaagctgaggcaggagaatcgcttgaacttgggaggtagaggttgcagtgagccgagatcgtggcactcgctgcactccagcctctgtgacaggagtaagactccatctcaaaaataacattaaaataaaaagcagagttgagctagacagaatgtaaattagtggtgcacaggaaaccagcctggagacatgttttatttgattaatttagtatctttttattttttttttagacagtctcactctgtcacccaggttggacagctcagtgcagcctcaacctcccgggctcctcccaccccagactcctgggtagctaggactacagatgtgcaccacaacacccgactaactaaaagctttttttagagacagggtcttgctttattgcccaggctggtcttgaactcctgggctcaagtgatcctcccgccttgacctcccaaagtgctgggattacaggcatgagccactgtgcccgtctgtgtccatttttaaacacctaaaaaaattcatatgaaattcctaatatcagcttctcttggagaaattggaaggaccagcaaatagggatctatattcctgtaagaactccatctcctttggacaggcaggtcctctctcctttgctacaaatccatcctctccctgtcgcccaggccagctgtcgcttttttttttttttttttttaagacagagtctcaccctgttgcccaggcaggagtatggtggcgcaatctcggctcactgcaacctccttctcctgggttcaagcgattcttctgcctcagcctcctgagtaggtgggattacaggcacctgccaccacgctcggctaatttttgtatttttagtagagatggggttttgccacgttggccaggctggtctcgaactcctgacctcaggtgatctgtctgcctcggcctcccaaagtgctggaattacaggcgttagccaccgcgcccagccttgtctgttgcctttatttctgagcttgccttgtttttcttgtgcttggtgtccttcactcatttctttatctgcctccgtagtctctcttgttatctaatcccagatacacacatgtatgcacacttactggagtttgtgaccctattatgacattttggttctgttggtggaaaaactgatcacctggaaaggtttctctttttctcgaagcaattgaaataacccgtgtttaaagataaacgtcttctgttttcagataactaagaaattcgtcaaaggctctacagagaagaacaagctcagactgcaaagagtaagacattttccctgaaatagaaaattaacctgctgtgctttttgcattaaatagtaagcaaagccctttgaagttcctttggtctagtttttacattttccccagccttctctgaccatcattttgattcctgcttcattttaagtacttggacttcatggtttgtggattgtgtcattttttggcttgctgagtgagtcctaaggttttgtgtgtggccttttctaagcttttatcaatagtgctaccactgtcttaatggttcagtatcccattgtagcttcaaattaccttccaaaaacccagtccatttccttgtagtcctgtctctttttttttttttttttttttttgagacagagtctcgctctgccacccaggctggggtgcagtggtgcgatctcggctcactgcaagctccacctcccaggttcacgccattctcctggctcagcctccccagtagttgggactacaggcatccaccaccacgcctggctaattttttgtatttttagtagagacggggtttcaccatgttagccaggatggtctcgatctcctgacctcgtgatccgcccgcctcggcctcccagagtgctgggattacaggtgtgagccgccgcgcctggccagtcctgtgtctttcacttattgctaagtgctataacatctgaatagcctctacactcgatgggtggttatcctttagtgactctctgcttagtctcctattctgtggggggcatcaccacgttttccacacagcaatgcagggggcttttgttttgttttgtctttgagacggagtcttgctctgtcaccagactggagtgcagtggcacgatctcggctcactgcaacctctgcctcccgggttcaagcggttcttctgcctcagcctcccgagtagctgggactacaggcacttgctgccatagccagctaattttttttttttttttttttttttgtattttagtagagatggggttcaccatgttgcccaggctggtctcaaactcctgagctcaggcaatcctcccgtctcagcctcccaaagtgctaggattacaggcctgagccactacacctggccgcaggggactttttacttattgcttaaaggttagagaaattgaacatcatgtcataccgaaacaaaccaaaactccagggaaggcctctgggctttgcctatgcagtgccagctcacaggaggggcctggtgaccatgggctctgcgtttactgagtgtttcctgagctccctgatgttcactgggcgtttcctgagcttcctgatggccacactgagtttttgtgtttcagatttggggttgatttttattttattacttttttttttattgagacacagtctctgttgcccaggctggagtgtagtggtgcaatctcggctcactgcagcctctacctcccgggttcaagcgattctcctgcctcagcctctcgagtagctgggattataggcacgagccaccacgcctggataattttttgtatttttagtagagacagggtttcgctatgtttgtcaggctggtctcaaactcctgacttcaggtgatccacccaccttggcttcccaaagtgctgggactacaggtgtgagccaccacgcccagcctgatttttatttttacagtttatctcattctttggaacaagagcactttttaagctcattggaacctccgagtcccgcacaccgggttggggagcggagaaagtatccaacggcggctgaagaaatctgattcacctgcagtttctagaagccttctatttcctgcttagcaacagggtgggagactcttcacccagttatgtttatagtctccttgttcagtccagacggtcaccttcctcgtgtgtctcgtatatcagatgcagtcacacagcacactggcaggaaatgcacatcagacatcttccaggctgtgtctctgtggcttttgttaaagctaccagagatgtattggaacacatttagaatttttccttagagacaagggcagatatcctaacccaaactgaaagctgagctgtcaggctccagacgtgtgggaagcccatattggatgagaggtggtcctcatgcagtgttaggagcgggcacctgtggagctgggcaggtgagcgtttttttttttattttgagacagtctcgctctgttgcccatgctggagtgcagcggcgtgatctcggctccctgcaacctccacctcccaggttcgagcgattctcctgcctcggtctcccaagaagctgggattacaggcacgtgcctccatgcccagctaatttttgtatttttagtagagacggggtttcaccatgttggccaggctggtctcgaactcctgacctcaagtaatccgcctgcctcggcttcccaaagtgctgggattacaggtgggagcctgcgcctggctgagcatgtttaacattgaacttcagattacgtaatgactgagtgtcccaggccactgccaagtctttggaatgaggaacgtagtgatgaagtgttacttccttaaagaatttgaaacaaggctgggcgtagtggctcgcccccataatcccacactttgggaggccaaagtgggaggatttcttgagcccaggagtttgagacaagcctgggcaacgtagtgtctctactaaaaagaaaaagaattcctgggctggttgcaatgggtcatgcctgtaatcctagcactttgggaggctgaggtggacagattgcttgagcgcaggagttaaagatcagtctgggcaacatagtgagactccatctctacaaaaattagccaggtgtggtgacgggtgcctgtggtcccagctactcgggaggctgaggcaggaggactgatttgagcccaggacggaggttgcagtgagccaagatagcattgctgcactccctccagcctgggcactagaatgagactctatctccaaataaataaataatgtttttttgttttgtttttcagacagagtcttgctctgtcacccaggctgcagtgccgtggcgtgatcttgaactgccttgtgggtttaagcgatccttgtgcctcagactcctgagtagctgggactataggtgtgcgccaccacattcagctaatttttttgtatttttggtagacttggggtttcaccttcttggccaggctggtctcaaacttctggcctcaagcaatttgtctgcctcagcctcccaaagtgctgggattataggtgtgagccccctcagcccagcaggattgtgttttaaatgaatcttatattgaatttcccacaagtaccaggacacagggctaattcttaacatttttctcatgatggaaggaagcataatggattatgaaaatcacttctgtggctgggtgctggggctcacgcctataattccaacactttgggaggctaaggcagaaggattgtttgaggccacgtgttcaagaccagcctgggcaacacagcaaaaccccatctctaggaaaattacaaaaatagctgggtatagtggtgtgtgcttatagcccctgctactcaggagcctgaggtgggaggatcacttgagcctgggaggtcgaggctgcagccagctatgactgcaccactgcactccaccatgggcaacagagtagactttgtctcaagaaaaataaaatcacttctgtgtaaagttgttgactggaggctcctcctggagctggtctctgaattcttatttattcatttatttttttaactgagtctcacttagttgcccaggctggagtgcagtggtgtgacctcagctcactgcaccctacgtctcctggttcaagtgattctcctgccccagcctcctgagtagctgggactacgggtaccctccaccacgcctggctaatttttttttttttttttattaaatggagtctcactctgtcactgatgctggagtgcagtggcaccgtgttggctcactgcaacctccgtctcctggtttcaagcaattcttctgcctcagcctccccagtagctgggattacaggcgcccaccatgcctggctagttttttttaaaaatatttttagtagagatggggtttcaccatcttggccaggctggtctcgaactcctgacctcaggtgatccacttgcctcggcctcccaaagtgctgggattacaggcgtgaaccaccgcgcgcagccaatttttgtatttttagtagagacagggtttcaccctgttgaccaggctggtctcaaactcctgacctcaggtgatctacccacctcagcctcccaaagtgctggaattacaggcgtgagccaccatgcctagccttggtccctcaattctgttcatcccgtccaggccgtgctgtcctccatgctgtgaaccgagcttcctcctgggagttggagggagggccacctgtcacttgccacactgtcttgtaggatcaggagcgtctgggcaagcagctcaagttacgtgcagaaagggaagaaaaggagaagctgaaagaggaggccaagcgggccaaggaggaggccaagaagaagaaggaggaagagaaggagcttaaggaaaaggagaggcgggagaagcgggagaaggatgagaaggagaaggcggagaagcagcggctcaaggaggagcggcgcaaggagagacaggaagccctggagtgagtgtccttggaggccatgctgggcccgccaccctgctgctggattccgctcctggccactctgatggggcctttccacttcacaggcagatggcggctcccttcagttccttcccatttctccttcgtgaggtgcccgtggggccctgacgtgggagcggtggaaagcagctccctgctctttagtgctcccccacgtccaactcaccctggaccccttgtctctgctgtgaccatccttccagttcccaaccaacttaggcatttgcattgcaggattgtgggttttgtctgtgctaattgtgctctgactggctaaagttttttatatatattctagtcacaggaagaattttattgactgttttccatttttattgtgaagacctatgtaaaagccttatactagacatgaaaataacttatattcatttaatgtaaaatgaaatacttgccatatactaacagttgagtgctgcggtcccttccagagccaaagcaaagagtcggctgaaatgtcatttgctgtctcacagggctaaacttgaggaaaaaaggaaaaaggaagaagagaaacggttaagagaagaagagaaggtagagtgtttcccacagagcttccccgtcccagcccgttggagaagcagatgcccaaagtggaattcttgccacagccgtcacctaatattctcttggtttggggaaaccaaatggcgcccgcagggagggcgagtctgtctagatgcgttcttgttgcttcttcccagtgctggctgtcacatgcctactggccctgcaatcctggcacttctacccacaagggcaacttggacattttgagattggctggctcagttgcgggtccgtgggttttgagagctgaaaatcacagtagtgccttcaagctaaaatgcttgacgttcggttctgggggcctttgcatgttttgcaacacatactgttcctcttcctctcctctttctcatcaccatctcttaacatcacagcgcattaaagcagagaaggccgaaatcacgaggttcttccagaaaccaaagactccacaggcccccaaggtgagcagccggctgcctttgcttttgggtttcagctctgctagacttttcctttctgaaagtgaaagggtctctccccagccagcttctctcattaggagggagggagcctccagtgacctagggcacttccatttctggttaagtcttgaggctcaatattttgtccttcgctttgtcccaaagaggtaaaaagtggcatgtctgattaaacagtgctgttttcagaggttacttcatgaataattttgtgttaggcgtaagagaaattcaccatgtttttacccttgggaaacttaggcttaaggagggagcacgtttagctgtaaaacaacagtacaattcacaaaggtttactttccctgcctggcgtcggtcacctggcatctcagaccttctgagccaccatctgtgcatggaaaccgcagccctccttcccctttacccagagggagcccatctccaatgttaggggtccttcagtgcctttccctgctccactcactgtatttatacacatgtgtacttagctatctcagatttgtgccatgttgccacatttagatgtatttcattctttttaatgtatctggcctttatttattttttgaggcagggtctcactgtcacccaggctgtagtgcagttgcacaatcaaagctcaccacagccttgacctctcagggtctggtgatcctgtcacctcagccttcccgagtagctgggactacaggcatgtgccaccatgcctggctaattttttatttttattttttttgagatggagtctcactctgtcacccaggctgcagtacagtggtgcgatctcagctcactgcaacgtccacctcccgggttccagtgattcttctgtgtcagcctcccaggtagctgggattacaggcacatgctaccacacctggctaatttttgtatttttagtatagacggggttttaccatgttggctaggctggtcttgaactcctgacctcaggtgatccgcccgcctcagcctcccgaagtgccgggattataggcgtgagccaccgtgcccggcctaattttttaatttttttttgtagagactgggttttgctatgttgcccaggctggtctcgacgacctggcttcaaatgatcctccaaacctcggcctctcaaagcacttggattacaggtgtgagtccctgcacctggcctgtccttttatttgtatgttgagacatttgatggcaattgtgtatcctgaaggtgcacaatgtgacattgttgtacctacacatcatattgtgacagccagagatccacatcatgtattttcactgccgcataatacttcataatgcaatgatatggtttctctctttttttacaaaaattatttatttatttagagacggagtattgctctgtcacccatgctggagagcagtggcgctatctctcggctcactctaacctttgtctcccgggttcaagcaattcttctacctcagcctcccgagtagctgggattacaggtgcctgccaccactcccagctaattttttgtgtttttagtagagacggggtttcaccatattggccaggctggtcttgaactcctgacctcagatgatctgcccatctcagcctccctaattttatttttagtagagactgggtctcactgtgttgccagggctggtctcgacctcctggtctcaagcatttctctcgctttggccacccaccgtgctaggatcacaggcatgagccacagagcctgccactatctcaacctctttgcccctcagtggtgtagggggggtccctgcacatgcttctctgcacacatgcattcctctgggacagccaagtaagcatgagttcacctctaggacaaaatagcatattgctgaagcatcatgagccatggccagagtgcgtgccagatgggaaactcagatgtacattcccggcgatgtgtggaaatttcctccccattctctgctatcactgcaatttttatgggattaattttcttttaactttgccagtctgatggatttttaaaaattgacattgttttactttccatttttacttgactcttggtgcagttgagcatctttttctgttcgtttgccattttagttcttctatgacttgccaattcctatttttttacctatttttctacaggattttctttttttttctttgcctgatctgtaagttttttttaacatagtctagtatttcattctccgtgatatttcgtctcagcctgttacctctttgtttacagtctttttttttttttttttgagacacagtttcactctgttgctgaggctggagtgcagtggtgccatctcggctcactgcaagctccacctcctgggttcacaccattctcctgcctcagcctcccgagtagctgggactacaagcgcccgccaccatgccccgctaattttttgtatttttagtagagacggggtttgcaccgtgttggccaggatggtctcgatctcctgaccttgtgatccgcccgcctcggcctcccaaagggctgggattacaggtgtgagccaccgtgcccggcctttgttgttttttgtttgtttgttttgagacaaagtttcgctcattgcccaggctggagtgcagtggcatgatctcagctcaccacaacctctgcctcctgcgttcaaatgattctcttgcctcagcctcccgagtagctgagattacaggcatgtgctgccacgcccagctaattttgtatttttagtagagacggggtttttccatgttggtcaggcttgtcttgaactactgacctcaggtgatccgcctacctcggcctcccaaagtgctgggattacaggtgtgagccaccacgcccagctacagtgtctttcatcatactgaaatttctccttttggccaggtgcggtggcttacgcctgtaatctcagcatttggggaggccaaggcgggtgaatcatctgaggtcaggagcttgagaccagcctggccaacaaggtgtctctactaaaaatactaaaaatacaaaaattagccgggcgtggtggtaggcgtctgtaatcccagctgctcatgaggctgaggcaggagaatcgcccaacccaggaggcagaggttgcagtgagccgagattgcaccactgtactccaggctgcgcaatgaagcgagactccatctcagaaaaaaaaaagaggagttgtgatctttcaaaaaaagaccctgtcttttttttttttttttttttttttttttttttttttttttgagaaggagtcttgctctgttgcccaggctagagtacagtggcgtgatctgggctcactgcaacctctgcctcccagatccaaacgattctcctgcctcagcctcctgagtagctgggactacaggtgcccaccaccatgccaagctaatttttgttttgttttgttttgttttgtttttgagatggagtcttgctctatcccccaggttggagtggtgcagtggcacgatctcggctcactgcaacctctgcctcccaggttcaagcaattctcctgcctcaggcccaggctagagtacagtggcgtgatctgggctcactgcaacctctgcctcccagatccaaacgattctcccacctcagcctcctgagtagctgggactacaggtgcccaccaccatgccaagctaatttttgttttgttttgttttgtttttgagatggagtcttgctctatcccccaggctggagtgcagtggcacgatctcagctcactgcaacctctgcctcccaggttcaagcaattctcctgcctcaggctcccaagtagctgggactacaggtgcatgccaccatgcccggctaattttttgtattttagtagagaccgggtttcactgtgttgcccaggctggtctcgaactcctgagctcagacaatccacccgcctcggcctcccaaagcgctacaattacaggcgtgagccaccgcgcctggcctaatttttgtatttttagtagagacggggtttcaccatcttggccaggctggtctcgaactcctgacctcaggtgatccgccctcctcagcctcccaaagtggtgggattacaggcatgagccactgcccctggcctaatttttgtttttagtagagatggggtttcaccatgttgggcaggctggtctcgaactcctgacctcaggtgatccgccttcctccgcctcccaaaatggtgggattacaggcatgagccactgcccctggcctaatttttgtttttagtagagatggggtttcaccatgttgggcaggctggtctcgaactcctgacctcaggtgatccgccctcctcagcctcccaaagtggtgggattacaggcatgagccactgcccccggcctttttttttttttttttaagtgaggtttgttgagatataatttacatccaataaaataaactcttttcaggacatttgtgttgacaaatgacagggccagctaaccataatgaagataaaccctatttccatcactcaaaacagctcccttgtagtctgtccccccaccgccggcccttgagactgccaatctgccctctgccctgtagctctggaaactcggctctgtggacccacacagtgcctgggcttttgagtctgtgccttggccttagcctggatgaatcccaccagcaccctgctgtgtgcgtccatggtgcctcctttctcccattgctcgaagaccccatcgggtctcttcttgatttcagaccctggccggctcctgtgggaagtttgccccctttgaaattaaagagcacatggtcctggcccctcggcgtcggaccgctttccatccagacctctgcagtcagctggaccagctcctccagcagcagagcggcgagttctccttcttgaaagacctcaaaggccggcagcccctgaggtccggacccacgcacgtttccacccggaatgcagatatttttaacaggtcagagcctgaggaggtcggccttcacccactagtgatgctggaggccagcatcctgaaccctggggtccccggggtgggagctctgggtccttctgttgcttgcttcctagtgccctcgggccctgggcttcggtgctggctcaggcctctctccacctggccttcctgtaagctcctgaagtcttcctctccctgtcttcccagctcctcgtggaggaatcttatttccctgctggtctccagtgaaggataccccccaacaccccgctcttgcaaatctcattccacagaacctcccttgctaaaaatgctctggggctgcacctgggcagctgtcctccctctcaccctgcaggctgcaccctcctccatctgtcccttcagtccatgttcctgacctttctttggggacaggcagtgctgctttttaacaaatgcccatctttctagaattgttaggccagcttcacagggaggttcctgggaggtttgtgagcaggtctgtaaggcagcgtgatcctgagcctggggttttccttctcagtgatgtcgtcatcgtggagcgtgggaagggcgacggtgttcccgagaggaggaagtttggcaggatgaagctcctgcagttctgtgagaaccaccggcctgcctactggggtacctggaataagaagacggcactcatccgcgcgcgagacccctgggcccaggacacggtgagctagccccagagtgcctccgtccccgtacctcctcactgtgcccctttcctccagccccaaagacagttgtgagtcccatgtgtttcttttctcagaagctcctggactatgaggtggacagtgatgaggagtgggaagaagaggagcctggggagtccctgtcccacagtgagggggtaaggatgtgccccagctgtcttcactcacagacggcttgtgtttgagtctctgtcccacagtgaggggctaaggatgcagcccagctgtgttcactcactgacagctggtgtttgacctgctgtgtggtctgaaacctgaacgcacctcaacatccagacttccagcttctctcgaaaaatctcatctggtgacactcgcccacgtggctgctggggatgggatcccgtccgcatctgcaccgtggccccacagccccctcttgcctcctgcgggcctgctgcacaccatttcctcctgactgcccagctgctgtgacctagtgggctttctgccgatgctcaccgtgtctgtcgggaggccatgcaaagcagatgttcacagctttacatttttttgtttctttaagatggagtctcactctatcactcaggctggagtgcagtggcgcgatttcggctcactgcaacctctgcctcccaggctcaagtgatagtcctgccccagcctccctagtagctgggattataggtgcgtgccaccatgcccagccaagatttgtatttttagtagagacagagttttaccatgttggccaggctggtctcaaactcctgacttcagatgatccgcccacctcagcctcccaaagtgctgggattagaggtgtgagccactgcgcctggcctactttgtttttaataaggcacacactctgcttttctatctgatgaactcttttttttttctccttttgaggatgatgatgacgacatgggagaggatgaagatgaggacgatggtttctttgtgccccatgggtacctgtctgaggacgaaggtgtgacagaggtgagggagtgaagggggaggtcaccggctcagcaaaagttcatttctggactggtgctcagtggcctgacctgggagggtgacgggggtcccagcccaaccatacgagatttggactgcattccaagcacgcaagctcactcgtgggaacagctgggcctgaacttggtattacctgggagggtggcagacgtaggaggagcttgcaagcgaggggagccataggagcagacaccctggtgagggagcgtggccatggtctgtgggttagaaggctggaaaccacccgagctgacatacagtcagcatgcagcaagacatgtgcattgtaagtgttgagtttgatgacgtaacaatcaagtgaatgtgggcaaccaccgcccgaaataaaacagaacttccctatctctccagaagattgcccacgtctctgcaggcgaacctgcctgccacccctttccagattccataaggttgtggaactgtctttttttttttttttcttgagacggattctcattctgttacccaggctggagtgcaatggcccggtgttggctcactgcaacctctgcctcccgggttcaagcaattctcctgcctcggcctcccaagtagctgggactacaggcgtgtgccaccacacctggctaatttttgtatttttagtagagacgggagttcattatgttggccaggctggtcttgaactcctgacctccagtgatccacccgcctcggcctcccagagtgctgggattacaggcatgagccaccgagcccggcaggaacttgctttcaagcaagttgtttttggtcctgttttgttttgaaggcctgtcgtttgggaagtggggatttggtgggactgtctcatggttggactggaggcctaggcattccttgtgcatatctgaccaccgaggcctgaactgtcagtcagagagtggtctcaggccctgcatgtgtctgccagatgcctgggccatgtgggtagacacccaaccctgttaaacggctccacgatcacacattcaccagaaaattcagaggggtgttaaaagaggcctcatgggtgagttcagaaatatctgtgacgctcccaaaggagaccaggtgtgaattattccatctggaagaggggcagccagcgcatggtgtgctctgccctggccctgacactgtgggaagttttgtgcccctgtcctttcctcttgctccccagctggctggggactggttcctcaaaagagtgcctgggcataggggagcaagaaccccaaataaacttctgctttctaaaccacaaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagagtgagtgtgggcggggccaggccacccacctgttcctgggcccagctaattccagggctgagggcaagagtcacaggctagtgggtccgtgatgcaaatgttctttccacaaataacagaggccagcccttttcctgtacatgtccgtacgttcaatgatgtccctagcagcaggacgaggcaggtcccttaattggcttgttttatcaaccaggacacaggcacagagagtgctggagtgggggctgtgctttctcaaaagccagggaggggccgggcacagtgcctcatgcctgtgatgccagcactttgggaggccaaggtgggaggatcgcttgagcctagtgcttcgacaccagcctgggcaacatggcaaaaccccatctctgcagaaaatgcaaaattacctgggtgtggtatcacgcacctgtgatcccagctactcaagaggctgaggtgggaggattgcttgagcctaggagtttcagaccacagtgagccatgatcctgccactgcactccagcctgggtgacagagcaagaccctgtctaaaaaaaaaaaaaaaaactcaaaaaactggggagggaccatggcacacaaggagagcagggcagtcatttgggtaggaacagcaggcatttgaagtcagccctggcaacacacgtgcccggccaaggctcacttctgggcaggtgcgtaggtgctaccctgtcttacacccgccctcatgaggccacctatccccgaagctggccatgccccaagcctcagtggcaatgagcttgtgtatgtgttttgttttttggcctgtggtgatgggtggctccccaagcctcatgcccacccatgttccctcctgccagtcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtcccctccacggggcccagccagggcactcccatctcgctgaagaggaagtcagcgggcagcatgtgcatcacccaattcatgaagaagcgcaggcacgacggccaggtgaggtggggtgggcaggtgggggcctctgcagggcttttctttttttgtttgttttttgttgttttgtttttttttcgagatggagtcctgctctgtcacccaggctggagtgcagtggcgcaatctcagctcactgcaacctcctccctcctgggttcaagtgattctcctgccttagcctcctgagtagctgggattacaggtgtacgccaccatgcctggctaatttttgtatttttagtagagacggggtttcaccatgttggtcaggctggtctcgaactcctgacctcatgatccgtctgccttgtcctcccaaagtgctgggattacaggcgtgagccacctcgcctggtgtttttgtgttttttaaataaccttactcttagagcagttttagggtcacagcaaaatcgattggaaggtacagaaagttcccatacacctccttccccaaagccaagccaagccacccaacatcacctcccagaatggtgcattggttacaatcagtgcacctcaggccaggcactgtggctcacgcctgtagtctcagcactttgggaggctgaggcgggaggatcacttgagcccgggagttggagaccagcctgggcaacatggcaaaaccccatctctaagaaaaaatttttagattagccaagcggtggcatgcacctgtagtctcagctactcaggaggctaaggcgggaggattactggagcctaggagattgaggctgcagtgagctatgatcatgccactgcactgcaacctgggcgacagagcaagaccctgtctctaaaaataaatacataaaacgcaccttcgttgatttatcaccaccactagggtttgttgctggtgttgagggttctgtgatttgaatgaatgttggatgctgtgcgtctacctttattgttttaaacaaagaggcttctccccactgaaaggcccctgtgctctgcccgtccaatcccttggaaatcaccaacctctctatctccgtggatcagccttttccagattgccctgtagctggaatcgcatcgtgtgtggctcctttgacttggcagtatgcgttgacagttcctccgtgtctgtttgtggcttgatagctcttttttttttcacactgaataatattccatgtggtagcatttttatttttgttcaacggttcttgaattttgcattcaagcacagttattaagcacttactgtgctccaggcactctgatcggtctctcagacacaggtatatgcagaacaccgcccggtgtaaggcacagacaggagcctgtaaggggaatgaatggctgtgtgattccagccttatgggtgcctcggaggcacaagcgcatggagccctggggtgtgtgatgggggcactgtctggtcttaagaaactctcatgcccagagagccactggcccctggcacccacccctggccatagatcggctttgttaacgttcattgcatactttttgtccttaccacacagtgttcggaagtgagtttctcttttttcttttttttccttttttttttttttttttttgagacagtctcgcgctgttgcccgggctggagtgcagtggtgtgatctgggctcactgcaagctccgcctcccgggttcacaccattcttctggctcagcctcccgagtagctgggactacaggtgcccgccaccacgcccggctaattttttgtatttttagtagagacggggttttaccgtggtctcaatctcctgacctcgtgatccgcccgccttagccttccaaagtgctgtgattacaggcatgagccaccacgcctgtcctggcctttttttgagtcaggggtcttactctgttgcctagtctgtagtgcagtggcgtgatcaccactcactgcagccttgacctccccaggctcaggcgatcctcccaccttagcctcctcagtagctgagagggactacaggtgcatgccaccacacccagctaattttctgtagaaacagggtttcaccatgttgcccaggctggtccccaactcctgggcttaagcaatccccctgcctttgcctcccaaagtactgggattataggtatgagccaccgtgcctggctccctgagtttgatttctaatatctacacttaacgcagacctatctgtccctgtgaaccttgggctttccttcaaggccacgatctgatggagttacaggttttcagagacttgggacaaggagcaagacagtggataacccccggccccagcttgcatcctcttctctgatgttaaaggtggtcgttggctgggcacagtggctcacgcctataatcccatcactttgggaggccaaggcgggcagatcacctgaagtcaggagttcgagaccatcctggccaacatggtgaaaccctgtctctactaaaaatacaaaaattagctgggcatggtggcaggtgcctgtaatctcagctactcgggaggttgaggcaggagaatcgcttgaacccaggaggtggaggttgcagtgagccgagaccacaccattgtactcgagcctgggcaacacagcaagattctagtccccccaaaaaaaaagaaaagaaaaggtggtcgttaggggcagggaggcgagagaaatggctcctgagatgatgctcagccatctccctgctgccagcacacagccatgggccttaatatgctgtgaatctccctcagctgtcacagcaggaggggccatcataacatcccaaagggtccagggctacgactgaaactgttcctggcactccctagagcctctgtccctgtacagtgtgtcatgtgcatagttcccctggctctgtggaggcggcttggcgccgtgggaagctcagtgcattggagctggggccacaggaggcccccacacagagctttgctggatgcattctttgttcaagccctgtgtgagcagtgcctttccctggtcacctgagcagccttagagggaaccggagctccccagcctgaaaatgatcggggcgggaaggtactatctggttgtgtcactatgcaagcagttttccagggcctttgcttatcagccctcccctgggaacccctgtgtccctcagatgttcctttggggtctcctcatgctccacacagtagtccaggccctggacggcctccttccccacccctctccactgatttgatgcagcagctgcctctcccagctggggtgcagtgccccgcccctggtcctcccaaacactgctcttgctccctgtcaacatgtggaacccatgtttccccacccggaaaatagcgccctgagccccatgtgcccagcaccacatcagagttactgtgcttcgggggcagtgagtgcctgtttatcatccctaaccacaaggaaagaagggtgcacccagtttaactagagtgggtcagagaggttgggtgggccttggagttagcaaaacacagcatctcacctgctaatggatggcagtggtggccacatgcgcgtgattggtggcctctgctgtgtggcacaggtgagggcctcctggggctcagcagtgcagcggacgcacgaaggtcacacgtgaaggaatggagacccaggcccagcttgatgcttaacccccacccctgaacctcctgcagtttgggacataaacgtccctggggagcagggtctggtcctgtgttttttttcagagcttgtgtggggaggggcacacaggtgggacccaaaggtggggctgtggaagcacatgagcccggatgggacatgtgccctggcatcctctgtttttttttgacagggtctcactctgttacctaggccggagtgcaatggtgcagtcacagctcaccgcagcctccactcctgggcgcaagtgatcctcctgcctcagcttcctaaggagctgggagtatagaggcacgtgccaccatgcccaactaattttcaaatattctgtagagacagggtctatgttgcccaggctggtctccaactcctgagctctagcgatcctctctccagcctcctggcatttaataaagctgctgactgatgcttctgcacccaaggggagggataagccattcatctgcaagtggtgtacatccatattttttactcggttacactttttttcccaatttgaaagttttcatcttttttattttattttattttattttattttgacagagtctcgctctgtcgcccaggctggagtgcagtggtgcgatctcagctcactgcaagctccacctcctgggttcacgccattctcctgcctcagcctcccaagtaggtgggactacaggcgcccaccaccacgcccagctaattttttgtatttttttagtagagacggggtttcactgtgttagccaggatggtcccgatctcctgacctcgtgatctgcccgccttggcctcccaaagtgctaggattacaggcgtgagacaccacgcccggcatcttttcttgttgttaaattagaaacagggtcttgccctgttgccctttattattttaggttcaggggtacatgtgcaggttggcaaactcatgtcacgggggtttggtgtatagatgatttattgggtactaaggtattttttctgaatttctccctcccaccgtcacataggctccagtgtctgttgttcccctctttgtgtccacatgttcttataagtgagagcatgtgatatttggttttctgtgcctgcgttagtttgctgaggataatggttcccagcttcatccatgttcatgcaagaagaggtttttttgttttgttttgttttgttttgtagatattgggtcctgctgtgttgcccaggctggtctttgaacttgtgggctcaagcaatccacctgcctcggcctcccaaagtactgggattacagacctgagccagggagtctttaaatctttttacttagagctcaaaagagatattcttaaggcattctgacctagtggggtgaagtgccatgtatctgtgaagccctaggacacctcaactcttcgggcctccgttttatttaaaaattttaaaatacaaggaaggatgtgtttgcccttgccaacaaaacattatgtgatcaaaataaaactaaagaagcatagatggccgggtgtggtggctcatgcctgtaatcccagcactttgggaggccgaggtgggtggctcacaaggtcaggagattgagaccatcctggctaacatggtgaaacccgtctctactaaaaatacaaaaaattagccaggcgtggtggcggctgcctgtagtcccagctactcgggaggctgaggcaggagaatggcatgaacctgggaggcggagcttgcggtgagccgagatcgcgccactgcactccagcctgggcaacagagcgggattctgtctcaaaaaaaaagcatagatggctgggtgcagtggctcacgcttgtaatcacaaaactttaggagaccgaggcaggcggatcacttgagaggccaggagttcaagaccagcctggccgacatggtgaaaccccatctctaaaaatgcaaaaattagctgagcatggtggtgcacgcctgtaatcccagctactcaggaagccgaggcaggagaatcacttgaactcaggaggtggaggttgcagttgagccgagattgtgccactgcactccagcctgggcaacagagcaagtctgcgtctcagaaaaaaaaaaaaaagacaaaaaggcacaaatgttagtgacaccatcttcatcccatgtagtcgttaaacgttttcctgactcctgttttccgtagtctgcgctcctccgtgtctgtgtttagcacttgcagtgctgctggcgagatgacagctgtccccgtgaagcaagctgccggcagctcagcacagtgggactcggtgttatgtgttaaatcctgtcttcagcctagagggtgaagagtggtgattgctctgaaaaattttggatccaagaaaagcctaatgtgtcaacgcgtctcctgtgtggagggagggcccagtgacttgaggtggctctgaagaaattggcatgttcttttgtttaacgtccccagacacctccagatcagaatgtccctcctcagcagcgtctacaggggactcttagactcttctttgcttaactattctttcaaaaaggtagttgaaaatggccgtaggccaggctcagtggctcatgcctgtaatcccagcactttgggaggctgaggcaggaggatcacttgagaccaggagttgaagggtgcagttacctgtgattgcaccactgcaccacagcctgggtgacagagcaagatgtttctcctgtgtcctcacagggtcaacccatgctgcctggggagagggacagcctgggctcccagccactgaagagaggatccaggaggggagcccctacccaggaattgatgaggctacggtaggaacccagtctgcctggccaggcactgtgctcttacatgacagcccatgaaaccagtctatggcctgaccgttgtgttgctgtgcggtcacttttctaggtttttgtagaggaagaattcctggaattttttgaggactatcctccctactgaaataagtgtggctgtctgtcctgggatgggcttgtgttcatgcacagagagggtaagcactgacgtggaggctcatggtggcctctacgcatcctgtctttctcctttggtgaaagcaaatggaaacagctcaggaatcttactagggtcaggtgcggtggctcacaccttgtcatcccagcactttaggaggccgaggtggaaggatggcttgagcccaggttgagaccagcctgggcaacatagtgacacccccttgtctctacttaaaaaaaaaaaaattagctgggcgtgatggcgggtgcctgtagtcccatcttctcaggaggctgaggcaggagaatggtgtgaacccaggaagtggaatttgcagtgagtcgaggtctaaaaaaataataataataattcacaagtcacagtcatcacttcacatcagggacgtgttctgagaggtgtcctcaggcaatttcatggttgggtggggctaggttgctcttacacatcctagatggacagcctgccacacgcctgggccgtgtggtacatagcccagggctcctgagctgtggacctgtgcagcaggtgactgactgctccatcctgcaggcacttgtaacccagtggtatatgtgtctttaacatagaaaaggcacagcagaggccaggtgcggtggctcatgcctgtaatcccagcactttgggaggctgacgtgggcgaatcctgaggtcaggagttcgagaccagcctggccaacatggcgaaacccccgtctgtactaaaaatacaaaagattagctgggcgtagtggcgggcacctgttaaaaaaaaaaaaaaggcacagcaaaaatatcgttgcggctggggcagtggctcacgcctgtaatcccagcactttgggaggccaaggcaggcggatcacttcaggtcaagagttcgagaccagcctggcaacatggtgaaaccccatctctactaaaaatacaaaaattagccgggtgtggtggcaggtggctgtaatcccagctactcaggaggccgaggcaggagaatcacttgaacctgggagtcagaagttgcagtgagccaagatcgcaccactgcactccagcctggatatatggcaagactctgtctcaaaatttatatatattaaataaaaatacagttgtctgtaatcccaggactttgggaggctgaggtgggtagatcataaggtcaggagtttgagaccagcttgaccaacatggtgaaaccccgtctctactaaaaatacaaaaattagctgggcgtgatggcatacacctgtaatcccagctactcaggaggctgaagaacgagaatcgcttgaacccgggtggcggaggttgcagtgagctgagattgtgccactgcactccagcctcagtgacagagtgaaactcccgtctcaaaaataaaaaataaaggccaggcatggtggctcacacctgtaatcccagcactttgggaggctgaagcgggcggatcacgaggtcaggagatcaagaccatccggataacacgatgaaaccccgtctctactaaaaatacaaactgggcgtggtgtcaggcgcctgtagtcccagctactcaggaggctgaggcaggagaatggcgtgaatccgggaggcggagcttgcagtgagtcgagatcgcgccactgcactccagcctgggcaacagagcgagactccgtctcaaaaaaaaataaaaataaataaatacagttgtaatctgatggggccactatcaggtatgcggcctgtcactgactggaaattattctgcagttggcaatgatggctgtttttggagatctgaatccagttcatttgagggaacccccaaggttctctggttgtggcctcttgaataaacctctcacatttggacagtttgttaccaaattgggttctggatgttggtttccttccgtgttgggggtgggaggaaggtgtcacacctgtggagttccccccgctaccgcactggcaccagggtggctgctgcctgcagtgctgatggccgtgtaccctgtctgtccagattggtgctgaagacatggacggcttccaggcagacacggaggaggaggaagaggaggagggcgactgtatgatcgtggatgtcccggatgctgtgggtgagaagggctgtagatagcagaacgcactggtgaggtgggcgctggaggtaaacctcaacagagaagggatggggctgcctaagactagctccactgtgagcagccaggagggcttgcagctggaagtggctcctgccctgccacatcctcgggcgggctgggccgtgggtgctgaccatgccaggcaccgttctggccgcagagccacaagggcctatgctgggagtctcaggtggttgtgacgttagatgggggtcagggaaggctgcactgaggcagcaagggagggccaggtggatttctggagcactcgccaaagaggaagtacagaggccctgcagcaggctgcgtgggaggagtgtgcccgggtggtggggggcaggcagggtcaacctgagagcaggtgagcaggtcacctctagaagaggcacaacgccccagcctctgcctgtccccactgtcaggtggagggtcccgccctggggttgttgcaggccccatgaggcagcagggtggggtcttcccccagggagcccagagggcccagccagctcaagaccctccctctcttgccctgcagaggtccaagccccgtgtggagccgcttccggagctgggggtggtgtgggggtggacaccggcaaggccaccctgaccgcgagcccactgggtgcatcctgagagcaggggtgacgtatgtagaacgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcctattggggaagcctgcgggcacaggagcaggcgtggaatccaatacttgtaaatgaattgaagcgtcaggaccacccgcctggccacgtgcgcgggcccctggacctaacgaggcagtgtataaacttattctctagccctgagctgctctgtctgtcttttccgaaaacattgtgtttctctgagagtgcaccttgcccatggcccggccccatgtggtgcctggtgtctggggccagccttgtgccctgcaacagcaccgtcccatctgtttgtcactaagtcaccctcataccaggctgacctgggtcaaggtgcgggtttttccgcacgtgcttctgtccggcgatccctcctgccctgggttggggggttaggagagggtgttcccagagacctgctagggtcacctccctgaacccggagctgctgggagccgagtttggcttcgagtctgaggctttgtgagagcccaccccaggtcaggtgcatcttttgcgagtgctggagctagaaggtgacctcctccccgccccaggttgagtgggctttatccacactgtccgagggaggacaggcgacagccgctgtggtactgagcagctcagagcacacgcagccacggggagggtcacgctcgccagtcctgctcttcccagccacaccccacctgaagtcctaagcttcccttcagggaaccctatgtgggaaaagtgtcagctacctccatccacccagtcagggacggcagggcgcccgggccaggccttcctgctgggaagcaggattcagctgtgcctgaagcagaggctgcccctgtgccacacctttgatgagctttacaggggctcccgacaacccggaatcaggtcctggggcctgcaggacgcaggactggagtgacagcctccattctcaacaggccgggtgcccacaccagctggggcagtgccgggggcgagggagggaccaatgcaaggtcaggggcacgagcataggccccgggcacctcccccaggtgcagacctgcatccccaagtcagcagtggggccggggcacacatgccttccacactgcagggcagagtccctgtgtctcctggggctgctgtaccacaaacctggtggcttaaagcaagtcaccatctcacagcttgggggtcagagtgcacacatgccccgccaggctaacatcaagctgtgggcaggaccaggccctcctggagagtttcccagtgctcataggcgctgcatccctcagctcggggtcccttcctccaccttcacagccatgcgcagcctcttccagtctctctctgattcaccctcctgccacctcttgtgaggacactgggtcccggaccacccaggatcatctcccagctcaagacctttcatcatacccaagcccctcttgccaggtgaagttgcgcatctgcaggttccaggaataggatgtggccgtctcaggacaccctgtccctctggccacagggaagccaggcctgtgacagcactcgcctcccctgcagggactgggcctttgtgggcacagcacagcctcccctagcgcacgggacttcctccccaggtgggtggctcatcgggcacttgtggccaggtgctggcctgagaacaggtatccacatggtcccaccttgacagggagccacacccagcccccaagccatccgctctgcagcaggtgggcctgccctgtgtcccacggtttcaacggagaaccaagaaactatattcaaacaacctgtttatttgggcttatgatttactaactgcaggtctatgtgcaggaaggccagcgtcccctcctgccgttgtcacccacatccacagagcagccctagtgccaggtgcagccactgccacccacggcacacgggaacgggacccatgctgcaggcctgctctcctgcccagggagatgccacgtgtgtctgtccggcagcttcatgacacagttaccaagcagctagggagggcttagatttgttggtgtccccaggcctctccctcgggggcttgggcgcatccccacagcccccaagggatgggggctctgccacggggcccaattccacagctccacggctggcgcccctcccgtgcccatggggcagagccaagtatttccagaggtggcttggaggccctggggtggcggggagaggaacagggagagcatgagacagacccacagggctgaggccaaccctgcttttatttcacaagagcttctcgatggctgacaggagctcgggtttcaggatggagtccggctcggcccccgcggccttgatgtcctccagcacagccatgtcccacgagaaggtcaggagggcagagggcacctgcggtaggggtaggccgtcactctgagaccgagagtcggcccttgccgcggcagggaactcagcgggcaacctgggcgcggggatgccccggcctggaagccatctcagctggtggaggctgtggctcgcacccaggcctcctgccctctccctccgggactccaggacctaagcctaaacctactgcactagctaacgcacgtcaccgctcccatttgatggggaaactgaggcgtggagtagttatgaacttgctcgaggccctgctgccagtaagtgggaaagcaggattcaaacccagggacctgcccaggccccctgctctgagaacaaggaggctccctcctgggggtgtctgtgccggtcccaggagaacctgcagaggcatcgggtcagcggtgctcctgcgggccgacactcaccagcccgcactcgttcaaggccaggttctcgtcctcggacagcttctgccctcccgaggccagcagctcaaaaggcagccagtcgctctgcagggcctcccggacgaacccgtacaccgcccccagccgctcccgagcgtagaaagtgcctggggagtgggggagtcagagcgggtggggcccagggccccctaccaacccgagccgccctccacgggcatcgttggtgcccaccctgcaggaggcagccatcggggaggcgcacgcgcagcagcgtgtagttgtacttgcgcagcccccgctgctcctccttctcccgcatggccttggtccgcagcacgctcagccgctccaccgcctcggacctgcacacgcgggccaggtcatgagggctggccggggttcttccaccccgccccgccccactctgctccgcggacgtcaggcccacctgagcctctgctcccgcttgatctcctctgctgtgaggttgaagaagtccccaggcagttcgaactgcgaggccaggggcgagggctggaagacgcggcgctgcctgtccagcttggcgcgcacgggctccgcagccagcagctgttccttgtgcctctccaggctctggggctgggccaaggtggtctcgctcagcacgtagaactcctcggggtcctctacagcgtggcaggacatgggtgtcactgtgcaatggagagacccccaagccgggccctcctgccccgaggcccctcgtccccattccctactcagccaggccctgtccacttaccctgatcctgggcgggaagcaacaccttctggaacccaatggcctcaaaaaactcgtgggtcccttccaggcagttaatgcgctcctgggggtggagatgggcgtcactgggggcccctggcttcctccatggcctggccacaccccacccagtccaggggctcggctctcgctattgggagcagctgtcgacccctggatggggcccagccctgggggtgcctcagtgctggatgcaaacctgcttttctacggtgggggctgtggagtctccaacagctctgcacagaggaaagagtcacaaccaggcacgaagagtgaggctgaggagccagacactgctggggcctgatgcgaggctaacaccgcccaggaccccagtccctgccctttcccccagaagaaccagacatctggtttgcatgagaaacctccccagagtcgacatgttcccaaacaagcccagctgaagaggaggaaaaggatgcaggtgaggagaggcagaatttgttgatttggggtgaccggtgcataaaagtcttgctctccatcttgtcctgctaccttctactggccgaacccttcactgcttgtggctcaactctcgctagctcctccagggagcccaccgcctggtgtgggccaccaccggctcctgcaggccagctgcccccacccccagcctgggccccgggggccagaaggcacgcccacctgaaacaccttgttctgcagcttgatcttccggtacttctcctcctcggggtgcaggtggatgttgtccaggtacctggggtaggtggagaaggtgagtggggcacagcccaggctgcccacccggcccctctgtgcctcctgctccaggtaacagcagctcagccacacttggcctctagtcagagggaagaagcggcccagtgacgcgagggcagcagaccatctccgggtggaaggcacacctcggacaccccatggagcccacccctggtgccagcaggagccccacggaacccctcaccgtcccaccagccctggaagggcacaattaaccacagcggtggggaagccacagtgccggaagagtggagagccagagctgaagggccgcagtgccagcagggggctcctgcggggtgctccctcggcgttggcgggcagcgtggacctccaggcctgcccccgatcctgagacccggggagtggggtgggaccctgcctcctccacatgttccccaaggaagccagggtgggaaacccctgattccttcaacaccttcattttgcacacgggtaaactgaggcccaaggaggcccagccctttgcctgaggcctctgggtggagctgcctcactctcggcctatgctccttcccaacccacctcagcaggtaatgagggggccagagggggtgacagccccagtgggaggggtgctgggatgagctggaggggccaggcagggcaaaggggccacacgctcacttggcaatggtgtccacacccagcttcacccggtcctggtctttgttgaacgtgtagatcttcatgatggaggcggccactgggtcggtggagaagtgctgggaggagggaagcagggaaagccactcactgagagcccgggccgcacggccctccgctgcccaggtaacaggggcaggaaaaggaaggcagaacagcggcttggagcggccccagctgtgcgctcatcacagaaaggaaaagagagaccctccaagaccgcagccctgcccacgccccagggcagaggcgacgcagccaagacccagcagaactcaagtctccccttccgccttctcaaggctagatccatgggacttggaagccagtgtgacgcgacagaactgtgcctcacactctggctttagaactcgacctcagtgctgagatccatcaaggccaccgccacttacagaacctcccgccaccatggacgccccatccctcctgctctcgcagccccatgatggacgttctggaaccactcccgggcctcatgtttacaaagagaccgagaggcccatcgtccagggtcacagggatggcaggtggcagagaggacacaaatgagtctgcaaccctcaatgtctgaaactcaatagctggaagacggatacccccagcccctgcccctccccgaggtcccacctatccacctatgttaccgggggaggggagaagtcatagctggaactctgggggtttcccagaaccagccctgctgactgcgaacagcgtcccagcatggagaggctgagaacagtacgtaccctaagacctggaaaagattggggcacaaatccacgctcggcacagccatcacacacggccacacccagagagccacccatggcctgggaagcagggctgccacccgcacctccctgggctgcccagatgagggcgggtgaacagaagggcagcccagggccatgtgtcaggattcgggccacctgcccaggcagcccagagctccacccaccaccccccaccctcaactgcacagcagggtccctcagcagccccctgcgtcacacggaccaatgacctacacactgagccggggctcatgccaactgaaaattgggacccggcccagtctgccggtttagttgctgagatgatgtggggagcgggacagagcacgtggatgcagagaggcagagctgccagatgggcatgtccccaagacaacagcttccttgggatcagagcgcccgggacagcacaccagccaagggaagcgtgtcagctccaaaagcgggcctcgggcgttttgggcgactggctgccaggcttaggtcaggagctgggtacatgcacagacaagggacgaaggaacagcagccaggaaggggtccaaatccatacaggaatgtactttgtgagaaaggtgggatttcacagctgtaagcaaaagacaggtgctctcgacaggtggggctgagaagaaaactgagccaagatctaaaaaaaaaattacatcagctccatcccaccatgttacataataacatgctccagctggatcaaagcttcaaccatggaaacaagcaagcagtcaaggagaagccagaagaaaagctctggaggccgggcacggtggctcatgcctggaatcccagcactttgggaggccgaggcggtcggatcacgagattaggagagcgagaccatcccggccaacatggtgaaacctcatctctaaaatacaaaagttagcccgggtgtggtggcgtgcacctgtagtcccagctacttgggaggctgaggcaggtgaattgcttgaacccgggaagcagaggttgcagtgagctgagattgcgccactgcactccagcctggtgacagcaagactctgtctcaaaaaaaaaaaaaaaaaaagcactggagaggccacaaaagaattctctcagcatggaaatggggaaggcatttctaagaatgaccccaaacccaaaagccatgaactaaaactgacacatttaattatacagagatcaaaaaatcctacacagcaaagtgaccataagcagagccaacatagaagcaactagagggaaacatgtgcaactcatatcataggcaaaagcctaaattgcctaatatgtaaagagtgctgccgggcacggtggctcccgcctgtaatcccagcactttgggaggccgaggcgggcggatcacgaggtcaggagatcgagaccatcctggctaacatggtgaaaccccgtctctactaaaaatacaaagaatcagctgggcgtggtggcggttcgcctgtggtcccagctactcgggaggctgaggcaggagaatggtgtgaacctcgtaggcggagcttgcagtgagcagagatggcgccactgcactccagcctgggcgacagagtgagactctgtctcaaaaaaaaaaaaaaaaaaaaaaaaaaagagtgcctacaaatcactaataaaaagacaaactatctactaaataatgtagaaaggacgcattctcatatgaaacatggccaatccaaaataaggaaagtgcaaattaactctatcctgagatgttattttcacctaccaacaggcgtaaagatcaaagtttggtgatttacagtatggtgagaggatggggacacgggtgcttttgcacacactgctggagtgggtgtgagtctggagagtctatggaactattactattttgttttgttttgtttttaagatgaagtttcgctcttgtcacccagtgtccacgctggagctcaatggcgtgatctgggctcactgcaacctccacctcccaggttcaagcgattctcctgcctcagtctcctgagtagctgggattacaggcgcctgtcaccacgcctggctaatttttgtatatttagtagatagggggtttcactatgttgaccaggctggtcttggaacttctgacctcaggtgatccacctgcctcagcctcccaaagcactggaattacaggcaagagccaccgcgcccagccacttactattttctgagaaagggtctcacttgtcacccaggctggtgtgcagtggcatgattacagctcactgcagcctctacctcccaggctgaagcaatcctcccacctcagccttctgagtagcagggactgcaggtgcacgccaccatgcccagctatttttttttgtttttggcagagacagggttttgccatgttgccctggctaaagccgaagtttctgagaacctattgatggtgttaagtgaggacttgctgtattggaaaaaaatgctgtggacgtttttattttttgagatggagttttgctcttgttgcccaggttggagtgcaatggcgctatctcggctcaccacaacctctgcctcctggattcaagcaattctcttgcctcagcctcccgagtagctgggattacaggcatgtgccaccatgcctggctaattttgtaggaagttctttctgtattgaagcaaataatacttaaccttttatgaaaaacaaccaggccacgcgtggtggctcacgtctgtaatcctagcactttgggaggctgaggcgggttgatcacttgaggcaaaagttcgagaccagcctggccaacatggtgaaaccccatctctactaaaaatacaaaaattagccaggcatggtggcaggtgcctgtaatcccagctacttgagaggctgaggcacgagaatcgtttgaatccaggaggcggaggttgtagtgagccgagaatgcgccactgcactccagcctgggtgtcagagtgagactccatctcaaaaaaaaaaaaaaagacacctagttgggagagaggagatacagatgcatacacaatggtgtgcctggatttggggtatcagaggaggggcttcactactagcagtggcctctggggactctgggagggatctgtaccacctgggcttccgatggagggtggctcaggcacaggaagctacaggttggggcaggagcacacagggtgccactcaccaagagaatggcctccttgatgcaggcgtcccgctggtccttcctcagggtggccccagtgagcggacaggtgaagtacacgccaggcacagccaggtgggcagagccttcctctctgggctcagatacctggggcagtgaaagcgtccaagtctggaccgtggacagaggccaccccgaccctcgccgagcaccacagtcctgagtgtggcccgtagaaccagacatctccagcccccatgctgtcccttccacctggtggccgtgggagacaccctggccaagtgaccggatccccgagtcttttccctggtatgtcaaatgtccctgtggggcctgctcagaactaaacgaggtaaggaacggaaagtacggagcagcttctgacacgcaggaaacacccagcagatggcagctgggttcctgctggtcctgtccccaagctgttgaggaaggagctctgtgtgggtgtctgcgggcacagtgcgctggacaaggcatgacttctgggcctccatttctaggccatctctaaggtccctgcgtgctaaaattcactgaatcctcgagggtcaagctgcttagaactcctttcagcggagctctgaaggcccacctcctagaggaaggcctccctgattccacccgtctccacagagcctcttgacctccaaggcaggcaggactgggcagtgctaggggacaggctctgaaaccacagactggctctggtcctgcctttgctggtcctggggtgtaggagagaggacagctggtttcacctctctcaaccccggttctctttttgaatagtggaaactgtaactgcatctgcccttaaggggttaaggggagggagcgatgggcttgtgtacctgaggcccacttctccaggcctgagccggcatcctcagctgccgagccccgaaggtcccagacaacaccgtgttccaccacaacctgcctccaccttgcaaggcaaggttttccaacagcccttgagccccaagggcagaggccacatctcccccgtgacacagtcaagctgtccccaccccttggcatgggacagtgccaccagtggctgttcttaccacgttggtccctggggcctcggggctcccgctgacggtggcttcggcttgaagttcctttctcactggaaggcagcccaagaaagagaggcagagacgggatagtgagcacgccgctgtcctggcccaagccccctcattcccggggtgggcctgggggccacgcacaccgccccagcctgcttctgctggaggtcaggctggaggtcccctgcaggacttgctgtgcagccacccctcagcctgagcaagcaccccactgcctgggcagcccgtttctgctccaagtctctgctcccaccccctccccaggaagctgcccttcccccagcacctgcccttgatgagccgctcccaagggtgaccctcacacccccacggttgctcatgtgacttctgcatccagggccgagaacctcaaacagccccaacctgggcccgaggagggccatatctcaccctggtttcggatggtgtcctgcgatgtggggccccaggcccgggactgcttctgctccagccgggctagggcggcagcggctgccatctgtgcctcattggtgggtccctggcggggcggcctgggggctggctggttgggcttctctttgtgggccttttccctgggaacagaccgagggagagtgagtgtatcctcccgaggtggccggcaaagctgacgtgcagtcacacagaggagcttctgcccctccccagcaccatcagccagacgtgtccctgcctatgtgggccaggacacctggttcccaggggccacctgcagccaccagatggttctactgcaggcggaagagcccctggaggaaggagatgctggttccactcagctctgcaccatcgggcaagtcctgcccccactggccctcagcgtcctcatctgtaaaatggggtgacagcacccctcctgaggtgaaggcaccttgacatcctcagtgctttttttctttttgagacagggtcttgctctctcaccaaggctggagtatagtggcacgatcatggcttactgcaatcctgagctcccaggctcaaggaatcctcccgcctcagcctcccaagtcgctgggacttagaggcaagcatcatcatgcctggctaatttttctatcgagacagggtctcgctatgtagctcaggctggtctcgaacttttgcctcaaatgatcctcccaccgtggcctcccaaactgctgggattataggcatgagccacagcacccagcccgcatcctcaggaattgaggagactcaaggggtgtcacatcctccctccctccctgccataagactctccaccctcaggtcacagcttcgtttgctgagcacctactgtgtgccgggaccctgctgggagctggtcggctcgcttggtttactcctcctaacaagctgccagggaggcctcaccatcccattcctaaacccaagagggacaggaagtccgggcgatgtgccccatgccacgccaccctcgtggcgggaccctggggagagcggacagcagaaccagcctcgccctggccactccatgccaggcctagggctgtgcaagtacgaagagctcatggactcgtggctccaccctgttgagccctacaccaaggagagttccgtaacccacgtggcacagtgacctggcagagaagcctcgcagagaagccctttctcccaacctgctcggacgcgtctgtctcacccgtctcctctcaggcccctcccatgaacttacgggctgtgtcaatttctgtgccgtaggtctattaaaaccttctgggaggccaggctctcagttcaagcccta

SEQ ID NO: 11976 - DNA, 12210 bp, Homo sapiens
ggagaaccaagaaactatattcaaacaacctgtttatttgggcttatgatttactaactgcaggtctatgtgcaggaaggccagcatcccctcctgccgttgtcacccacatccacagagcagccctagtgccaggtgcagccactgccacccacggcacacgggaacaggacccatgctgcaggcctgctctcctgcccagggagatgccacgtgtgtctgtccggcagcttcatgacacagttaccaagcagctagggagggcttagatttgttggtgtccccaggcctctccctcgggggcttgggcgcatccccacagcccccaagggatgggggctctgccacggggcccaattccacagctccacggctggcgcccctcccgtgcccatggggcagagccaagtatttccagaggtggcttggaggccctggggtggcggggagaggaacagggagagcatgagacagacccacagggctgaggccaaccctgcttttatttcacaagagcttctcgatggctgacaggagctcgggtttcaggatggagtccggctcggcccccgcggccttgatgtcctccagcacagccatgtcccacgagaaggtcaggagggcagagggcacctgcggtaggggtaggccgtcactctgagaccgagagtcggcccttgccgcggcagggaactcagcgggcaacctgggcgcggggatgccccggcctggaagccatctcagctggtggaggctgtggctcgcacccaggcctcctgccctctccctccgggactccaggacctaagcctaaacctactgcactagctaacgcacgtcaccgctcccatttgatggggaaactgaggcgtggagtagttatgaacttgctcgaggccctgctgccagtaagtgggaaagcaggattcaaacccagggacctgcccaggccccctgctctgagaacaaggaggctccctcctgggggtgtctgtgccggtcccaggagaacctgcagaggcatcgggtcagcggtgctcctgcgggccgacactcaccagcccgcactcgttcaaggccaggttctcgtcctcggacagcttctgccctcccgaggccagcagctcaaaaggcagccagtcgctctgcagggcctcccggacgaacccgtacaccgcccccagccgctcccgagcgtagaaagtgcctggggagtgggggagtcagagcgggtggggcccagggccccctaccaacccgagccgccctccacgggcatcgttggtgcccaccctgcaggaggcagccatcggggaggcgcacgcgcagcagcgtgtagttgtacttgcgcagcccccgctgctcctccttctcccgcatggccttggtccgcagcacgctcagccgctccaccgcctcggacctgcacacgcgggccaggtcacgagggctggccggggttcttccaccccgccccgccccactctgctccgcggacgtcaggcccacctgagcctctgctcccgcttgatctcctctgctgtgaggttgaagaagtccccaggcagttcgaactgcgaggccaggggcgagggctggaagacgcggcgctgcctgtccagcttggcgcgcacgggctccgcagccagcagctgttccttgtgcctctccaggctctggggctgggccaaggtggtctcgctcagcacgtagaactcctcggggtcctctacagcgtggcaggacatgggtgtcactgtgcaatggagagacccccaagccgggccctcctgccccgaggcccctcgtccccattccctactcagccaggccctgtccacttaccctgatcctgggcgggaagcaacaccttctggaacccaatggcctcaaaaaactcgtgggtcccttccaggcagttaatgcgctcctgggggtggagatgggcgtcactgggggcccctggcttcctccatggcctggccacaccccacccagtccaggggcccggctctcgctattgggagcagctgtcgacccctggatggggcccagccctgggggtgcctcagtgctggatgcaaacctgcttttctacggtgggggctgtggagtctccaacagctctgcacagaggaaagagtcacaaccaggcacgaagagtgaggctgaggagccagacactgctggggcctgatgcgaggctaacaccgcccaggaccccagtccctgccctttcccccagaagaaccagacatctggtttgcatgagaaacctccccagagtcgacatgttcccaaacaagcccagctgaagaggaggaaaaggatgcaggtgaggagaggcagaatttgttgatttggggtgaccggtgcataaaagtcttgctctccatcttgtcctgctaccttctactggccgaacccttcactgcttgtggctcaactctcgctagctcctccagggagcccaccgcctggtgtgggccaccaccggctcctgcaggccagctgcccccacccccagcctgggccccgggggccagaaggcacgcccacctgaaacaccttgttctgcagcttgatcttccggtacttctcctcctcggggtgcaggtggatgttgtccaggtacctggggtaggtggagaaggtgagtggggcacagcccaggctgcccacccggcccctctgtgcctcctgctccaggtaacagcagctcagccacacttggcctctagtcagagggaagaagcggcccagtgacgcgagggcagcagaccatctccgggtggaaggcacacctcggacaccccatggagcccacccctggtgccagcaggagccccacggaacccctcaccgtcccaccagccctggaagggcacaattaaccacagcggtggggaagccacagtgccggaagagtggagagccagagctgaagggccgcagtgccagcagggggctcctgcggggtgctccctcggcgttggcgggcagcgtggacctccaggcctgcccccgatcctgagacccggggagtggggtgggaccctgcctcctccacatgttccccaaggaagccagggtgggaaacccctgattccttcaacaccttcattttgcacacgggtaaactgaggcccaaggaggcccagccctttgcctgaggcctctgggtggagctgcctcactctcggcctatgctccttcccaacccacctcagcaggtaatgagggggccagagggggtgacagccccagtgggaggggtgctgggatgagctggaggggccaggcagggcaaaggggccacacgctcacttggcaatggtgtccacacccagcttcacccggtcctggtctttgttgaacgtgtagatcttcatgatggaggcggccactgggtcggtggagaagtgctgggaggagggaagcagggaaagccactcactgagagcccgggccgcacggccctccgctgcccaggtaacaggggcaggaaaaggaaggcagaacagcggcttggagcggccccagctgtgcgctcatcacagaaaggaaaagagagaccctccaagaccgcagccctgcccacgccccagggcagaggcgacgcagccaagacccagcagaactcaagtctccccttccgccttctcaaggctagatccatgggacttggaagccagtgtgacgcgacagaactgtgcctcacactctggctttagaactcgacctcagtgctgagatccatcaaggccaccgccacttacagaacctcccgccaccatggacgccccatccctcctgctctcgcagccccatgatggacgttctggaaccactcccgggcctcatgtttacaaagagaccgagaggcccatcgtccagggtcacagggatggcaggtggcagagaggacacaaatgagtctgcaaccctcaatgtctgaaactcaatagctggaagacggatacccccagcccctgcccctccccgaggtcccacctatccacctatgttaccgggggaggggagaagtcatagctggaactctgggggtttcccagaaccagccctgctgactgcgaacagcgtcccagcatggagaggctgagaacagtacgtaccctaagacctggaaaagattggggcacaaatccacgctcggcacagccatcacacacggccacacccagagagccacccatggcctgggaagcagggctgccacccgcacctccctgggctgcccagacgagggcgggtgaacagaagggcagcccagggccatgtgtcaggattcgggccacctgcccaggcagcccagagctccacccaccaccccccaccctcaactgcacagcagggtccctcagcagccccctgcgtcacacggaccaatgacctacacactgagccggggctcatgccaactgaaaattgggacccggcccagtctgccggtttagttgctgagatgatgtggggagcgggacagagcacgtggatgcagagaggcagagctgccagatgggcatgtccccaagacaacagcttccttgggatcagagcgcccgggacagcacaccagccaagggaagcgtgtcagctccaaaagcgggcctcgggcgttttgggcgactggctgccaggcttaggtcaggagctgggtacatgcacagacaagggacgaaggaacagcagccaggaaggggtccaaatccatacaggaatgtactttgtgagaaaggtgggatttcacagctgtaagcaaaagacaggtgctctcgacaggtggggctgagaagaaagctgagccaagatctaaaaaaaaaattacatcagctccatcccaccatgttacataataacatgctccagctggatcaaagcttcaaccatggaaacaagcaagcagtcaaggagaagccagaagaaaagctctggaggccgggcacggtggctcatgcctggaatcccagcactttgggaggccgaggcggtcggatcacgagattaggagagcgagaccatcccggccaacatggtgaaacctcatctctaaaatacaaaagttagcccgggtgtggtggcgtgcacctgtagtcccagctacttgggaggctgaggcaggtgaattgcttgaacccgggaagcagaggttgcagtgagctgagattgcaccactgcactccagcctggtgacagcaagactctgtctcaaaaaaaaaaaaaaaaaaagcactggagaggccacaaaagaattctctcagcatggaaatggggaaggcatttctaagaatgaccccaaacccaaaagccatgaactaaaactgacacatttaattatacagagatcaaaaaatcctacacagcaaagtgaccataagcagagccaacatagaagcaactagagggaaacatgtgcaactcatatcataggcaaaagcctaaattgcctaatatgtaaagagtgctgccgggcacggtggctcccgcctgtaatcccagcactttgggaggccgaggcgggcggatcacgaggtcaggagatcgagaccatcctggctaacatggtgaaaccccgtctctactaaaaatacaaagaatcagctgggcgtggtggcggttcgcctgtggtcccagctactcgggaggctgaggcaggagaatggtgtgaacctcgtaggcggagcttgcagtgagcagagatggcgccactgcactccagcctgggcgacagagcgagactctgtctcaaaaaaaaaaaaaaaaaaaaaaaaaaaagagtgcctacaaatcactaataaaaagacaaactatctactaaataatgtagaaaggacgcattctcatatgaaacatggccaatccaaaataaggaaagtgcaaattaactctatcctgagatgttattttcacctaccaacaggcgtaaagatcaaagtttggtgatttacagtatggtgagaggatggggacacgggtgcttttgcacacactgctggagtgggtgtgagtctggagagtctatggaactattactattttgttttgttttgtttttaagatgaagtttcgctcttgtcacccagtgtccacgctggagctcaatggcgtgatctgggctcactgcaacctccacctcccaggttcaagcgattctcctgcctcagtctcctgagtagctgggattacaggcgcctgtcaccacgcctggctaatttttgtatatttagtagatagggggtttcactatgttgaccaggctggtcttggaacttctgacctcaggtgatccacctgcctcagcctcccaaagcactggaattacaggcaagagccaccgcgcccagccacttactattttctgagaaagggtctcacttgtcacccaggctggtgtgcagtggcatgattacagctcactgcagcctctacctcccaggctgaagcaatcctcccacctcagccttctgagtagcagggactgcaggtgcacgccaccatgcccagctatttttttttgtttttggcagagacagggttttgccatgttgcccaggctaaagccgaagtttctgagaacctattgatggtgttaagtgaggacttgctgtattggaaaaaaatgctgtggacgtttttattttttgagatggagttttgctcttgttgcccaggttggagtgcaatggcgctatctcggctcaccacaacctctgcctcctggattcaagcaattctcttgcctcagcctcccgagtagctgggattacaggcatgtgccaccatgcctggctaattttgtaggaagttctttctgtattgaagcaaataatacttaaccttttatgaaaaacaaccaggccacgcgtggtggctcacgtctgtaatcctagcactttgggaggctgaggcgggttgatcacttgaggcaaaagttcgagaccagcctggccaacatggtgaaaccccatctctactaaaaatacaaaaattagccaggcatggtggcaggtgcctgtaatcccagctacttgagaggctgaggcacgagaatcgtttgaatccaggaggcggaggttgtagtgagccgagaatgcgccactgcactccagcctgggtgtcagagtgagactccatctcaaaaaaaaaaaaaaagacacctagttgggagagaggagatacagatgcatacacaatggtgtgcctggatttggggtatcagaggaggggcttcactactagcagtggcctctggggactctgggagggatctgtaccacctgggcttccgatggagggtggctcaggcacaggaagctacaggttggggcaggagcacacagggtgccactcaccaagagaatggcctccttgatgcaggcgtcccgctggtccttcctcagggtggccccagtgagcggacaggtgaagtacacgccaggcacagccaggtgggcagagccttcctctctgggctcagatacctggggcggtgaaagcgtccaagtctggaccgtggacagaggccaccccgaccctcgccgagcaccacagtcctgagtgtggcccgtagaaccagacatctccagcccccatgctgtcccttccacctggtggccgtgggagacaccctggccaagtgaccggatccccgagtcttttccctggtatgtcaaatgtccctgtggggcctgctcagaactaaacgaggtaaggaacggaaagtacggagcagcttctgacacgcaggaaacacccagcagatggcagctgggttcctgctggtcctgtccccaagctgttgaggaaggagctctgtgtgggtgtctgcgggcacagtgcgctggacaaggcatgacttctgggcctccatttctaggccatctctaaggtccctgcgtgctaaaattcactgaatcctcgagggtcaagctgcttagaactcctttcagcggagctctgaaggcccacctcctagaggaaggcctccctgattccacccgtctccacagagcctcttgacctccaaggcaggcaggactgggcagtgctaggggacaggctctgaaaccacagactggctctggtcctgcctttgctggtcctggggtgtaggagagaggacagctggtttcacctctctcaaccccggttctctttttgaatagtggaaactgtaactgcatctgcccttaaggggttaaggggagggagcgatgggctcgtgtacctgaggcccacttctccaggcctgagccggcatcctcagctgccgagccccgaaggtcccagacaacaccgtgttccaccacaacctgtgtccaccttgcaaggcaaggttttccaacagcccttgagccccaagggcagaggccacatctcccccgtgacacagtcaagctgtccccaccccttggcatgggacagtgccaccagtggctgttcttaccacgttggtccctggggcctcggggctcccgctgacggtggcttcggcttgaagttcctttctcactggaaggcagcccaagaaagagaggcagagacgggatagtgagcacgccgctgtcctggcccaagccccctcattcccggggtgggcctgggggccacgcacaccgccccagcctgcttctgctggaggtcaggctggaggtcccctgcaggacttgctgtgcagccacccctcagcctgagcaagcaccccactgcctgggcagcccgtttctgctccaagtctctgctcccaccccctccccaggaagctgcccttcccccagcacctgcccttgatgagccgctcccaagggtgaccctcacacccccacggttgctcatgtgacttctgcatccagggccaggcaccagggccgagaacctcaaacagccccaacctgggcccgaggagggccatatctcaccctggtttcggatggtgtcctgcgatgtggggccccaggcccgggactgcttctgctccagccgggctagggcggcagcggctgccatctgtgcctcattggtgggtccctggcggggcggcctgggggctggctggttgggcttctctttgtgggccttttccctgggaacagaccgagggagagtgagtgtatcctcccgaggtggccggcaaagctgacgtgcagtcacacagaggagcttctgcccctccccagcaccatcagccagacgtgtccctgcctatgtgggccaggacacctggttcccaggggccacctgcagccaccagatggttctactgcaggcggaagagcccctggaggaaggagatgctggttccactcagctctgcaccatcgggcaagtcctgcccccactggccctcagcgtcctcatctgtaaaatggggtgacagcacccctcctgaggtgaaggcaccttgacatcctcagtgctttttttctttttgagacagggtcttgctctctcaccaaggctggagtatagtggcacgatcatggcttactgcaatcctgagctcccaggctcaaggaatcctcccgcctcagcctcccaagtcgctgggacttagaggcaagcatcatcatgcctggctaatttttctatcgagacagggtctcgctatgtagctcaggctggtctcgaacttttgcctcaaatgatcctcccaccgtggcctcccaaactgctgggattataggcatgagccacagcacccagcccgcatcctcaggaattgaggagactcaaggggtgtcacatcctccctccctccctgccataagactctccaccctcaggtcacagcttcgtttgctgagcacctactgtgtgccaggaccctgctgggagctggtcggctcgcttggtttactcctcctaacaagctgccagggaggcctcaccatcccattcctaaacccaagagggacaggaagtccgggcgatgtgccccatgccacgccaccctcgtggcgggaccctggggagagcggacagcagaaccagcctcgccctggccactccatgccaggcctagggctgtgcaagtacgaagagctcatggactcgtggctccaccctgttgagccctacaccaaggagagttccgtaacccacgtggcacagtgacctggcagagaagcctcgcagagaagccctttctcccaacctgctcggacgcgtctgtctcacccgtctcctctcaggcccctcccatgaacttacgggctgtgtcaatttctgtgccgtaggtctattaaaaccttctgggaggccaggctctcagttcaagccctatactcctctggctctgcttacatacccgggcagccctccctcctcgtcccacccctgcctatctagtcctcccacagctgagcatcttgggtggaagaggagatgactcatgaagacccaccccggcctcatccgatatctgggtctttccaacaaaatgccatttcccagggcacctcaccccaaccagccatggaccctgcccccctgggcagccacagggacccttctggaacctcagccagggagcgtcagcatcactccactgcacaacgccctcccactgcaaaatcctaaagcttcccttggccagagagcccttcccagcctggcccactgccctcccgtggcctgtctcccctgggctccccgcagttcttcccacaccccagctgctccccactgcaggcccctgcactgtctgcaccttctgcccagaatgttctccgggggagtgggaggaggatgggggtctggaaagggctagagctgccgcagggagagaaggaggggcagatttccccacagctgagtctcactgtgtcctgggagaggccttcccaaaccacctgacggcccctgctcaccctccttggaggccctgggcactcatccaagcactcatcgcctgagcgctcatccaaggtctgttggtttatttgtccatcggctccctctagaaggtgagccctgggacagcagaggccttctcctgtccaccactgcagcctaaaacaggacttggtgcccacccaccccacacaccctggatatgcagtctcgctccacaagggacctccgcaccgcttcctttcccaaccttcccctccaaccttcccctctccgcccaggctctgggctgatccagccatcaccccgataccctgcatccttcctatcatgcccagtcccagtggccccagcaccccccacccactattggttgaatcaatgaagggctcccccgatttgcccccttctctccctgacccctctccctccctcactcagcctttgctctcctgctctcccccaggaaccctgacgtcctcactatgcccctacctccatcaccaccccactgccccgtgattcctgacccccacttcctgccacctccctgcctctcccagcccccactccctcacaatcccttccactattgcttacagacccgtgtcctggctgcctggctgacttcctcagtccctctccatcagtccccaccaccctctggccagccagctccctgcagcggccccagctctccagtttcccttttctcaacccaacagccctcagccttgcaccttccctagctccacttcttccccggccctcccagctggctcagccctgctcaggcccttctctccaagtcctccctagacaatccggaagcctgcccggcatctatctcctttcccctcctctcccacttccataatccacttggcacagtgacgtggcagagaagcctcgcagagaagctctttctcccagcctgctaagacgcgtctgtctcacccgtcttctcctctcaggcccctcccgggtaagagtccatctgtcagaatccctcacctccactctcctcacacaccttcctcagcccctccctctcaattcgccaggacatcccaggtcactgacgacgctgcccaccccggcctccctggccttccagactctttctagtctcccatcagcctcccacgtgctccagataccaaatccagaacccctcttcccatggatacctcaaaacaactcttcaccaccccaccccacagctgtgcgtcctcctccaagctcagctcccatccatggtcacctagattgccccaaatcatcccggcctcttcggccagccgggtccccagacagagctctccctcaccacccggc

SEQ ID NO: 11977 - DNA, 135 bp, Homo sapiens
tttattttttgagacggagtcttgctttgtctcccaggctggagtgcagtggcgtgatctcggctcactgcaacctccgcctcccgggttcaagcgattctcctgcctcagcctcccaagtagctgagattacag

SEQ ID NO: 11978 - DNA, 286 bp, Homo sapiens
tcctctggctctgcttacatacccgggcagccctccctcctcgtcccacccctgcctatctagtcctcccacagctgagcatcttgggtggaagaggagatgactcatgaagacccaccccggcctcatccgatatctgggtctttccaacaaaatgccatttcccagggcacctcaccccaaccagccatggaccctgcccccctgggcagccacagggacccttctggaacctcagccagggagcgtcagcatcactccactgcacaacgccctcccactgcaa

SEQ ID NO: 11979 - DNA, 1159 bp, Homo sapiens
ccagattggtgctgaagacatggacggcttccaggcagacacggaggaggaggaagaggaggagggcgactgtatgatcgtggatgtcccggatgctgcgggtgagaagggctgtagatagcagaacgcactggtgaggtgggcgctggaggtaaacctcaacagagaagggatggggctgcctaagactagctccactgtgagcagccaggagggcttgcagctggaagtggctcctgccctgccacatcctcgggcgggctgggccgtgggtgctgaccatgccaggcatcgttctggccgcagagccacaagggcctatgctgggagtctcaggtggttgtgacgttagatgggggtcagggaaggctgcactgaggcagcaagggagggccaggtggatttctggagcactcgccaaagaggaagtacagaggccctgcagcaggctgcgtgggaggagtgtgcccgggtggtggggggcaggcagggtcaacctgagagcaggtgagcaggtcacctctagaagaggcacaacgccccagcctctgcctgtccccactgtcaggtggagggtcccgccctggggttgttgcaggccccatgaggcagcagggtggggtcttcccccagggagcccagagggcccagccagctcaagaccctccctctcttgccctgcagaggtccaagccccgtgtggagccgcttccggagctgggggtggtgtgggggtggacaccggcaaggccaccctgacctcgagcccactgggtgcatcctgagagcaggggtgacgtatgtagaatgcttagggtgtcctccccacagagcagatacttgaaccgactcaattcctgtgtaaagagcactttgtcctgcttcacggacctccccaaagtgtgcagagttctatataggatgctggattagttcctttgatatttgtaaaaattcccccaagagccgcatatgaatctgccctttaataaagcattattgagattgctggcctattggggaagcctgcgggcacaggagcaggcgtggaatccaatacttgtaaatgaattgaagcgtcaggaccacccgcctggccacgtgcgcgggcccctggacctaacgaggcagtgtataaacttattctctagccctgagc

SEQ ID NO: 11980 - DNA, 894 bp, Homo sapiens
ttgccctttagacttcctggcctgatggactgttccaagatgcagtcattctcctatggtctttctggagatgtcttctctagactgagcagccaatgtgttgctatgaagctctggctagctgggtaatgcacttccttgtatttgctcttcctcgttccttgtctcatgtctccttttccctgggattctaccctacactgaagtaatagcacacaaatttttgtctcaagttctgttgtctagggaagccaggctaagacatggttcaatgggtgtccttagaaagcagacctccaaaagagaactttgggtctccaccgatggtggcaaactgggtggcccggattcctggcatgcagtgatagtacaattgccaatatgttatgtggtataggcagaaggcaaggtattggcatatcaagtggctgtgtacttgatcagtacagagggaacgataatcataaggattgtgttacatggtggctgcctttgatggctttggaagatttgcaaaaaggcataacagactcaggaaagctaattgcccacttaaaatatgctgtgaaagtcagagggcctctatggtagccttccaaatcctcttatctactgcagctgcagggcaaatgatggaggaagaaaatcatgttcagggtttcatggtatagggttgcaaacctacaaaggagaaaaaattcacagccttaaaatgtctcctgtgtcaatgtgaaggctttgatagggaaagagtaggaacctgaaacctgcaaggtggacatttgagtggacaaatctaataatcttgaatgtccaaatttccctgcctctctggagattatgcagtctcctcagtaggagactatgcagttatatcactcgatgtactataag

SEQ ID NO: 11981 - DNA, 756 bp, Homo sapiens
gtcctaaggtgagaaggagggccactagcataaaaacaacttgaacagaacttccttcacaagccaataaattctaataacaaaaggcaaaggaaaaagttccctatagaagctaaggattttccaaagcctaatgctcattttttatatccttctttgtatggtcaaaggttgattcttcctttaccagacacaaaaaagggcttaattaaaaatttgaaatcaaattttagagatataaactataaataaatacatttgcctttcaaatttttagaacattatcctagttaattcaaatttttttatttgagatgaaaggcgatttaagctaattttcattggatcatttattattattattattttgcagtgtattagttaactactgttatataacaaattaccccaaaacttaatggctcacagcatcaaaaatatattagctcatagtttttgtgggttaggaatctgggtgctgtatgtctagtgctcagggtccttcacaagattgccatcaagttgtcgactggggatgtagtcatctgaaggctcacgtgagtgagtatcaaattccaagctcactcactttgttcaagtttttgacatctgctggctggagaccacttgtttgccttgtgggcctctccacagagtagtttacaacatggcaacagcctctctagttagtatgagcaagccccagaagcacatttgccatattctaattattagatacaaatcaataggctcgag

SEQ ID NO: 11982 - DNA, 756 bp, Homo sapiens
gtcctaaggtgagaaggagggccactagcataaaaacaacttgaacagaacttccttcacaagccaataaattctaataacaaaaggcaaaggaaaaagttccctatagaagctaaggattttccaaagcctaatgctcattttttatatccttctttgtatggtcaaaggttgattcttcctttaccagacacaaaaaagggcttaattaaaaatttgaaatcaaattttagagatataaactataaataaatacatttgcctttcaaatttttagaacattatcctagttaattcaaatttttttatttgagatgaaaggcgatttaagctaattttcattggatcatttattattattattattttgcagtgtattagttaactactgttatataacaaattaccccaaaacttaatggctcacagcatcaaaaatatattagctcatagtttttgtgggttaggaatctgggtgctgtatgtctagtgctcagggtccttcacaagattgccatcaagttgtcgactggggatgtagtcatctgaaggctcacgtgagtgagtatcaaattccaagctcactcactttgttcaagtttttgacatctgctggctggagaccacttgtttgccttgtgggcctctccacagagtagtttacaacatggcaacagcctctctagttagtatgagcaagccccagaagcatatttgccatattctaattattagatacaaatcaataggctcgag

SEQ ID NO: 11983 - DNA, 1605 bp, Homo sapiens
gcaaccttgcagagtcagaatcctgatcagcagttttgaccagcacatcaagagtggctttacctcccaggcattgatccagcattagtcaagctacaagacactgatgtagaaaaccataatgtcagtttactaatgtagaataagaaataaaatctcagaagacctgagctctcctgtcagcatgacttgcacttgtacttttcctttttgtagagaagctaaattataatcagaaagttgttttggtgagcttggaatcagaaaataggagtttaagtcatctgttcaacatgcagctttcctcagctgtgatagctttttcctgctgtccagtcttcatgtggagcctggtcaatagcaccagaattctaagtctgctggccaaggtgctgcctcctgcagagagagaaagcccatcaaagttgacttcagtgactcccccttcactcacccctcatcttccacggccaaccaactccctttttgattgacacatcatttctttacatacattaatgccttccatattaccacagagagtttgttagactggaaatcattttatttctttgatctacttcatctttctctgcattgagcctttgcgtactaatttatagctattttctcacaggatagtctatttccattatatctatattttctagtggtcctttgcgtttgcctcttttccagactgtatagggcatggtgccaggcacagtttatttgttttattctatatgctgatagtatcatcttttccatctttagatgttttatctcattcagagtgagaggggcacttggtcagtcctttttgcatctcaatagttgatcctcttttgattaaaaaatatttaatttctaataatgtgtgttagagtgaaaataacaggaattattaggcccagtcaagactaacagttcttgactcatagttccaaatcacagttccaagatttccttaacctttctgatcctcacttccctcccaaaaaagtaagaatggctataattacctacctcatggaaattataaggcttcagcaagattaaatgtactcatttatttaacatgcatagtaagaactataaatgttaatttattcttacttacattaggatactgacttatgaaacagagattaaacacattctgcaaaaggactggtattgacaggctttgattctaatagctcaaaagataggccatggcttgctagagaaaatgaaaggatactcaaggctcattagattaaaaggctgctaatgttctctaagctgtaagtagatttttgcccacatttatgaaggttgatttctaatcagattagaaatggcataggctggtggcgtcatctcagagctgccacagcattctcaggagactcagccatatcatgttgggttgctctaagaacacacagagacctttatgctttttcacaaaagcatactctttccctggagtgtgtaactctatgtgttgacctttagtgggataagttcttacaatggagctattctgggtacaaaacatcactactctgtgagatttaggaagataacactgtttgctgattttacaagcccactcga

SEQ ID NO: 11984 - DNA, 933 bp, Homo sapiens
gtaccacagtgatgcagcaaggccaggtacccgagaggtatccccaggccccaactccctacaccgcacacacacaaagctctccccatcttggtctaagagggactaagccttcctcctacgaggactctccctgccttcagaacggtggctcctccagtgaggaaaaagagagaagcagaaggaactgcaaagtggacccttggatgctgctatccaaaatcagagccaaaattaagagactcttaacccccgcaaaattatccaggttaaaaacatacgtgagcttcagaaagggtgaacatagccatggctgagaatcgttgtggattatcatgataggaaattgacatgcttatgggtgttctgtcctttggggttgatgtcagggagccaagtggttgcactatttctgctgtgtgtccgaatttctaaagtaatatccgtgtattgtttggagagcggacttttttgctttactcctacttttacagaaaagaattttgtttctcaagcaacaaaacatttggtctctggtgtcaaagaggactttattatattagaattataaagctttagttaggaataagtgttggacattattaaatcaagttactgcaggctgggcatggtggctcacgcctgtaatcccagccctttgggaggccaagactagtagtctccaattccattccatcacttgaggccatgagttcaagaccagtctggccattgtggtgaaactccgtctctactaaagacataaaaattagcatggtggcctgcacctataatcccagctactccggaggctgaggcaggagaatcacttgaatccaggaggcagaggctgcaatgagccaagatcctgccactgcactctagcctaggcgacagccgcagacttggtctccaaaaaaaaaaaaaaaaaaa

SEQ ID NO: 11985 - DNA, 172 bp, Homo sapiens
tttttacagttgtgtagtattctatggcgcacatgtaccaccttttctttatgcagtccaccactgatggacacctgtgttaattctctgactttgctattgtgaatagtgctgcaataaacatatgagtgcagagctttttttttttttttttttttttgatagaatgatt

SEQ ID NO: 11986 - DNA, 1858 bp, Homo sapiens
taaatactgaaatgtcaaagtgaaatctcctaactacatctcactatagccacagatttccaacattacttcatttttgttatactttggatgactttttacccagactcctttgtcccattttttaaaaggacagacacggtacattgagcttaattttaatgttctctctaaaatgctaataattatggctcaattattacagtggttttcttgttggagttttctccctttagctgctctaaattgtgagtggtatagagtcacagagcttacttgattattcacccagtccactgctgatgctacgtgtttcttcaggacctgtcctttagaatacttcccagaggcaagcacatggttgcctatattaaagccacctgtatatcacttgctaagtcctctttgtcaacacttgccctcattgtgactacagaatcactttttctagtttttaaaattgttatcgtaagactgtgcttggaaatattcccagggattagtatgatgattttgttggggtgtttggagatacatttgccaatgctgtacatgtaaaatttccatgacaacttataaaataaatactttgatctctttatcagccatcaatgttaacatataaaatcagctgaattaaagttaagactatgtaaacagatgactagaacctcttcttaagtaaaaatatgtgtggttcccttaattacttgtcattggaaatttgtaattcctttcaattttctgaacatatgcacaattttactattctaaaaaaataactattcataactactcacttattttctcctttcacgcacttctaatttttggaagaagtgatgggcatttgttccctataactcttgccatctatatccacctggatccgtagcaatttgggtcttatctgaactactacgatgaactgcactcaaaattacatttgatgtgatacacacagtaactcaattctttctttgctttcatcttttgcaatcatctacctccctatgcagtctggacaaatactgtcaaattcctaacagcatcatcattagcactgttgaaatccttccatcatttagtagatgctaagcctgtgttgtccttcattgccctgagatgctatgcagtttatctgcttgcacacttcagatgcaaaacatagatgggaaaagtaaggaagcatactgatttgcattcctacatatttgtatgctttactgtttctcctgatgcttctgcttccaattgccatcttcaccttcgtcatctctagcttcctactttactctcctcagtcactgttcattcttagcctctgatttctatcacttcttttgctgtccaatttgtgcttcctctatttctttcctcaaatacctctccagcatcattatgtcacaaaattatttgccctgagaatctcttgctcttcccctgctttgtgctgcagggagactgattcttatctcactgtgtcagctgcattccagccagagtccacctatgagtggctctggtaagagattggaaggccgaagattctggtagttttcttgtcagtggctgtctcttctcctacctactgctcctacaagaaaggcctgcaaaggtttacactcctgctatgtgacatctgagcttctggtaaatctcattctccccttgtccctctgtctgggagtggaatgtttcctgacatcgctagtctgtgtgtggcttcactgttgatttgactgctttcacttttctgtcatcagtataaccaaaaccctgcagaaaactgcctctgttgtaaatacttaaggtggtttttgttcctggttggatcctaaagaacacaaaatcattc

SEQ ID NO: 11987 - DNA, 1101 bp, Homo sapiens
gcagcagagagagcctgggttggagccatgaggctgcccctgcgtcagctctgcctccttggaagcttctgtgtctcgggttcttcatacgcccagtggcagggatggaccaggcaccccttgcaatccttctggacaaatgtgccactgtcctatgaaaataaaaggacaccactcaagctccaggaggcagaaccttaactcaaatctgagccaataaacaatgtcactctagcaccaaagtctatttcaaaatgcaaactatttgaaatatcttatttttggtaaatgctttattttggaaatgggtttttgttgttgtttccctgaagagagttcagatcagcaaagcaagtagctttggagaagacacctttagacgaggactcctgtgaatcagcaggacagcgtagcaggacattaggtgagccacagggtggagcaggatgggagggcagaggcttctgcttcagaattgaagccgaaggcaagtaatgctgtgggtgttactggagacaaaaggaaccaaacaagaaaaatctggagaggcaaatgttgatgtcttaatagatttgggaggtcacactctttaaaaatgggtcccaaagcaaagctctcaaaacttcattaaaagaaaagtcttacatttgacaagtgacctggacagaggagctaccaggacattggcccccttgctgtgcacctgcactgtgcatcacagctcacgtcgtgtttgttacactttgtcacctcacattttattataaaggtcattcccgtgttaaaaagagagcgcggtatgacagcgcctagtgaattgtagtgtctttagggaggaacaaaaatggacataaatgaatacaaagaaaagattacctgaaactgggagcaaatcaaagtaaaaatgtagggatagggtgttgctttcttttaaaaagataatgctgtcaggattaaagtgagaagaatttaattttcatttcagcctgaacactagttttactttcagaaaggttcttggtgccaagctgtgacacttttgcctttgtgggtatacacacttggtacccttgcttagcactgtggaagaggaagtctctc

SEQ ID NO: 11988 - DNA, 1101 bp, Homo sapiens; identical to SEQ ID NO: 11987

SEQ ID NO: 11989 - DNA, 143 bp, Homo sapiens
ttttttttttttttttttttttttgagacagagtcttgctctattgcccaggctggagtgcagtggcgtgatcttggctcactgcagcctccacttcccaggttcaagcaattgtcctgcctcagcctcccaagtagctggga

SEQ ID NO: 11990 - DNA, 143 bp, Homo sapiens; identical to SEQ ID NO: 11989

SEQ ID NO: 11991 - DNA, 1067 bp, Homo sapiens
ctttgaccggacagacagatacttagatagctggcaaaacattatttctaggtatgtttgtgaatatttttccagaaaagtttaatatttaaatcagtaaactcagtagacaaaacctaccctggacaacgcgagtgagcctcgtccaatcccttgaggccccagaagaataaaaaaagaggaagggtgcatttactctctcttcagttggaacatctatgctctcctgcctcagacattggacatggaatctcctggttctcaggcctttggcctccatggttacaccagcaccccacctggttcgcaggccatcagtctcagactaaattacagcactgggtttcctatttctccactgcagacggcatgccttggggatttgggcttctataattatatgagccagttcccataaacaatcacttctcatatatctatatatacctattggttctgtttttctgaagaccctaatacagccccatagcactatatttttattttttctaaaacatttaaacagcctatttttttagagtcatttatgtaggtatccaattctctcatgaacgcctcaaggccagaaattcaatccattttatttttgccattgccgcagaggaggcacactgtagctagtcaataagtggttgtggaaggaattgagactgatagatctataaacccactttctgtggtacatgcagtctatattcaatattccgtgcagcttactccacaagtgagaggagggtctaagcttttgagcatagggatggttttagaaaataattacatttaaaaagcaaaatggagacctgttgagaataaataaagtcttgtttcttatagttgtgaatcttttatatcaagacttcacctgaaaaactgctagattgtgcttcaaagcactgtaagttctagccctgggtctataatgttatctaagatatttatcatcattgagttctctggactcaatgttcttatccgaaaattgaaggagttagatataatcatttttaaaatgttttccaaaccaacatcctaaagtctactctcga

SEQ ID NO: 11992 - DNA, 9298 bp, Homo sapiens
attttcatttatttattattaatttttttaagagacaaggtctcactctgttgcccaggctcgagtatagtgatgcgatcatggctcactgcagccccaacctccagggctcaagtgatcctcctgcctcagcctcctaagtaagtaggtacgactacaggcatataccatcatgcttgggtaatttttttgttttgttttttgtagagatgggatctcactatgttgcccaggaggtctcaaactcctggcctcaagcaattctcccaccttggcctctcaaagggctgggattataggtatgagccaccttacctagcctgaataattttttcaaagaatagaatttataagtaaggctgggaattatatggaaaaactcccacgtttttatctgatgccacaaggagtcagagaaacagctgctaatgtgtgctcacaggtctcctgaagttgcaggagtatcagcctcccagcaacactttgagattcaaaccttagttttaagtgagagattggaaagctcctggaagtgtcttattgagagagggaaggaaacacttaacttggtcaatgcttgaagacacaaggcttgactcttgtctctactgtttgattctaaaagaagccactcctctcagcaccccctctgacaaaggcagtgcagccattgggtcctgtctaaagtgaacctcagggagggtgagatgtgattactgttaggatgttcaaaggcagctctggagagtcttggagggctccacttaaaactggatggggcacaccgatactaggaaataactctgagtcccagcctgtctgagagatcatctatgtaaccaatgggcgagtggcaagctgactcctgtggcctctgcacccccatccttggcagacatccctcattggttgtgaccctctgtcctctgccccactggatccactgcagtgaggggcagagccaggctagaaccaagcctcttccttgcccatctggagctctgcctgctgtctcttcgtctcccagcaggctctctgcactagcatctgagcatctatcaaatgctcacttgctgtcatgtgcaggctctgcccttgaccgcagtgtaatttcccctggtctacagatcacatgggaacttgcagagcgggtgcacgtagggtggggactggggtgtctattcctccttcattattcagcagatcattagttcagtcacttgtccggatgtctaatatccagtcacacccacaagaaatacgcaaacatctgctcacaccccgatatagaccatcaagaatacacatatggctggtgccttaactgagtcatcttttttccattccattcatgaaagcaacataagaaagccaagagtgaaaggggtaaaagatcacagtataaaggtcttcggtgtgtccttcaaagatttacacaacattgtcctaaagggaagtcacagcagcttagctgtttctcacagatcagagaggatggtggggcagccaggagtcatcagtaaacccaggtgagcagtgcaggactgaatgtcgctgtccacttgcaggtgggagtccatgtggagggtgctccttcttgtttctcattgggacggtgactgtgtatagtggaaagcacagagccaatgagggacaggatggctgtggtggagggaaaacagtgcagggctgctctgtctctctgtcctgtcccgttaggactggtgggccaccacaggtttctgtaaagtacaaacacacatgcacatataagcacacacatacacaggcatgtaacacagacacacatgggcatgcacatacaaatacacaggtgtgtacatggatgtgcacatctgtagacacaaatttagattacacgtttgtgcacacatgcatgtgaggcaagagaatagggtctggaggcagggaacctaaggccaattcgtgctgacttcctagaactgaatcaaaatgaaaaccccacctctccatgcctgaggaacaaaaggttcagcagctactccctttgctataccccctttccactgcatctcagatgaaaatggaaagtacctcggattggtcccctcccgcaaccaaccagactggtcatcggccaagtcttcatgtgtaactttgtaacttcccttcagcctctgattggttgcctcctgcgactgatcacattggttggggccactccttcatctgcatagagtataaccaagtaaccaatgggaaaactctggagggcacttaaactccagaaaatgctgtaaccaggctcctgagccactggctctagcctgctcccactctgtggagtgcactttcttttcaataaatctgcgctttcgttgtggtaacacacacacttgggtgtgtatgcaggtacatacacatgggtgtgcacaaacacacaggcatgcacacagtacacacacacacaggggtgaacgcagccacacacatacacacatggacaagttagtgaaaccctgggtttgctttcttcacaatattaggtgaactctcttggggttttttacttaacctctctctgcctctgttttctcagctacaaatttgggttagtgacacaggtcctcctccaatggggtgtgtggacagcagatatttgaaaatttaaagctctaaaacacaagatattattctaatttcaaagtatttagattttcaagccctcgttggcaaagattttactttactttttgctttgattctcaggtctgaatctttgttttgtttatctccattttctttgctctgaagacttaattttaatacataaatctgacgggtcactgaactttaaaaactcctcagagaatgagagaaaactttaccgcgaaggtgtggctggccattcctttcctcgcgttggggtttctctgtgtcagcgagcctcggtacactgatttccgatcaaaagaatcatcatctttacctttggggaaaacaggaagagggatggtgctttatcaatcacatacttagcccaaacaagtgccttggcctcctcagaaatttaaaaggtagaaaaaaatggacatatccccttttaagaagcttccacatcacatattttttaaaaagtatttacatttcagctgtcatgcaaatcaacagttttgccaacttctttctcctttgctctggcactggcattaacattcttcctcactgtggccctggaaatcctcacactaatgaagcagcagaaaggcccatcacactgcactggtgtgtggtcttcgcatttccttgactttcttttcttttttgttctttcttttttttttttttgagacaaagtcttgctctgtcacccaggctggagtgctgtggcgcaatcttggcttaactgcaacctctgcctcgggttcaagtgattcttctgcctcagcctcccaagtagctgggactacaggttcacaccaccatgcctggctaatttttgtattttttagtagagatggggtttcaccatgttggccaggctggtctcgaactcctgacttcaagtgatccgcccgccttggcctcctgaaatgctggaattataggtgtgagccaccatgcctggcttccttgcctttcctttgtgagacacggcaacagcccaaggggtctcagatgctgaccctcagcagagggcacctcctggggccatggctgtgtagctgggggcatctggcctcacatcctagttgagtgttggtgtccaggtggctggtgcaggcacccgcccttcttcacttttgcatgtcttctgtggcctgcctgactggagccagttgtcagggctcctgagagctgactgtgggcacctcttcctgaccccacgctcggtgacatcagctgggagcttgcgatcagccagggtgggagcatttacgccacagaacctggcacatgctacaggccaggactttgtccttttccttttctgggagttggctcagcagcgtgctcctgttgtgctgttcccctctctgcagggtcatgtggcctggcctgccggccctccgtccccgctccaggactaacctctgtggagggaatcacctaactcgagggatcacgactcctgagcagtgaagtcgcatgaggccccacagaccccgggattggaggcccaaggacctgccagtgtgcggggctggcctctgcagacagtgaaaagctcccgtggccacgcttggcagatgctggtgaggatggcggggagaaatgtgaagggtcaggcctcagctttgcctttcagaccccaaaattcctgtgagcttcagggggccgggggtgagctattctggctttggactggaggtgagtgaggtctctggataggacagagtctacccttcacaaaaccagtcatacagaggacacaaggaatcgccccttgtcctcctgctacaaacatgaatctcttggccgggcacggtggctcacgcctgtaatcccagcactttgggaggccgaggtggatggatcatctgacgtcaggagttcgagaccagcctggccaacgtggtgaaaacccgtctctactaaagatacaaaattagcctagcatggtggcaggcacctgtaatcccagctactcaggaggcagaggcaggagaatcacttgaacccaggaagcggggggtgcagtgagctgagatcacgccattgcactccagcctgggcgacagagtgagaccctgtctcaacaaaataaaacaaaacaagaatctccacctggatttcagcccacgagatgtgcaggaaactccccgcagagccagcacatggctctccaggagcccctgctggcagctccttagtgggtcatctctggcaaagttgccctcctggctggtgaccctgaatctgggattagccccaaagggccctgggcaccagctgtatcccaggattgaccagaatgtgtgctgggagctcagggcatgcaaagagcgagctggcatggaggtggggtggctgactgatcaaggagtgagctggctggaaagagggattgatgtgccaggtgttgcagggaggcggtggagagccccgggggagaggcttcatacttggccctggaggacttcacaggacagagatgggcagggagggggcacacccaggcgtggaggcaagtgcctgcttggtgcgctctgaaaccagcgtccgctgtgcgttgtcctacgcacgggaaggaagtgcatccttgggcgggtgtagtagggggcaggctggctccagtgtgtgacaaatggccaaagtctgcagggctatgctaagaaatcccacttcattctgcaggcagttgggagccaaggattgcttgtgagcagaggagggacacacactgtctgcaaggactgcagctgtggcagagtttgaacaatggtgtgtgtgagggcaaagctcagaagacagggacaacaggagatcagtccaacaatgtctgggggcctgaaacagctcgacagcagagggacgggactctgaatggggggaggagctaccagcctctggtgagcagtggttgggtcacaaggtgagtgaatgagatgagcacacagataccccaagagcccggccacgtgctggggaggcctcacatcccgttcgtccaggacaaagctaatgtccttgtcaccaccaagccttcaaggaaggctaaatgatgagccgtactttctagaaggccaggaactgtgtaccacgttaggacaatttatgtagaaaaccatggaaaccactaccaccaccaccgctgccaccagggccccctttgcacgcttaaagcagcaagttccagctgtccagaacaccaacttgctgggtcctgagggtggcccgagcggcactgggaatgttttttgggagtcaggacatgagatatgtcccacagataatgaagaaacacacagagctgcgactggtcattttcctccccgaagctcatttcccaggcccatgggggtgggggagcagagggctcttaccttgacttttcagggaattactgaactttcttctcagaagatagggcacagccattgcctagaagaaacagagtgtctccaggcttcatcaagttgtgacgtttaggaattgtcaactaattttggatttcttattgttcttccagcttctaattaaccatggccactattttctgctctctagcaatatttgaacttttagcaatatgagaatggacattttcaataaattaagcatgaaatgcctgaaataagagatgctcagctttggggaagctgccacatttgggtggtatggcagaaagagtacaagtttctgccctgcaggtctggtttaaatcccagcactcccccttaccactgtgtgacatggacaattaattcacttctttttttgtttgagatggagtctcgctctgtcacccaggctggagtgcagtggtgcgatcgcggctcactgcaagctccgcctcccgggtttatgccattctctcgcctcagtctcctgagtagctgggcctacaggcgcccgccaccacgcccggctaatttaattttgtttttctgtatttttagtagagacagggtttcaccgtgttagccagaatggtctcgatctcctgatcttgtgatccgcccacctcggcctcccaaagtgctgggattacaggtgtgagccactgcgcccggctaattcacttcttaccctctctgaacctcggtctcctcctctgtaaaatgggcctgtagctctctttacagggatactggaagatcacttgtggctaacacgattcctgggtccctgtgactgttggtcctcacacttctcctcctgtctcttttccagttgattgccttgctacagtgtgataagaaatccattctctgtttggcttttcagggaagtgaagagacagccaaatggccaaattcccctggaaatttctcctggtgtctggcaccctgggattttgcctggctgggtttgtgggcggctgccagaggcactgcagaagctgtcaggctgggcttccagggacaaaggtggaagcgcccccaccagagaagagtgtgggtgtcaggcatggcctgggctgagaccccgctgtcacttcctgtctgtgatcttgatcaagctcaccccctgccctgagccggctggtttgttcatcagtacaacagggttaataaatagcactgcctacccgctgggtgctgtaaacatcctgtggaaagatggacttttgaaaacatcgcgtgtcactgtgaggagctgccggggttggaagaggagtggctagatgttccttgaggctccctgctgcgctgggctgcaggtaaggcctgaagctaaagcccattcctcctggggcgctggccatggtacctctcatcctacccctaaccactccacctgaacacggggagcaactccctcccaggctggctctgccctctgtgcactgctcctacccctaaccactccacctgaacacggggagcaactccctcccaggctggctctgccctctgtgcactgctcctactcctaaccactccacctaaacacggggagctcctccctcccaggctggctctgccctctgtgcactgctcctactcctaaccactccacctgaacacggggagcaactccctcccaggctggctctgccctctgtgcactgctcctactcctaaccactccacctgaacacggggagctcctccctcccaggctggctctgccctctgtgcactgctcctactcctaaccactccacctgaacacggggagctcctccctcccaggctggctctgccctctgtgcactgctcctactcctaaccactccacctgaacacggggagctcctccctcccaggctggctctgccctctgtgcactgctcctactcctaaccactccacctaaacacggggagctcctccctcccaggctggctctgccctctgtgcactgcatctgtgggtcccgctcacaccccccgagtccctgtgccattttcgagcacactggctcctgagtgttttcacctctggcagccagcgcctatgtctcccagatggaagaagtccccaggccacgggcccgctgtgcctgttcagggaagggcagaagtgcctgggaatgtgtgtggcccagggcctggcccttactcaggactgacgggtgtgggtggccttgctcctacgcggaattaactgtggggtgtgatctgcgtggtctccagagcccccaggaggactgagccacagtcagcctgtgtgggtttgcttcatgtcagatgcttgcctccttcctttcccgtctcactttcccgctcccctactgggctttcttggattttcaacaaatgcatctacacaaatccagctcaggtgtgtgccacggaggaagccaactcacaagagttgccacggtgttgtggcagctgtgtgggcattgctgtgtgggtagctgtgaggacattgcatctctgccaccccgtggacttgccacactgctggaaaggggtgcagtcttccacctttgtcgggtgtctggggcttgaatggagtaacacataccttggcctcacttgaagggtctgcatttgggtcctctggtctcttgccaagtttcccagccactcgagggagaaatatctggagggcaaagaagagacttatgttattgttgaacctccagccacagggaggagcatgggcatgggtcagctggatgtaaggatggatgctctctatacatgctgggttggggatgctgggactgcacagccacccccagtatgccgctccaggactctgggactagggcgccaaagtgtgcaaatgaaaatacaggatacccagggaactttgaatttcagattgtgaaaagaaaacaaatcttgagactccacaatcaccaagctaaaggaaaaagtcaagctgggaactgcttagggcaaagctgcctcccattctattcacagtcatccccctgaggctcacctgcatagctgattgcttcctttcccctatcgcttctgtaaaaatgcagactcactgagccagactaaattgtgtgttcagtggaaggctgatcaagaactcaaaagaatgcaaccttttgtctcttatctactacaaccaggaagcccccacttaagggttgtcccaccttactggactgaaccaaggtacatcttacacctactgattgatgtctcatgtccccctaagatgtataaaagcaaatt

SEQ ID NO: 11993 - DNA, 508 bp, Homo sapiens
gtaactctgagccagtggcccccaaggtggcagaacaggtgtcagccacatctagaaggaggcctagggacctgcagggtgccacccttggtgaggcggctgtgggccacccttggtgaggcggctgtgggctgtgggtgaggcagccccttggtgaggggctgggaggagtgggcttctctcggcctggctgggagtccaggtgccagggtcactaagacaggcctggcatgcgggtgtggaggctggcatggtttgcttgggcatgggtggggcatgggacaagctgcacaggtgtgcagagcactctccacatagtcactccctcttaggaaaagactccttcctccacttgagagggcatcaggccagcagggaccagacgttcgcctaatccagaggctgtcccccaccagataagggcgtagccaggcacgctgtttaccatccgtcctcaccaaggactctgtggccataaaaagagcagggcttcaccagctcgaggcgg

SEQ ID NO: 11994 - DNA, 508 bp, Homo sapiens; identical to SEQ ID NO: 11993

SEQ ID NO: 11995 - DNA, 380 bp, Homo sapiens
ctcacctgtccactagcagctggacgggaaaatggcaaggggtcatttcctgtactgtaccgtgaggcagtgattagctacgtgtggctcgtccaactagagatgtgctgtgagtgtaagatgcacactggatttctaaaactttgtgcaaagaaaagggaaatatctaattagtaatttcatatggattctgtgttgaaatgacaatattttaggtttttgagctaagtaaaaatacattattaaaattagtttcaccttttttattctacttcttaaaaatgtgcttgctgctagaaaatttaaaatgatagatgtggcccatattatgtttctgtgtgatagactgctctggatcaagagtcggcaaactatggccc

SEQ ID NO: 11996 - DNA, 380 bp, Homo sapiens; identical to SEQ ID NO: 11995

SEQ ID NO: 11997 - DNA, 2318 bp, Homo sapiens
ttttattttattttttttaattttttattgatcattcttgggtgtttctcgcagagggggatttggcagggtcataggacaatagtggagggaaggtcagcagataaacaagtgaacaaagaaacaagtgaacaaaggtctctggttttcctaggcagaggaccctgcggccttccgcagtgtttgtgtccctgattacttgagattagggagtggtgatgactcttaacgagcatgctgccttcaagcatctgtttaacaaagcacatcttgcaccgcccttaatccatttaaccctgagtggacacagcacatgtttcagagagcacaggtttgggggtaaggtcatagatcaacaggatcccaaggtagaagaatttttcttagtacagaacaaaatgaaaagtctcccatgtctacttctttctacacagacacggcaaccatctgatttctcaatcttttccccacctttccccctttctattccacaaagccgcgattgtcatcctggcccgttctcaatgagctgttgggtacacctcccagacggggtggtggccgggcagaggggctcctcacttcccagtaggggcggccgggcagaggcgcccctcacctcctggacggggcggctggccgggcggggggctgaccccccacctccctcccggacggggcggctggccgggtagaggggctcctcacttcccagtaggggcggccgggcagaggcgcccctcacctcctggacggggcggctggccgggcggggggctgaccctccacctccctcccggacggggcggctggccgggcagaggggctcctcacttcccagtaggggcggccgggcagaggcgcccctcacctcccggacgaggcggctggccgggcggggggctgacccccccacctccctcccagacggggcggctggccgggcggggggctgacccccccaccaccctcccggacggggtggctggccgggcagaggggctcctcacttcccagtaggggggccgggcagaggcgcccctcacctcccggacggggcggctggccgggcggggggctgacccccccacctccctcccggacggggtggctggccgggcagaggggctcctcacttcccagtaggggcggccgggcagaggagcccctcacctcccggacggggtggctggccgggtggggggctgaccccccaacctccctcccggatggggcggctggccaggcggggggctgacccccccacctccctcccggacggggcggctggccaggcagaggggctcctcacttcccagtaggggcggccgggcagaggcacccctcacctcctggacggggcggctggccgggcggggggctgatcccccacctccctcccggacggggcggcttgccgggcggggggctgacccccccccccggacggggcagctggccgggcagaggggctcctcacttcccagtaggggcggctgggcagaggcgcccgtcacctcccggacggggcagctggcctggcgggggctgacccccacctccctcccggacggggtggctgccgggcggagacgctcctcacttcccagacggggtggctgccgggcggaggggctcctcacttctcagacggggcggctgccgggcggaggggctcctcacttctcagacggggcggttgccaggcggagggtctcctcacttctcagacggggcggctgggcagagacgctcctcacctcccagatggggtcacagccgagcagaggcgctcctcacatcccagacggggcggcggggcaaaggcgctccccacatctcagacgatggggcggccgggccagagacactcctcgcttcctagatgggatggcgccgggaagaggcgctcctcatttccctagacgggatggcggccgggcagagacgctcctcactttccagactggggcagccaggcagaggggctcctcacatcccagacgatgggcggccaggcagagacgctcctcacttcccagacggggtggcggccgggcagaggctgcaatctcggcactttgggagggccaaggcaggcggctgggaggtggaggttgtagctagcccagatcacgccactgcactccagcctgggcaccattgagcactgagtgaaccagacaccgtctgcaatccccgcacctccggaggctgaggctggcggatcactcgcggttaggagctggagaccagcctggccaacacagcgaaaccccgtctccaccaaaaaaaaacgaaaaccagtcaggcatggc

SEQ ID NO: 11998 - DNA, 686 bp, Homo sapiens
cagggagaatgagactgagagacaggagggcaggagaaggtcagagacaacttttgcttctgaggctgctgctgaggacttcattttggggcgttgttttctgagccccaacagaaggaaggaagcctctccctccaggggtcagtcctgggcctcaagggcaccctcgaagcaggcagctcagctcacagagctcccctcggccatgtcctccacctgcccttccttggtccagcacctcacctgcacacacctgtctggagagtccccaaggttggagagctgctgagtcagctgggccgagcacacagcgcaatacttccttgtgcctcctaaccaggatgggcgacaccagcccattttatggatgggacaagaagaagctgggctgacaagcccaacatagtggagccagcaacaggcttttactctcctctctgtctctttgtctctctcccccaccgcacctccatccgctccattctcctctctgcacatcagcttcccagacaatattcttggtttctgtggctcccaaactgaagcttccccacagtggctgcaactatccagacctggggccacacttgggcctccaggcaggggatctagtgatcacattctggtcatgtcatcaggccaacttggctgagctctgccctccttatctctcttctcccctcgag

SEQ ID NO: 11999 - DNA, 490 bp, Homo sapiens
tcgattgaagcacaatttattagagcccagaaatcatggcaatccattcccacaagcacacagcacagctaaaccagctccaaggagggtccgagtgtccacaactgcaccccaggcccattgtgcctgccgctggagagtgtggggccccttggcccctaaaggtttgctgagaagtcactgacatgagacagatggattaataggagaaacggtatgcaaatttatgtgatgtgtacatataagaacctttagaacgaagacccaacgatgggggaaattgtccatttttatgtttaggtttaataacgtatgaacagtcctctaaaaaaaggattggacacaaagggcttgatctaatgtgaatagactgagtgggaacccagcaaggtctgtctagatttgtcttcatctctgagcattttcttctctggacgtggggcagggccctctctggaatgacagtctcatgacctacagtcaaacaagg

SEQ ID NO: 12000 - DNA, 602 bp, Homo sapiens
aggtgcggtggctcacgcctgtaatcccagcactttgggaggccgaggcgggcagatcacaaggtcaggacatcaagaccatcctggctaacacggtgaaaccccgtctctactaaaaatacaaaaaattagccaggcatggtggcaggcacctgtagtcccagctacgcgcgaggctgaggcaggagaatggcgtgaacccgggaggcggtgcttgcagtgagccgagatcgcgccactgcactccagcctgggcgacagcgagactccgtctcaaaaaaaaaaaaaaaaaagaccagcctgaagcagagattgggtcccagcctggctctgcctggccctctgctcccgcttcacctcacagacagaacgctgccctgtggaggggtccccggaccctttggtgggtgccaagcgggtatggaggccaaggcctgagtggtgagaatagtccaggggctagcgctgcgtggggagggcgagctcagagagcaggggagcctgaccctgcaggtcaagacttctgtctgagagaaatgaaaagctggggattttaagcaaaggaatgccttgacccaaccctcacaacttacataataatt

SEQ ID NO: 12001 - DNA, 1429 bp, Homo sapiens
cagcctccagagtaaagtgaaggcgcaaagcctcatgcaaacatcgaggaatgccttcattgtttcgaggtctctcttcctggcctcccaagcccactccctgccccaagtgccacccttccctggcacctgatccctgaggacgttgggtcctggggtgggggcctctgggctcttcctctgggtcccaggagccccctccccactctgtggccccagctccagacttggcaaggcaagccggagtgaggtttctccactccctcccaagtgctgtgctggcggctcccgaaataaaaatcaaatgtgggcttggcaaagggagcggggtgggagaagcagcggcagcagggctggggcttcattctttccattgtaacttcacctcctaacctctggcattttaattatgtctcctacccccctcactctgcctgggccagggggtgagctcaccctttcctctagcctgggagggggcagctgctgcctggacccccagtccccggcctgctcgggggaatctgggtggcggccatgctgggggtgtcggcctcaggctccctccagcttctccagtctcagaggggcctggagaggggcccagcccccagacagccagccgacacctcaagttccatgtgtgaatcattagtcttcacacccactgctccatttagtggtggccactgtcctaaggcaaggcacggcaggctcaccagcccattctatggatgacttagccatcatcgtctgcagggccaagcctgggcccaggcctatcgctcctggttctgcactctttccaaacccaggaagaggggcaagaacagctcaggcctgataatttgccttatctcttcgagtgtccgtttttttccaatggtaagtgatggaaagcattattttgatactaaaacatacaaggacatagcatggggtaggaagtaaaatgcctgtgaaagttcaaggtagaaaacaaatcctcaaggaagatctcgtggggctctctgcaggcgggccccagggagtagcatcctcctccttggcatggctgtggactggagtgagatgcagtcatatgtgtttgtagccagtttgtgcagacccaaggctgctgtggaagatgccagtgggtgctgggtgctgggtgctggcaggcagccttggcccaccccaggatgcagaggccttcttccctccaaggcccacagtgggagtcctgccgactctctccgtctcctggggagggaaacctccacaggacaagcagcctgtgtgggggtgggggctgcctccacggacagtgcaggcacagggcaaccttgactgtgagcccagggccagcacccaaccaccccaactgaggcttcctctccatcctctgggaggtcccccgccacactgccttagaggcccagcccctcga

SEQ ID NO: 12002 - DNA, 1428 bp, Homo sapiens
cagcctccagagtaaagtgaaggcgcaaagcctcatgcaaacatcgaggaatgccttcattgtttcgaggtctctcttcctggcctcccaagcccactccctgccccaagtgccacccttccctggcacctgatccctgaggacgttgggtcctggggtgggggcctctgggctcttcctctgggtcccaggagccccctccccactccgtggccccagctccagacgtggcaaggcaagccggagtgaggtttctccactccctcccaagtgctgtgctggcggctcccgaaataaaaatcaaatgtgggcttggcaaagggagcggggtgggagaagcagcggcagcagggctggggcttcattctttccattgtaacttcacctcctaacctctggcattttaattatgtctcctacccccctcactctgcctgggccagggggtgagctcaccctttcctctagcctgggagggggcagctgctgcctggacccccagtccccggcctgctcgggggaatctgggtggcggccatgctgggggtgtcggcctcaggctccctccagcttctccagtctcagaggggcctggagaggggcccagcccccagacagccagccgacacctcaagttccatgtgtgaatcattagtcttcacacccactgctccatttagtggtggccactgtcctaaggcaaggcacggcaggctcaccagcccattctatggatgacttagccatcatcgtctgcaggccaagcctgggcccaggcctatcgctcctggttctgcactctttccaaacccaggaagaggggcaagaacagctcaggcctgataatttgccttatctcttcgagtgtccgtttttttccaatggtaagtgatggaaagcattattttgatactaaaacatacaaggacatagcatggggtaggaagtaaaatgcctgtgaatgttcaaggtagaaaacaaatcctcaaggaagatctcgtggggctctctgcaggcgggccccagggagtagcatcctcctccttggcatggctgtggactggagtgagatgcagtcatatgtgtttgtagccagtttgtgcagacccaaggctgctgtggaagatgccagtgggtgctgggtgctgggtgctggcaggcagccttggcccaccccaggatgcagaggccttcttccctccaaggcccacagtgggagtcctgccgactctctccgtctcctggggagggaaacctccacaggacaagcagcctgtgtgggggtgggggctgcctccacggacagtgcaggcacagggcaaccttgactgtgagcccagggccagcacccaaccaccccaactgaggcttcctctccatcctctgggaggtcccccgccacactgccttagaggcccagcccctcga

SEQ ID NO: 12003 - DNA, 774 bp, Homo sapiens
caacctctggtgtgaagagcatagagaaggcttcccagagtgaggggtgaccaggaggagcccgggaggaagagcatggagggcagagggagcagcatttgcaaggcccagaggtaagacagtgcctagggcagggcccacgggagcatccggcctggagggagcggccagggtcctgggagctgcgcgagctgttagggtgcatcttaggaagatttctgggcaggctgtggaggatgggttggaaggtaatcagaacggaggtggagtgacctcttagaaggctgccacagaggcccaggtgagaggtgatggtagccaggcccaggccagtggcagccaggtggaaagaggtggccagactgataagagatttaaaaggcagaagccagaggacttggtgactgatgggcagaaggatgggggccagtgatctgctcaggctggctcctgggcttctgaagaatgaatgaacgaatgaatgaatgaatgaacaaacgaactgggaaacagcaccagatctgaaagccccaggtttcagcttgatcgtcgggctggggagtttgctgctgcacttgcatttggtacacctgcagggcatccaagtggaggtgcccatgagatggctggacgcatggaggtgccctggagaaggtggagagagaggaagccggcacagcctgcaaagaggccagagaatgagtagccagagcccctgaagcctcacaggaggaggtcttagacaaggcacagccaacagtgccaatggcaaga

SEQ ID NO: 12004 - DNA, 771 bp, Homo sapiens
caacctctggtgtgaagagcatagagaaggcttcccagagtgaggggtgaccaggaggagcccgggaggaagagcatggagggcagagggagcagcatttgcaaggcccagaggtaagacagtgcctagggcagggcccacgggagcatccggcctggagggagcggccagggtcctgggagctgcgcgagctgttagggtgcatcttaggaagatttctgggcaggctgtggaggatgggttggaaggtaatcagaacggaggtggagtgacctcttagaaggctgccacagaggcccaggtgagaggtgatggtagccaggcccaggccagtggcagccaggtggaaagaggtggccagactgataagagatttaaaaggcagaagccagaggacttggtgactgatgggcagaaggatgggggccagtgatctgctcaggctggctcctgggcttctgaagaatgaatgaacgaatgaatgaatgaatgaacaaacgaactgggaaacagcaccagatctgaaagccccaggtttcagcttgatcgtcgggctggggagtttgctgctgcacttgcatttggtacacctgcagggcatccaagtggaggtgcccatgagatggctggacgcatggaggtgccctggagaaggtggagagagaggaagccggcacagcctgcaaagaggccagagaatgagtagccagagcccctgaagcctcacaggaggaggtcttagacaaggcacagcgaacagtgccaatggca

SEQ ID NO: 12005 - DNA, 148 bp, Homo sapiens; identical to SEQ ID NO: 8938
  misc_feature (136)..(136): n equals a,t,g, or c

SEQ ID NO: 12006 - DNA, 130 bp, Homo sapiens; identical to SEQ ID NO: 7216

SEQ ID NO: 12007 - DNA, 10553 bp, Homo sapiens
atccaaggcgcaagatggcgctgctttttgcacgttctttgcgcttgtgccgctggggagccaaacgattgggagttgcctccacagaggcccagagaggtaggattatctctttttactcttttacctccagaatggctgccgtctattattcccagaccccactccgagaagcaactccaaccctctcgggtcttttccttccccacctgccttggtcttaagattccaaacctgtgataccatttggtttctttaaattccgggacttactcaatccgagtttttcagctccgtgagctatccgtagtaaagcgacctcgcgactctcttgcccgcttggcattctgactcttccctagttgctcgtgtatcatggctgcctgcctcatatctgaatatatcaccagccctagggttctagcccctgttattatcccgtctttttgctctgcccgcaggcgtcagtttcaaactggaagaaaaaaccgcccacagcagcctggcactcttcagagatgatatgggtgtcaaatatggcttggtgggattggagcccaccaaggtggccttgaatgtggagcgcttccgggagtgggcagtggtgctggcagacacagcggtcaccagtggcagacactactgggaagtgacagtgaagcgctcccagcagttccggataggagtggcagatgtggacatgtcccgggatagctgcattggtgttgatgatcgttcctgggtgttcacctatgcccagcgcaagtggtacaccatgttggccaacgagaaagccccagttgagggtattgggcagccagagaaggtggggctgttgctggagtatgaggcccagaagctgagcctggtggatgtgagccaggtctctgtggttcacacgctacagacagatttccggggtccagtggtgcctgcctttgctctctgggatggggagctgctgacccattcagggcttgaggtgcccgagggcctctagtatgtccattactggagtccctaatcacgcctttggccagcctccttttgaaagtgtccgaagcctttttactttgcctcaagcaacctctagctcccacaattcagtgttgggtcctctgtgcaatatcatgatcatcttcctcatcccctaccttgtgaaagctaggcatacagccaaaccctccttttccccacccaccaactactgccaatttcctaggctaccatgggtgtatcttccttgacctgcttccttcagtccctctgcctccctttgcccaggcctttctcagactgtattccatcctggggtcttatcattcagctttgtttgaatttattaatcaccatgatacctctccctccctttgtccacatgtaacttgttcttggggctctaccagatggctgaagagtaaatcctttctacctctggctgaaggagtggtgcagtcaatgacttggccctttttctacagcacatttagagtttgggctctggctccctcagtaagtgctttattaactcagtgtgtcaaaatgaaaacagagccctccttccccagtagctcagtgccacagaccttcagccccacacagctgtagctatccttaccctgagtccatctaccttaaatctgtacctctgacacccagccagtctgtcataatcattatcccagttataaccttgaccaaaggggaagagagacacttgggggatatctaggggatgagtgctagaaactatttatttatttttgagacagagtctcactctgtcacccaggctggagtgcagtggcatgatcttggctcactgcaaactctgccttttgggttcaagcgactctcgtgcctcagcctcctgagtagctaggattacaggtgtgtgccaccatgcccgtctcatttttatatttttagtagagatggggttttgccatattggccaggctggtctcgaactcctggcctcatgtgatcagcccaccttggcctcccaaagtgctgggatttcaggcgtgagccaccacacccggccaaaactgtttattcttgagaagttccatcttcatttctgccacagttggaacttcccgaggaaggaaggaggcctgaggttttgcacaatctgtttcagagcctgtttagactcaaacctatgcttcccttggcagcagaatacacttaacctaaagcagtatttggagttgagaaaaacctggtggggtaagtgaatatgtactgtttggtagggtaggtagagaagctgtgctttgaccctgtgattccatctttttctaccttctatgatggtgatgaagctagatacccctagggaagaaagaaggactgggtttagcaaaaatgatttggtaattaaagtttatttgaacacaaaatactttctctgtctataaaattggctgttagcagtagcagcagcatgtcctggccaaggggagtagatttctccagactactaaagccatgtatatagccattcccacttcccatattctgtggatatgtacatgtgcatggtagctagagtccctccaccagagtatctctctcatgatggtttcttcagggagaggaagaggagacctgggtgaagagctgggatggttttgagtggggcaagccattaggctgtaccttgaagcccagtctctctggatagctgtactgcaggtgtcctctgaggcccttctctgtactctgtctgctgagggaatggggtattttgactcccatagaaagcactagcctaagtcaccaaatgactgcttggtccccactgaagcagtgtagctctccatagtatttttggtggttatggattacatgtgtggccagctcatgctttttcttgagcaggggctgtccatgacctgtgctcataccatgctttctaagttctctttggacagggcctcagctgctgcctcagcctgagtttcagagagtgtgtaggagtcctggtaatcttgaagcagtttgaccacctccagatggttgaactgcacagcatcatccaggggaatgttgccccacctgagaggaataatgatatgatcaggcaaaggagacgtggagagtggtggttgtatatatttgcatggtggctggagggtaggtggagaagctgtgcccaccctcctccacttttagcctattcctcacctgtccttggcaaaaggattcactttgcaagcctcgatcaggaatttaacaacttcgatgtgtcctaggaatatgggcagaaggaaaatgagaaggcgcaggtcttgaaccctttggtgcagacacttagccactgaagtctttaccaagaggggaggggaaaaggcctcttcccattttgtaccctgcagcactcagtcatagtctagctgcaaaccgaagggtgtctagataaaactagttgctgcccctataaccttgagggcacatataatgaaggtacttttggtgaaaaagaaagggtcttatgattaccctcctcctcccctccttaacccttcagtaccttcagctgcagcaacatgcagagctgtgcgcgagtcatagtctttctgttccatatccatggctgacaaggcaaacctgagggtagtgggaaagcagctagagttgcctagatcagactggaatcacaggtgttctttgtgaactggtgtcagactggatgagtttcagagaaagtgaaacagcctatagccagatttgttggctctgaataatcttttttccatatccagatgagactgttatactcatattagagagatgggaatgtgatccttccagaaatatcactcactgcctacctgtggtaagtgcccatttgaggcagggtacctacttcctaggacactgctcttaacactcaataacaatggctaacattaattatcatagagcagacagtttactttttttaaaaaaaatctccttttttaaaaaaatttcatttaaatgcaatctatatccattctaattccaaagctgaagcacttaactattttgctacgctgcctcctagtaaaatctctgaccaggagtattttattgtgtatatttggtcacagtagcattaccttcgaagagctgagacatcgccactataggcagcaaataacaggttgaccacagtcttgttctggaacacaaatcatacccacatgacattaattgaactcacctatgccagctgtgccctgtgaccctcctccatggatgcttagtccaagggtattgctgaagtgttatggaatgtgctactctgaaatattcttttttttttttttttttttgagacggagtctcgctctgtcgttcaggctgaagtgtagtggcgcgcggtcttggctcactgcaacctctgcctcccggtttcaagcgatgctcctgcctcagcctcccaagtagctgggaccacaggcgcgtgccaccacgtctggctaattttttgtattttcaatagagaccaggtttcaccgtgttagccaggatggtcttgatctcctgaccttgtgatccgcccgccttggcctctcaaagtgcagggattacaggcgtgagccaccgcacctggcctttgaaatattcttacaagccacctggagttttccttacccgaatttctgccccttcacgccgtgggtctaacttccgagcacagtgcctcaggttgtcatagttgtggaaattgaagagagacaccaacttctagaattgtaagccaaatatattgtttatttactccttacacttagtaggagctcaaaattgctttattatagtaaaagtggtaccattaaacaaatttattgcttcaaaaatagtaagtactatatgcaaagcatctcacctggcagaagctggtccccctatggctgttccccagcttgtccaatgggggtgacaggcacatcattcccatgacattgggtaccaccaggaggatggctcctgatacagctgacttggctggcaggcccacctggggaacagaactgaagctgaggataaagtgggtgtgccccaaatcagaaaataaacaagttaggctgtactcttaacaagtttacaaatgactgcatgaccacaatccacctcaaccttttggcttgttaattagcttcttttattactcctgtcctttccttcccttaaattcattgattcagctagaaaatattttttgaaatacttacagcattctgtgctagatgctgtgctagaactaggaacttccattctggtgttaggagataggtaataaacaggtaaataaatagacacgtaatgtttaaagtaattgtgataaatagtgagaagtagggtgctgtaaatagaggtagaggggggccacatgagatagggtggtcagaaaagtctttctttggaaatgacatctaagctgagaccccaaggagaagagccagcaatgtgaagcacaattcaggagctgcaacacctctggttgtttttctttttctttttttctttttttttgagatggagttttgctcttgttgcccaggctacagtgcaatggcacaatctcggctcagtgcaacctctgcctcccaggttcaagcacttctgcctcagcctcccaagtagctgggattacaggtgcacaccaccacccccggctaattttttgtatttagtagagatggggtttcaccatgtaggtcaggctggtctcgaactcctgacctcaggtgatccacctgcctcggcctcccaaagacatctctttatatattcgaggaacttggtgtttttgagaaactcgtctaaggagtctcaacctaattgccttcctggaagttagtgaatgagaggcaggaacaagcttccacctctatcttgagagagtcagtgttctctcttcttagcactgggctcatgacagatggatagcagagccagaaactcacgtggaaggcaaactggccagagaagtcatacatgccgcaggaatgcatgaggctgagggtgttgcgcactgcttcagcactcagcacactctcgcctgtgatggggcagatcccaccgttggcgagggtggctgccatgacactgcctgattcacaagtgacctccacagaacacagctatgaaaacaaagaataggtgaagatgtgacgtgaacctgcacatgggaccctcgggtgtagggaaagggcaagggcaaggacagtctgtcctgttccctcggccctgagcagtgttttcttacctggaagtagagatcaagggcagccatcatgtccacccccttaggaaagcactgcaaggaagagaggggagagcatttctcttcaggacatcagccctttcacactgtcagggtctcagctgaagcccccaacccctactgcccttccactagcagcagaattcccagggactttctcttccggcctcttctggttaccttcttttccttgagataatagccgatggcataattccgatcccctgtttccttctctgactggaatctgaagcaaacacccaatttagtacttgaagttggaggagtgggtgttgggagaaggggaaaaattaccttccctggagagacagaactacatcacaccacaaactaaatgaacccctttataacttctcacagtaatattagaggaaatttctgaacctgagcaaacactcagcatagttttgttataaagtaaacccaaaccaaacaccccaaactgtctagtcatctaggaaaactggtgaagtttttggctttgaaagtcttggcaagaaagggcttaggcacaaaccatcacactgcctctctcattatgtactaattagaaatggaacaaattattttacaagataaacaaatgtttatgaagggactcagaggaagctggagggccaaagttcccctgggatttcttcctcctaagattctctctcccccattcctcttgtccccatcctaagtacacacacatacaccacaatgctttcagtcagtcctctgagtagggacttacgtggcattgctgaaacccatgtattcattcccagccattttgttgagatactgcaacacctggaagagaaaaagggacattgaggctccacttggttaagaagctctattaatacctcacaggttgactagcccttctgaactcaggtcttgtcaagaggctttcctctctgaggccagcagatttccacatttctggaaataaggcttctagtatgggctggtgcacctggtagtggggttagagagccactggggcagctggagaggacagcatgccatggcgaaatgcagccaggggctaagtagcaagggaacttacaaaatcaaacttctctgctttgttacagtccatctgcagagaaagagagagatgtcagcattctaagtgtaggaggatgacagagggaagggtcagaaggatctagtggagttctagtgttagtctggtcctgctgctgcaaatgtgttcaattttataatggccctttttttatccttctgaaaacaccgcacttccattggctcctctctttctctttcttttttttgagacagtcttgctttgtcacccttgtcacccaggctggagtgcagtggcacgatcatggctcactgcagctttgacctcccaggctcaagcgatcctcccacttcagcctccaagtagctcggattacaggcatgagccagcttgctgggccatcccacttccattctcaatccaaaccctcatccctgactcccacgttcattttcctgactcgaatcctgtctcctagccccaccctatccctgatctccatccccattccttacaccccatgctggagctttactccatcccattggccagcatgatggttcatgcctgtaatctcagcaatttggggggctgaggcaggaggatcgcttgagaccaggggtttgagaccagcctaggcaacataggagagaccctgcctcaatttttttttttttttttttttgagatggagtcttgctctgtcgcccaggctggagtgcagtggcaggatctcggctcaactgcaagctccgcctcccgggttcataccattctcctgccttagcctcccgagcagctgggaccacaggtgcccaccaccaagcctggctaattttttgtatttttagtagagacggggtttcaccgtgctagccaggatggtctcgatctcctgacctcgtgatttgcccacctcggcctcccaaagtgttgggattacaggcgtgagccaccgcgcctggcctctatattttttaaaaaaggtcctacttagatgggaatgggatgaggcaggtcccagatacaggtttgtagatggagccatcacagaacaaggggagagactcagcctcttttcctcacccagactcattgcttactcatgtgtcaactacagagtcaataccacagggactctgatacctgagtccctgaggggaggattcctaacaccaccttccccaggaggggctgtgattggctccagggtgttgctgcccagctgctcccaggttcttgctcaagccctgggagacctacagctgatgggctagtctgacaccctgttcaaggccaactcacagttccaggtgacgtgaataactgccctggcctggccattcacccttgcctgcaggtgtcccacacccagaagtggccaatcagtgcccaatagtgctgtcctccccttgtctctggcatttggcccttggtcctaggcaggggtcaggacctgctcacttctctaagggtcagaaagctctaggctctagactcatgggtgggggcagggaacagtactgagtggggatgacggaggtggtgcagtctcttatactgacattgtcagcataacatgtgggtccctgctgtgcctcatgtgccttctggggaccctcaaaggaatcagagccccaccagtctccctggagagctgaacaaatatgagggatacaggaacacaggagcttagaggataatacctatcagaaggttaaggtggcactgaccttgatcagggagctgacaacaatggcaccagcattgaccatggggttatgggggattcctggggaaatacaaaccaccaagagtcttagccactgaacaaagcctccctgacagcccgctcactttgtgggttagacaagaaagactgctagggagaaaggcatgacagggctaatcaggaagggcagagaaacaaaaaaggctgggagatggggtggggataaggagaaggggacagctgtaagtacggtctgagccttggtagtgctcaccttcctcattgagggagagcttgttgtagcgcaggccacttggctctttgcccacaaacttgtgcacgtagtcagtgcctagggtgcttatggagatggcataggtgaggggcttcacacaggactgcaggcagaaggggatctttgtgtggcccacagagtgcctggaggcagacagatgccatgaaaggggttggcctgtgttcggcacctgtgccctgcctccccttcctcttgcccagcatctcaccgttgaccatccacagtgcacagggagacaccccacaggtctgggtttgacttggccagctgagggatgtaggctgccacctggacatgagtgggtagagaaaagggagatggatgtggagaagaggaacagagttgaggttgagggtcaagagaatcttttagataaaagctaaaattctgtcttctatagggcagaggggttccctcctgcctgttgctcccagaaatgcccgagccttaagtcctagaaggccatatctttgtgtatccgcaatcctgtagagatagcagtaaagccaatggaagttaaaaaaggagaattctgaggcaaccttccccttttggttcttaggctcagttaccctataaatccctttgaaggctctattcgatcttgattccctcacctgctctaggaatcgtgtatagaaacacatgaagccatgtcaccatttacagaagttctgcttctcatctctcattcataggactcccagccccaggaaatctctgagaagcgaggtatatctaggtgtggtggctcatgcctgtaatcccagcactttgggaggccgaggtgggtggatcacttgagatcaggagttcgagaccagcctggccaatatggcaaaaccccatctctactaaaaatacaaaaattagtcgggcatggtggtgtatgccagctactcgggaggctgagacaggagaatcgcttgaacctgggaggtggaggttgcagtgagctgagattgcaccattgcactccagcccgggtgacagagcaaaactctgtctcaggaaaaaaaaaaaaaaaaaaaatctggcccaggtccctgacccctcccttagtcccctgactctcactttgcctccagtgagctctttgacatcctcaaagatgcgatccacatggcccgtgaactcctcaaaatcaggaatgaca

SEQ ID NO: 12008 - DNA, 143 bp, Homo sapiens; identical to SEQ ID NO: 7217

SEQ ID NO: 12009 - DNA, 116 bp, Homo sapiens; identical to SEQ ID NO: 7991

SEQ ID NO: 12010 - DNA, 151 bp, Homo sapiens; identical to SEQ ID NO: 7218

SEQ ID NO: 12011 - DNA, 126 bp, Homo sapiens; identical to SEQ ID NO: 7221
  misc_feature (9)..(10): n equals a,t,g, or c
  misc_feature (14)..(14): n equals a,t,g, or c
  misc_feature (20)..(20): n equals a,t,g, or c
  misc_feature (95)..(95): n equals a,t,g, or c
  misc_feature (107)..(108): n equals a,t,g, or c
  misc_feature (110)..(110): n equals a,t,g, or c
  misc_feature (118)..(118): n equals a,t,g, or c

SEQ ID NO: 12012 - DNA, 151 bp, Homo sapiens; identical to SEQ ID NO: 7219
  misc_feature (4)..(4): n equals a,t,g, or c
  misc_feature (45)..(45): n equals a,t,g, or c
  misc_feature (89)..(89): n equals a,t,g, or c

SEQ ID NO: 12013 - DNA, 118 bp, Homo sapiens; identical to SEQ ID NO: 7220

SEQ ID NO: 12014 - DNA, 100 bp, Homo sapiens
tttttgtacttttggtagaggcggggtttcaccatattggccaggatggtcttgatctcctgacctcgtgatccgcctgcctcggcctcccaaagtgctg

SEQ ID NO: 12015 - DNA, 2953 bp, Homo sapiens
agctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttggtaagtgccctcctggggggcagctggggtctgggaggccttgggatgtggctgcagctgggtcagtcagccaggctgaagcccactccctgggtctgagcagactggccccaaactccagagaccacccctcaccccccagcttctgtctctgctgctggactgtgctgtttgtaaggcatcccccaccccgagaagttctgctaagatccccaagaaggggacagatcctctctggcagagacactggcagacaagaagagccagagagaagtggggtgggggcatcagcacccccagcagctgctgctgcctgctgacccagcctccagctcctccgggtgcagggtccctcctgctgaccagcctccagctcttcccagttctgggctccgcagcgagcggcttgggggcactacctgacacaggagaccatgtctgggcagagggtggctgcaggtggagtctgtggccctgtggcgcacacccaggggctcccccgatgctggttactatctgggctatggtggccacagctgtcttgcccctcctcacggccgtgctgggtgttaccgtggtcacccgcagggacacggaggggccaggcagagcagccctagttcacctcaccgggagcccccgccagaaggtgggcacctctgggagggagggactgccaggccttggggcttcctgtgctgagtcagagctggaacgggagacgcaggagccccgcagccgcgggaggtgcagatttggggctgccaggtggcgccaggtccccttggccagcccccagcgcccctttcttctgtccccagggcctcggcttcacaggatggggctgccagtgtcctgggcccctcctgccctctgggttctagggtgctgcgccctgctcctctcgctgtgggcgctgtgcacagcctgccgcaggtaggtccctcagccgcgttctgtctggggcctcgctgcggctgccattcacagcccagcgcgggaaggggctggaggcaggtccgcgcacccagctcggcacgcgcgcctgcaccgggccttggacccgaggctgacgaccccgccccccgccccccacctctacccccaaggcccgaggacgctgtagcccccaggaagagggcgcggaggcagcgggcgaggctgcagggcagtgcgacggcggcggaagcggtgagtgccaggctgtcccggggaccagggtggggtccgcagggcaccgaccagccttcctcgcccccagtccctactgaggcggacccacctctgctccctcagcaagtcggacaccagactgcacgagctgcaccggggcccgcgcagcagcaggggtgagcagagggcggggcgggggcggccgggcggggcttactgtgcagcgcgtgccaacccctgggccagacccgctcctgccccctgcccggagtgaactctgccctgaccccacccccagccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtaacgtgggccagggtagggcgctgtgggtggggccggcagatcctcagcaggttggatggtgctgacccctcctcgggttggcttcctgtctccaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggctgccagcccgtgaggtccgtgaggtcctggccgctctgacagccgcggcctccccgggctccagagaaggcccgcgtctaaataaagcgccagcgcaggatgaaagcggcca

SEQ ID NO: 12016 - DNA, 2947 bp, Homo sapiens
agctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttggtaagtgccctcctggggggcagctggggtctgggaggccttgggatgtggctgcagctgggtcagtcagccaggctgaagcccactccctgggtctgagcagactggccccaaactccagagaccacccctcaccccccagcttctgtctctgctgctggactgtgctgtttgtaaggcatcccccaccccgagaagttctgctaagatccccaagaaggggacagatcctctctggcagagacactggcagacaagaagagccagagagaagtggggtgggggcatcagcacccccagcagctgctgctgcctgctgacccagcctccagctcctccgggtgcagggtccctcctgctgaccagcctccagctcttcccagttctgggctccgcagcgagcggcttgggggcactacctgacacaggagaccatgtctgggcagagggtggctgcaggtggagtctgtggcctgtggcgcacacccaggggctcccccgatgctggttactatctgggctatggtggccacagctgtcctgcccctcctcacggccgtgctgggtgttaccgtggtcacccgcagggacacggaggggccaggcagagcagccctagttcacctcaccgggagcccccgccagaaggtgggcacctctgggagggagggactgccaggccttggggcttcctgtgctgagtcagagctggaacgggagacgcaggagccccgcagccgcgggaggtgcagatttggggctgccaggtggcgccaggtccccttggccagcccccagcgcccctttcttctgtccccagggcctcggcttcacaggatggggctgccagtgtcctgggcccctcctgccctctgggttctagggtgctgcgccctgctcctctcgctgtgggcgctgtgcacagcctgccgcaggtaggtccctcagccgcgttctgtctggggcctcgctgcggctgccattcacagcccagcgcgggaaggggctggaggcaggtccgcgcacccagctcggcacgcgcgcctgcaccgggccttggacccgaggctgacgaccccgccccccgccccccacctctacccccaaggcccgaggacgctgtagcccccaggaagagggcgcggaggcagcgggcgaggctgcagggcagtgcgacggcggcggaagcggtgagtgccaggctgtcccggggaccagggtggggtccgcaggggaccgaccagccttcctcgcccccagtccctactgaggcggacccacctctgctccctcagcaagtcggacaccagactgcacgagctgcaccggggcccgcgcagcagcaggggtgagcagagggcgggggcggccgggcggggcttactgtgcagcgcgtgccaacccctgggccagacccgctcctgccccctgcccggagtgaactctgccctgaccccacccccagccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtaacgtgggccagggtagggcgctgtgggtggggccggcaggtcctcagcaggttggatggtgctgacccctcctcgggttggcttcctgtctccaggtggacgtcctgtactccagggtctgcaagcctaaaaggagggacctaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggctgccagcccgtgaggtccgtgaggtcctggccgctctgacagccgcggcctccccgggctccagagaaggcccgcgtctaaataaagcgccagcgcaggatgaaagcggcca

SEQ ID NO: 12017 - DNA, 2943 bp, Homo sapiens
agctggctgcagggtctctggggagagaagggtctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttggtaagtgccctcctggggggcagctggggtctgggaggccttgggatgtggctgcagctgggtcagtcagccaggctgaagcccactccctgggtctgagcagactggccccaaactccagagaccacccctcaccccccagcttctgtctctgctgctggactgtgctgtttgtaaggcatcccccaccccgagaagttctgctaagatccccaagaaggggacagatcctctctggcagagacactggcagacaagaagagccagagagaagtggggtgggggcatcagcacccccagcagctgctgctgcctgctgacccagcctccagctcctccgggtgcagggtccctcctgctgaccagcctccagctcttcccagttctgggctccgcagcgagcggcttgggggcactacctgacacaggagaccatgtctgggcagagggtggctgcaggtggagtctgtggcgtgtggcgcacacccaggggctcccccgatgctggttactatctgggctatggtggccacagctgtcttgcccctcctcacggccgtgctgggtgttaccgtggtcacccgcagggacacggaggggccaggcagagcagccctagttcacctcaccgggagcccccgccagaaggtgggcacctctgggagggagggactgccaggccttggggctttcctgtgctgagtcagagctggaacgggagacgcaggagccccgcagccgcgggaggtgcagatttggggctgccaggtggcgccaggtccccttggccagcccccagcgcccctttcttctgtccccagggcctcggcttcacaggatggggctgccagtgtcctgggcccctcctgccctctgggttctagggtgctgcgccctgctcctctcgctgtgggcgctgtgcacagcctgccgcaggtaggtccctcagccgcgttctgtctggggcctcgctgcggctgccattcacagcccagcgcgggaaggggctggaggcaggtccgcgcacccagctcggcacgcgcgcctgcaccgggccttggacccgaggctgacgaccccgccccccgccccccacctctacccccaaggcccgaggacgctgtagcccccaggaagagggcgcggaggcagcgggcgaggctgcagggcagtgcgacggcggcggaagcggtgagtgccaggctgtcccggggaccagggtggggtccgcagggcaccgaccagccttcctcgcccccagtccctactgaggcggacccacctctgctccctcagcaagtcggacaccagactgcacgagctgcaccggggcccgcgcagcagcaggggtgagcagagggcggggcgggggcggccgggcggggcttactgtgcagcgcgtgccaacccctgggccagacccgctcctgccccctgcccggagtgaactctgccctgaccccacccccagccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtaacgtgggccagggtagggcgctgtgggtggggccggcagatcctcagcaggttggatggtgctgacccctcctcgggttggcttcctgtctccaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggctgccagcccgtgaggtccgtgaggtcctggccgctctgacagccgcggcctccccgggctccagagaaggcccgcgtctaaataaagcgccagcgcaggatgaaagcggcca

SEQ ID NO: 12018 - DNA, 28091 bp, Homo sapiens
gcggcgctcgggaggaagtgccgatcggctgctggggcgaaaagggggcgccgggccgctctagccggtgaggccggcgggctctctgtggctgcggctgggaaaccgcgcggaggaggtgcccggccggggaccaggtggccgcggtttgcggggacgcggccctggccagacagaagagacgccgggcgggggggcgcggccggcctggaaggcggcgggcgcggcgggtgggctcggcggagggtgaggcggcggggcgccccgcggggaaggggctccggagtgacgcgggacccggctagcggcgagcccacggcggctcggaagggaagcgcggagcctgagcgggggtacccgggctgcgacctctgcgctgggagctgtgcctctgagccggtgtctccccgagggaaaggggacgtgcccgtgcccgtgcccgccctcaggctgtggggtcggtcccgagacgcggggctcagctggcttctcttcttgcagccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggtaaagccctttgttgtcagatgccaaccttaggggcgtaaggggcacgcacacagggtcgggtcaggatcggccctccctttgctttgcagttttgtctcagcttcctggggcaggcgtgctttgacagctgtgtctgtgttcaggcgtctacgtcttccttctggggtgaatcaagaagcatggaaggaggccaggcgcggtggctcacgcctgtaatcccagcactttaggaagccgaggcgggcagatcacctgaggtcaggagttcaagaccacgctggtcaacatggtgaaaccccatctccttaaaaacacaaaaatgaaccggtcgtggtggcgcgcacctgtggtcctggctactcaggaggctgaggcaggagaattggttgaacccaggaggccgagtttgcagtgagtggagatgcagccactgtactgcagcccgagcagcagtgcaaggcttatgtggaagagagtaggtctccagcctatcgtcagtttttttttggtggttgttttaattttttttgagacagggtcttactttgtcaaccaggctggagtgcagtggcatagtcctggctcactgcagcctggacctcctgggctcaaccgatcctcctgcctcagcccccctaggagctgggctacagactcacgctactacacccagctaatttttatattactataattttttatcttttttttgagatggagtcttgttctgttgcccaggctggagtgcagtggcgtgatctcggctcactgcaagctccgcctcccgggttcacgccattctcctgcctcagcctcccgagtagctgggactacaggcgcccgccaccatgtctggctaattttctgtatttttagtagagacggggtttcaccatgttagccaggatggtctcaatctcctgacctcgtgatccgcccaccttggcctcccaaagtgctgggatgacaagcgtgagccaccgcgcctggccttttttttttggagacagagtttcactctcctcacccaggctggagtgtagtggcgcaatctcagcttaccgcaacctctgtctcccgggttgaagtaattctctacctcagcgtccagagtagctggcattacaggcgcccgccaccacactgggctaattttttgtatttttagtagagtcggagattcaccatcttggccaggctggtcttgaactcctgacctcgtgatccacccaccttggcctcccaaagtgctgggatcacaggcgtgagccactgcgcctggccctgttgttagttttattctctagagttcaacttttaaattttactttcatggagattttcaaacataccccaaattagagagtttagcataatcaccgcccacggtccatcatccaatgtcgtcatttattaatattttcccagtctcattttgtctgttctccctgccctatttttttctttcctgggccattttaaagcaaattccagaagttactggttttttccaattatgaatacttcatagttgcatctctaatctaactgattaggaaattacttaaaaagtaactttttggaagtccaagtccgatgtgaggacaaaaaagagtaacttctgtgtcataataggtaacacatttaatggtaatacctcttccatattcaaatatgaacaattattactgtaatgtctctatttccctaagcgcatagctttatttttcctcctttttacttttctcttagaagaaatatttaccaagccttctagtaggtaattttcttttttagccaatagttcaggctgaccgtgtaaccatccctagttctagttctagttctttgaatgtcttccttttttttttttttttgaaacagcgtcttgctgctctgtcacccaggctggagtgcagtggcacaatctcggctcactgcaatctccgcctccctggcccaagccatcctcccacctcagcctccctaatagctgatactacaagtgtgcactgccacgcccagctaatttttgtattttttgtagagacgggatttcaccatattacccaggtctcgaattcctgatccctttgatgagagatctgacacatccctgtggtgctccctctgggccaggcactgctccaagggtttcatatactttcattcatctgtgcaacagccctgtaggtaggccctgcagtcacaccatctgacagaggaggaaacaggagtagaagaactgagtggtccagggcttcaaggctcagagggctccggttgcccccagccctcgttccgtcccctgctccacccagtgctgcttgccatgtcggcatcaggcctgatctgaaagcttccggagcatcttacagacgtccaccttgccaccattcaggactgataagttctcttggatttgcgttggaccttttttttttttttaagatggagtttcactgttgttgcccaggctagagtacaatggcatgacctccacctcctgggttcaagggattctcctgcctcagcctcccaagtagctgggattacaggcgcctgtcaccacgtggtgcccagctaatttttatatttttagtagaggcagggtttcaccatgttggccaggctggtctcgaactcttgacctcaggtgatcccgccttggtttcccaaagtgctgggattacaggcatgagccaccacacccggcccaggatttctttatatattctggatatcatcccttatgaagtatatagtttgcagatatttgctcccattgtttgggttgtcttttcacttgatatagtgtcctttgatgcacaaacattttaaattttgatgcagtgcaatttattgtttctttattgcctatgtttttgtcatcaggtttaagaaaccacctcatccatagttatgaggattttcacctatgttttcttctaagagttctgtagttttagctgttaaatttaggtctttgatccattttgagttaatttttgtatatgttattaggtgagggtccactttattcttttgcatgtggatttccagttttcccagcaccatttgtttaaaagactgctttttctccactgaatggtcttggcacttttgtccaaaatcaattggcaatatatgtaagggtttatttctgagctctctctcctgttccattggtgtatatgtgccagtaccacactgttctgattattatagctttgtgataagttttaaactcaggaagtggtagttattcaccatttgctcctctttttcaagtttgttttgtttctggatcctttgcaatttcatatgaattttaggatcggcttgtccaattctgcataaaagacagtttgaattttgatatggattgcatagaatgtgtagatctgtttggggcacattgtcatctttacaatattaagccttctggctgggtgtggtggctgacgcctgtaatcccagtactttgggaggctgaggcgggcatatcacttgaggtcaggagttcaagaccagcctggccaacgtggtgaaaccccgtctctactaaaaataaaaaacaaattagtcggaggtggtgcacacctgtaatcccagctacacgagagggtgaggcaggagaatcgcttgaacctgggaggaggaggttgcagtgagctgagatcatgccactgcactccagcctgggtaacagagggagactccatcttaaacaacaacaataacagaagaaaaaaacagtattaagtcttccaattcatgaatgaaggatctgtccatttatttacgtctttaatttctttcaacagtattttgtactgttcaagtcttgcacattcttggttaaataagtattatttttgatgcttctctaaggaattgtttttcttttccttttttttttgagacagagtcttgctctgtcacccaggctggagtgcaatggcacaatcttggctcactgcaacctctgcctcccgggttcaagcaattcttctgctcagcctcccaagtagctgggatcacaggtgcctgccaccacacccagctaatttttttttttgagatggagtcttgctctgttgcccaggctggagtgaagtggcccaatcttggctcactgcaagctccacctcccgggttcacaccattcttctgcctcagcctcctgagtcgctgggaatacaggtgcctgccaccacgcccagctaattttttgtatttttagtagagatggggtttcaccatgtagccaggatggtctcgaactcttgacctcaggtgatctgcctgcctcggcctcccaaagtgctgggattacagatgtgagccactgtgcccggctggagttgttttccttagttacattttcaggctgtttgttgctagtatatagaaatacaagctgggcaccgtggctcacgcctgtaatcccagcactttgggaggccaaggcgggtggatcacctgtggtcaggagttcgagaccagcctggccaacatggtgaaatccagcctctattaaaaatacaaaaattagtctggcatggtggcaggtgcctgtaatcccatctactcaggaggctgaggcaagagaattgcttgaacctgggaggcggaggttgcagtgagctgagatcgcgccattgcactccagcttggggaacaagagtgagacttcatctcaaaaaaaaaaaaaaagaaatacagtggatttttttatgttaatcctgtattgattgctgaattggtttattagtgctaataggattttttatgcactatttaggattttcgatatatacaatcatatatattcaatatatacaattaatatatatgtgaatagagataattgtagtctttgtttctagtttgcatggcatttatttctttttcttgcttaactgccttagctagaacttcaagtacaatgttgaataaaagtgactagagcgggccgggggtggtggctcacacctgtgttcccagcactttgggaggtggaagtgggcagatcacttgagatcagcagtttgagaccagcctggccaacacggcgaaaccccatctctactaaaaatacaaaaattagctgggtgaggtgatgtgcacctgtagtcccagctacttgagagggtgagacatgagaattgcttgaacctggggggcggaggttgcagtgagccaagatcatgccactccactccagcctggacgacagagcaagaaccctgtctttaaaaaaaaaaaaaaaaaaagtggctagaacaaacatctttatcttgttcctgatcttaggtggaaaacttttttgttcctgatattaggtggaaaacttttagtctttcactgttgaatatgatgttacttgtaggttttctgtagattccctttatcgagttgaggaaattctcttatattcatagtgtgttgagtgttttttatcatgaaagggtgttgattttttttttaaagatagggtcttgttctgtcacccaggctggagggcagtggcatgatcatggctcactgcaacctcgaattcctgggctcaggggatcctcctacttcatcctcctgagtaggtgagactacaggcatgagccaccatgcccagctaattttttaatttttctgtagaggtagggtcctgctttgctgcccaggctggtcttaaactccagggctcaagcaatcctgcctcagcctcccaaagtgctgagattacaggggtgagtcactgcactgcacccagctgtgtgggatttttcaaatgcttttttcctttagatgatcatgtgtggtttttttcctttcattttgttaatgtggtatattgattttcgtatgttgaaccatccttgaattcctcagataaagcacgcatattcatggcgtattatctctttattattattatttttgtagagatgagatttcactctgttgcccaagctggtctcaaactcctgggctaaagtgatcctcctgcctcagcctccgaaagcgctgggattataggcatgagccacttggccctatcttttttctttttctttttttttttttttgagacagagtctcactctgtcgccgggctggagtgagtggcgcgatctcggctcactgcaacctccatctcccgggttcaagcaattctcctgcctcagcctcctgagtagctgggactacaggtgcccgccactatgcccagctaattttttgtgtttttagttgagacggtgttttgccatgttggacaggctggtcttgcactcctgacctcgtgattcacccaccttggcctcccgaagtgctgggattacaggcgtgagccaccgcagcgagccttatctttttaacagttaaaagtttaaggccttatcatgtaataacattgctggatttgatttgctgctgttttgttgagaatatttgcatctgtattgataagggatattggtctgtagttttcttttcttggcatgtctttgtatagctttgatgccagcataatattggcctcatagaatgagttaggaagtattctttatattatgggaagaggtaaaaagggattggtgttaattcttcttcaaatgtttgatagaattcaacagtgaagtgatatatacaatcatatatagagagagagagagagagagagagatggacttttcttttgttggaagtttattgactattgattcaatttccttattgaaattgacttttctttttggaagctaaaacgtataactgtagtgaaagtttctgaacttttctttcattggaagttttttgactactgattctttatttgttataggtctattcagattttctgtttcttcttgagtcagtttggtctcgctctgtcgcccaggctggagtgcagtggtgccatcttggctcactgcaacttctacctcccgagttcaagtgattctcccacctcagcctccccagtatctcggactacaggcgcacgccagcatacctggctaatttttgtatttttagtaggaacagcatttcaccatgttggccaggctggtctcgaactcctgacctcaggtgatccacccgcctcggcctcacaaagtgctgggactacagacataagccaccgcgtccagccttgagtcagtttagatagtttgcatgcatgtttctaggaatttgtccattttgtttatgttatctaatctgttaccatacaattgttcatagtatccttttatagccctagttatttctgtaagatcagtagtaatagctccactttctctcttggttttagcaatttgagtcatctcttttcttcctctttttttttttttgagatggagtctcactgtgtcacccaggctggagtgcagtggcatgatcttggctcactgcaacccctgcctcccaggttcaagcaattctgccttagcctcctgagtagctgggattacaggtgtgagccaccacacccagctagttttgttttgtttttttgtttttgagacggagtctgtttctgtctcccaggctggagtgcagtggtgcaatctcactcattgcaacctccgactcccagattccagcaattctcctgcctcagcctcctgagtagctggaactataggcgtgcaccaccacgcctggctgatttttatatttttagtagagatgggatttcaccatgttggccaggctggtcttggactccctacctgaggtgatccgcccaccttggcctcccaaagtgctgggattataggcatgagccaccatgcccagccagtttttgtatttttagtagagatggggtttctccctgtcggccaggctggtcttgaaatcctgacctcaggttatccaccagccttggcctcccaaagtgctaggattacaggcatgagccaccacgcatggcctgtcttttcttcttggtcattttcgctaaaggtttgtcaattttgttgatcttttttgttgctgatctctattgttttcccattctgtttcatttatttccattttaacctttgtttccttttttctgctggtttgggtttaatttgctctttttttcccctaatttttcaaggtatacagttaagttattgatttgagatctcttttttcttttctttttttttttttttttttttttttggttgctgttgagatggagtctccctctgtcacccagactggagtgcagtggcatgatctcagctcactgcagcctccgccgcccaggcgattctcctgcctcagcctcctgagtagacgtttcccggccaaggtgtttctttttgaatgtaagcatttacagctacagatttccctctaaacactgctttcactgcattccataagattgttttttgttgttgttttgttgtttgagacacagtctcactctgttgccgtttggagagcagcgatgcgatcatagctctgtagccttgagctcctggactcaatcagtcctcctgcctcagcctcccaagtagctgggactacaggtgtacaccactgcacctaactaatttcttttataagtttttgcagaggccaggcacagtggctcacacctgtaatcccagcactttgggaggccaaggtgggtggatcacctaaggtcaggagttcgagaccagcctggccgacagggagaaaccccatctctactaaaaatacaaaaattagctgggcgtggtggcaggtgcctgtaatcccagctactcaggaggctgaggcaggagaatcgcttgaacctgggaggcagaggttgcagtgagccaggatcacaccattgcactccagcctgggtaacaaaagcaaaactccatctcaagaaaagaaaaaaaaaagtttttgcagagacagggtatcactttgttgcccaggctggtctcaaactcctgacttgaaggagtcctactgcctcggcctcccaaagtgctgagattatgggcaagagccaccgcaccctgccacttggctgttttgttctgttgtatttccattttcattgatctcaagacatcctaatctcccttttgtttttttgttcgacttactcgttattcaagagtgtctttatttctgcatatttgtaaattttccaaaaaagtttttctttctttcttttttttttgagaaagggtcttgctctgtcgcccaggctggagaatggtggtgcacaatcttgcctcactgcaacctctgcctcccgggttcaagtgatcctcccacctcagccttcccagtagctgggattacaggcacacaccaccacacctggctaatttttgtattttagtcttaacgtgctggtcagactggtctcgaattcctgacctcaggtgatctgcccgccttggcctcccaaagcactgggattacaggcgtgaaacaccatgcccagcccccaattttttttttttaatagagagaaggtctcactcaagcccaggctggtcttgaactcctgagctcaagctgtcatccctcctcggcctcccaaggtgctgagattacaggtgtgagtcacagtacctggccttctttcaagactttaaaaatgccatcttggctgggcacggtggctcacgcctgtaatcccagcactttgggaggccgaggtgggcagatcacgaggtcaggagatcaagaccaccctggctaacatggtgaaaccctgtctctactaaaaatacaaaaaattaaccaggtgtggtggcaggtgcctgtagtcccagctactcgggaagctgaagcaggagaatggcgtgaacccgggaggtggagcttgcagtgagctgagatcacaccactgtactccagcctgggcaacagtgcgagactccatctcaaaaaaaaaaaaaaatgtcatctcactgccttctggtccaatagtttctgatgagaaattggctgttaatcttattgaggaacatttatatattgactagtcacttgtctcttgctgttttaggagattctctatctttgggtttcagcagtttgattataatgtatcagtgtggatccctcaatttataagctacttggagttcattggacttcttggatgtgtaaattcatgtctttcattaaatttgcaaagtttcagctactattctttgcatcttgaaatactagttttgtttctttctgtctgtttgccgcttatggaactttatgcatacattgatgtgcttcatggtgtagcacaggtcccttgggctctaggcatttttctttgttctttttttctttctgctcctcattttggataaattcagctgacctgtcctcaagttcactgtttctttcttcttccttctcaaatctgctgttgaaacttctggtgaaattttcactacagttactgtactttttagctccaaagtttctatttggtttctttctgtagtaattatcactttactagtattctctatttggttagacatggttcttttgttttcctttagttcattatccatggtttcctttatttttaaatttctttttatttagttattaattttttttttttttgaagcggggtttcactcttgtcacccaggctggcaggcaatgtcacaatcttggctcactacaacctccgcctcctgggttcaagtgattctcctgcctcagcctcccaagtagctgggattataggcatgtgccaccacacccacctaatttttggtatttttagtagaaactgggtttcaccacattggccagactggtcttaaactactaacctcaggtgatctgtccgcctcagcctcccaaaatgctgggattacagatgtgagccactgtgcccagcctctttttttagtgtatttaaggtaattgattgaaagtttttgtctagtcattcaaatgtctaggcttcctcaggaacagtttctattaatttctttatttttaaaaaattttttttaattttcttttttttttagatggagtctcactctatagcctaggctggagtgcaatggcttgatcttggctcactgcaacctctgcctcctgggttcaagcgattctcctgcttcagcctcctgagtagctgggactataggtgcgtgccaccactcctggctaattttttgtattttcagtagagacatggttttgccgtgttagccaggatggtctcgatctcgtgacctcatgatcctcctgcctcggcctcccaaagtgctggaattacaggtgtgagccaccgcgcccagcctattttttattttttgagacaaagtctccctctctcacccaggctgtagtgcagtggcacaaccctggcacactgcagccttaaccgtccaggcttaagtgagtctcccaccttagtctcctgagtagctagaactacaagcatgtgccaccatgcctggctggttgtgttgttactgttttagacacagggtcttgctacatttctctgactggtcttgaactcctgggctcaagcagtcatcccaccttggcctcccaaggtgttgagattacaggtgtgagccaccgcacccggcctgttaatttctttatttccggtgaatgggccacactttcttgtttctttgcatgccttgtaattttttgttgaaacctgcacaatttgaagatgataatgtggttactttgaaaatcagatcctccgccctctgcagggttcattgttgctgtttgttgtggattgtcgtttctcgtttgtttagttactttcctgacctttttaaataaagattatattctgtcaggggtgcttgtttctgttcttttaggttagtggttagcttgtgctttgaaagagatttctttaaatatctagtggcaaaaaggataaagaggccgggcgcagtggctcacgcctgtaatgctaggactttgggaagtggaggcgggtggatcacttgaggtcaggagtttaagatcagcctggccagtatggtgaaaccctgtctctactaaaaatacaaaaattaaccgggcatggtggcacctgcctgtagtcccagctactgggaagactgaggcaggagaatcgcttcaacccagggggcggaggttgcagtgagctgagattgcgccattgcactccagcctgggcaacagagcgagactctgtctcaaataaaaaaaaaaaaaaaaaggataaagagtgtcttccatcctttccaggttgcctctgtactggggcaagtccttcagtgtccgccaggctgttcacggcttttcctcagcctttacttcttgctcccatggagcctaaggatgaaccagaggtgaaagttgagggcctcctcaggtgtttctgagcccctgtctagccccagctgtgtgcatggccttctggatttccaagcatgaacaggagctttccaaagcccttagaccttcatgtagctcttttcccagcctcttccttcctaggcttttctgtcagctctttgcccatctgttgttgtccctcccccacaacttcaggtagtatctacctgtaaatgccttcaggccaggcgcggtggctcatacctgttatcccagcactttgggaggccgaggcgggtgaattgcttgaggtcaggagttcgagaccagcctggccaacatggtgaagccccgtctctagtaaaaatacaaaaattagctgggcgtggtgggtgcctgtaatctcagctactcgggaggctgaagcaggagaattgcttgagcctgggaggcggaggttgcagtgagctgagatcgtgccattgcactccagcctgggcgacagagtgagactccatctcggggaaaaaaaaaaaaaaaaaatgccatcaacagcacgaccctggaggctgccccagccctgagagagttcgagggggtgaaacaaaggcaagcccttcagggagacactagaaagatccaaatgcataagcaggattccttgagaaaaggtctgtatcatcccttctgacaccagcaagccacatcagaaatacaggttgccttccccatggctacatgtgagctggtagtagtggctgagcagaaatagcccagctgtcctcctgaaatttagcagggtcttacttcattgagcagtcatctggttcgtagacaccagagttacagaaaagtttattgggaggttttgacagtttaatagaaaaaagtttattgtgacagttttgacagctgaatagaaaaaagtttattgtgacagttttgacagcagaatagttgctttgctggagagacggatctttggagctgccaactccatcattttggtgatatccagctctgttgctgaatttttagctatgctgttttaagttattttcttagtggttgctctagagatgacaatgtacatctttaacttaccacaatgtacttcagattattactaacttaacacttaaagtacagcatttttttttttatggagtttcactctgtcacccaggctggagtgcaatggtgtgatctcggctcactgcaacctccgcctcccaggttcacgccattctcctgcctcagcctcctgagtagctgggactacaggcacccccaccacacccggctaattttgtatttttagtagagatgaggtttcaccatgttggtcaggctggtctcgaactgctgacctcaggtgatccgcccatcttggcctcccaaagtgctgggattacaggtgtgagcgactgcactgagcctaagtatggcaacgtgtctataacatagatctacttccgttgtactatgacatagttccccctccattttcctatagcacagtcccaacctcccttttcctctgacatagttccatcctccctcctcctatgacgtcctcccttctcctctggcatagctccatcctcccttctcctatgacacagctccatcctcccttctcctctgacatagctccatcctcccttctcctatgacacagctccatcctcccttctcctctgacatagctccatcctcccttctcctgtgtcatagctccatcctcccttctcctctgacacagctccatcctcccttctcctctggcatagctccatcctcccttctcctatgacacagctccatcctcccttctcctatgacacagctccatcctcccttctcctatgacacagctccatcctcccttctcctatgacacagctccatcctcccttctcctatgacacagctccatcctcccttctcctctggcatagctccatcctcccttctcctctgacatagctccatcctcccttctcctctgacatagctccatcctcccttctcctctgacatagctccatcctcccttctcctctgacatagctccatcctcccttctcctctgacatagctccatcctcccttctcctctgacatagttccatcctcccttgtcctctgacatagctccatcctcccttctcctctgacatagctccatcccctcttctccttcatgtattattgccatatatacatttatgtatgttataacttcagctcttcagcgttataattattgcttcaaaagtattttgaaagaagttgcctggaggcagtggcttatgcctttaactccagcacttttgggggctgaggtgggcagatcgcctgagccagggagttggagaccagcctgggcaacatgacgaaacccatctccaccaaaattacaaaaaattagtctggcatggtggcacgcgcctgtagtcccagctatttgggggaggatcccagctaaggtgggaggatcacttgagcctgggaagtcaaggctgcagtgagctgagattgtgccactgcactccagcctgggtgcagatcttatctcagaagtaaagggactaggaatggtggcttttatctctaatcccagcactttgggaggctgaggtgagtggatcaccggaggtcaggagtttaagaccagcctggccaacatggtgaaaccccgtctctactaaaaatacaaaaagtagccgggtgtggtggtgggtgtctgtaatcccagctactcgggaggctgaggcaagagaatcgcttgaacctgggaagcggaggttgcagtgagcaagatcgcaccactgcattacagcctagatgacagagcgagactctgcctaaaaaaaaaaaaaaaaagaaaagaaaagaaattaagatctggacactgtggttcatgcctgtaatcccaaagccttgggaggccaaggcaggaggatcacttgaggccaggagttcaacaccagcctgggcaacatagcgagactccatctctatttaaaaaagaaagaaattcaaagagaaaaaaagtatacttgtttttttgtatcatccatattttacctttcttttttttgcccctttttctttcctgtgaatttgagttactgtctagtgtcatttccttttagtctgaagaacttcatttagaattttttttttttttttttgagacaaagtctcactgtgttgcccaggctggagtgcaatggtgcagtctcagatcactgcaacctctgcctccctggttagagtgattttcctgcctcagcctcccaagtagctgagactgcaggcacctgccaccacccccagccaatttttttggtatttttagtagagacagggtttcactatgttggccaggctggtctcgaattcatgacctcatgatctgcctgtcctggcctcccaaaatgctgggattaccatgagccaccacgcccagcccatttagaatttctttttttttttttttttgagatggggtctcgctcttgtttcccaggctggagtgcagtggcacgatctcggctcactgcgagctccgcctcccgggttcacgccattctcctgcctcagcctcccgagtagctgggattacaggcgcctgccaccacgcccacctaattttttgtatttttaggagagatggggtttcaccgtgttagccaggatggtcttgatctcctgacctcgtgatccgcccgccttggcctcccaaagtgctgggattacaggcgtgagccaccgcgcccggctagaatttcttgtaggacaggcttgctagcaaccaattcagtgtttatttgggaatgtctttatttcagcttcattttttgaaggatagtttagctggctatagaattattaattgatcattcttttcagtgtttaaaagtgtcatcatgctaccttctgggttccattgtttctgatgagaagtcatctgtcaaattgtccctttgtacttgaagaattatctttttttctcttgatgttttcaagattttctctttgtctttggcctttagtagtttgtgatgtatctaggtgtggatctcttggtgtgcatcgtatttgggcttcagtaagcctcttagattcatagattaatgttttgttttgttttaccaaatttggagagtttttactcatcatttcaacaaatttttttcctgcccctctctcatctccttttgggagtaccactgcatgtatgttggtgtgcgttctctaaagctttttttttttttttccaaccttttttctccttattcctcaaactggattatttatttatttatttatttattttttaattttttgagacggagttttgcttttgttgctgaggctggagtgcagtggcgcgatttcggctcactgcaacctccaccaccttcgaggttcaagcaattctcctgcctcagcctcctgagtagttgggactaccggagtgtgccaccaccatgcccagctaatttttgtatttatagtagagacgaggtttcaccatgttggcaaggctggtgttgaactccggacctcaggtgaaccacctgcctcagcctcccaaagtactaggattacagtcgtgagccactgcacccggccaggataatttttaatgaatttttttcttctgccatctcaaatctgccgttgagtacatctaattaattttttttttttgagtcggagtctcactgtgtcgcccaggctggagtgcaatggcgcgatcttggctcactgcaacctccacctctcaggttcaagtgattctcctgcctcaccctcccaagtagctgagatgataggcgcccgccaccacgcccagctaatttttttgtatttttagtagagacagggtttcaccatgttggccaggctggtcttaaacccctgacctcaggtgatccgcccgcctaggcctctcaaagtgctgggattacaggcatgagcccggccttgaatttttttttaataggctttttgtttgtttgtttgtttgtttttgagatggagtcttgctctgtcgcccaggctgaagtgcaatggtgcaatctcggctcactgcaacctccgcctcccaggctcaagcgattcttatgcctcagcctccccagtagctgggactgcaggcaccctccaccacacctggctaaataatttttgtagttttagtagagacaggatttcaccatgttggccaggctggtcttgaactcctgacttcaggtgatctgcccacctcggcctcccaaagtccagggattacaggcatgagccactgctcctgaccatggctttagtttttagagtagttttaggttcacaacaaaattgggtggaggatacagagatttcacatatactccagacccccacacatgcaacagcccctccccacaacaccatcatgctccctcaccagactggtacgtttattacaatccataaacctacacagacccatcattgtcacccaaggtccatagtttacattagggctaactcttggtggtgtacattctatggactttgacacatgtataatgacaggcatctactattgtggtatcagacagagaagcttcacaacctcattctctgtactttacctgttcatcctgccctccccactacattcactaaaaatgtcctttcagtgattgtcctttttaactctggaatttccatttgatttttttttttctttttttctttttttttttagacagagtctgcctctgttgcccaggctggagtgcagtggtgccatctcggctcactgcaaccctctgccttctgggttcaagcagttctcctgttttagcctcccaagtagcagggagtacaggctcatgacaccacgcctggctaatttttgtatttttagtagagacggggtttctcaatattggtcaggctggttttgaacgtttgacctcaggtgaggcacatggtgaaaccccatctctactaaaaatataaaagttagctgggcgtagtagctcacacctgtagtcccagctactccagagactgaggcctgagaattgcttgaacttgggaggtggaggtgcattgagctgagatcatgccactgcactccagcctgggtgagagagtgggactcggtctcaaaaaaaaaaaaaaaaaaaaaggattctctatttcctgaatcattgccatcatattttcatttaattatttgaacatacttatagtagctgctttgaagtctttgctaaactcaacatctgggcccactcagagtcagattatatcaactgctttttttcctaaatatggatcatggtttcctgtttacctgtcttataattttttttgttgaatactggacatttcagatgatctatgtctggattctgagttgttttcctgagtcttgtgttctgtttgttttagttaagttgtttggacttaaactgcaaaacttgcccacccacccctgcagcctctgatatctctgctcagatttttaaattcttttttttttttttttgagatggagtcttgctgtattgcctaggctggagtgccagtggtgccatctcagctcactgcaacctccacctcctgagttcaagcaattctcctgcctcagcctcccaagtagctgggattacagatgtgtgccaccatgcctggctaattttttgtttttttagtggagatgaggtttaaccgtgttagccaggatggtctcgatctcctgaccttgtgatccgcccacctcggcctctcaaagtgctcggattacaggtgtgagccaccacgcacggccttaaattctattttttagtctggcttcctagcagttgcttctgtgtttgcatatggtagtggtcagccagggatttgggcaagagggtgtgctcaaacactcctaacccaaaaggctccccaccacaccatgtggtttcagagcacgttgtgagttcagccagcccctctctctttgctttcacttcaccctggcctctcttggagctcccaacacctgcagtggtttcctcaagagccaggcccttcctgggagagctgagcccttctgtggctctcattttcagagtcttcctgttaagtatctggctggcccagtgctcactccagctgggatcacagccccaaatgatcagggctgtcagttttctttgtaagtgtttatcgagtcaccacttttaactacgaggcctgggttttcccttctgtcccacatccacctctgctgctgctggtttttgcagccagccttgacctggtaaatcactcagatttgctgactcaggagtaggagccaggggcagccccaggtgcaaaggctgtagacttcccagtattctggcccaaggcccaacatttttcaagaagaatctcttctcagtgagttctcagctttggtcagtttccagaactctgaaaagttctaaatcagtgagttttgataattttgtctagttttagattattttttctttttttctttttttttttttttgagatggagtctcacttcgtcacccaggctgaagtgcagtggtgcgatcttggctcactgcaacctctgccttttgggttcaagcgattctcctgcctcggcctcccgagtagcataattataggcgcacgccatcacaccggctcatttttaaatttttggtagaggtggggtttcaccacgttggccaggctggtctcaaactcctgacctcaagtgatccgcctacctcagcctcccaaagtgctgggattacaggcgtgagccaccgctcccggcccatattcgattcaacgacctctctacttgagtgtggctggaactcagaagcttcttttagttttagatgttgtttgttttcagggttaagtctttactaattctggaatgtatttctgtcaatgctgtgaggtaggtgattgggttgggatcttttatgtatgaaaacccagtttttaattttctcttgtgaaatccatcgtctttctccttgcaccccatctgtgatgcttcctctgccacacgaggctttctgtgtgagggggggctcttcctggaggctctcttttgctccattgatcgatttgcctgttctcttggttttcagttaacttcatggatatgccattaacttctctccatggttagaaatttaggttatttccaagtttttcatatttggttaatatctttgtggccaaatctttacatacattctccttaaaaatcatgtcactgaggcggaaggattacatgagcccaggagttcaagaccagcctggccaacatgacaagaccttggctcaacaaaaagattcaaaaattagctggcatggtggcacactcccatagtcccagccacttgggaggctgaggcaagaggattgcttgagcccaggaggtcaaggttgcagtgagctgtgatcctaccatgcacttcagcctgggcaagagagcaagactctactgcgcacacacacacacacacacacacacacaaaataatagaagcactttctgggttaaagagtttacaaatttcaaggcttttaatattgtcaaatattctagaagaggttttactaatgatggtgtgggtgtgctgaaggggcgtatttaatcgaattcactctgggtttaaccctctctttttgaacatgttctcagtctcctttcagccagtctctgctgcagtgcatttgaggcacagtcctgtagcccctggcgcccccggtcattggcagggccctgtgtgcctaagaacagtaggcactagaaggaaccgcccaaaatcctggcctggggaggtgtacgaggccacctttgtctacgcatgagacaaaatccctgttccacctcactctgctccacccacccgttcctactggaaagacagccttggctccatgtcacgggctgaaggcctgtcctcagttgctccttttttgtttttttgagacagtctcactctgtcttccaggctggagtgcagtgacacaatctctgctcactgcaacctccgcctcccgggttcaagcgattcttgtgcctcagcctcccgagtaggtgggactataggcacgcgccaccacacccggctaatttttgtatttttagtagagacgggtttctccatgttggccaagctagtctcgaactcctgacctcgtgatccacccgtctcggcctcccaaagtgctgggattacaggcgtgagccgctgcacctggcccctcagttgcttttgtggggttgaaagaacttcctttttgaaacgatggcatggcagcagtggatggcggttggtttttcatgtctttatttggcaaagttgaagattgcagttctgtctgtccccacatttcctcttcattctctctctctctctctctctctctctctctctctctctctctctctctgtgtgtgtgtgtgtgtgtgtctcggttttggttttaattttactggttcactgatgcctaaaagtcaaggcatcactatttcataagcaggttctcctagtttgggggaggactcagtcatgcacatacacacccccagcacatctgccttgatgcactggtgctgtggcctgtgcagtagtgaggctgtgggagctgctgtcagaaggctgctgccacactgtgactccagcagaggcgatgggacacacggggcatattctggagcagccaagtccatcccgagagagaatgcgggtgtctgtgtgtgtgatgtgtgtgagactgtgtgtgtgtgtgcatgtgcatacatgtgtaaagtgtacagttggcccttgtgtgtgtgagattgtgtatgtgcatacgtgtgtaaagtgtacagttggcccttggtgtgtgtgtatgtgtgcatgtgcatacgtgtgtaaagtgtacagttggtccttggtgtgtatgtgtgcatgtgcatacgtgtgtaaagtgtacaattggcccttggtgtgtgtgtgattgtgtgcatacgtgtgtaaagtgtacagttggcccttggtgtgtgtatgtgtgcatgtgcatacatgtgtaaagtgtacagttggcccttggtgtgtgtgtgattgtgcatatgtgtgtaaagtgtacagttggccctgtgtgtgattgtgtgtgcatatgtgtgtaaagtacagttggccctttgtgtgtgtgagattgtgtgtgcatacgtgtgtaaagtgtacagttggcccttggtatctgcaggttccatatccatcatttcaaccaatctcgagttgaaaataattggggaagaaaaggatggctgcgtctgtacactgtataacaactatttacatagcatttacatcgtattaggtactgcaagtaatctagggatgatttaaagtacgtgggaagatgtgcgtaggttatatgcaaacactatgtcattatatataagggacttgagcatccttggattttggtttgcacagggggtttcccatggataccaagagactacgtgtgtatgcaagtgtgagtgtgtatatgcatgtgtgtatatgcatgccatgtgtgtgcatgtatgtgtatatgcatatatgagtgagtgcacgtgacagtctacacgtgagggtgcatgtgtgtgcgcgtgtgggtgactgcatatgtgtgtgcatgtgtgggtgcgggtgcatctgtgtgtgcatgtttgggtgcgggtgcatgtgtgcgtgcacgtgtgtgtggatgagaggtcgcatgtgtgtgggtgagggcgtgtgtgtgtgcatgtgtgtgggtgagggggcatgtgtgtgcacgtgtgtgggtgaggtgtgtgtgtgcatgtgtcagggtgtgtgtgcgcgcatgtgtgtgggtgagggcctgtgtgtgcgtgtgtgtgggtgagagatgtgtgcgcatgtgtgtaggtaagggtgcttgtgtgcgcatgtgtgtgggtgagggcgtatgtgtgtgggtgagggcacgtgtgcgcgcgtgtgggtgagatggcgtgtgcgtatatccatgtatgactgcatctgtatttgcatgagttcatgtgtgagtgcatgtttatacgcgtgtcagggtctctgtgtatgtgtatgacgtgtgagtacatgtgttaatgtgtgtgtacatgtgtatatgcctgtgtgcatgtgtgtatgcatgtgtatacatgtgtacttgtgtatgtgtatatgtgtatgtctgtatatgtgtgtgtatgcctgtgtacgtatgtatatgcgtgtgtgtatgcatgtgagtgcatgtttatgcgtgtgtatgtgtacttgtgtgtgcctgtgtgagtgcatgtgtgtgtacatgtgtatatgcgcgtgtgcgtatgcgtgtatgtgtacgtgtgtatatgcatgtgtgtgtatatgcctgcatgtatatgcacaagtgtgtatatatgtgtatgtgtgagtgtatgtgtgcatgtgtatctgtatgtgcgtgtgtatatgtgcatgtgtgtatgtgtgcgtgagtgtgtgcatgtgtgtgtgtatgtgtgcgtgtgtatgtgtgtgcgtgagtgtgtgagagtgtgtatgtatacgcacgcgtgtgtgtctgtctccctcaggacagtgcccaggcggatgggtcagtgctcctgggttggtttgcccctggtggcccatgtctgagccctgccccttacggctctgtctgcaggttctcccatgggcaggtggtctctctggatgagctgcgccccttccaggacccagacctgagctccctgcaggccggctctgcgtgtctggccaagcaccaggatggcctctggcacgcagcacgcatcaccggtgaggctggccgtgggggcctcccgggaacaccctcccaggccccacgtgtgttgtcactgtgtggctgctccctgcttcctttgggttgagtgtcgggactctggctctgggcccgaaatgagcacacctaccctcagcctctgccctgccttgctcctcatgtccagggtggttcccttcagtggcacctgctgtcaaggattctgacctgcagcttgtctctgcccccagatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagaggtatggcagcagctgcggagcccaggagccaggaaggtggggtcaccctgagaggctcctggccggtgagggcaccaaccatctaaccaaactattggagagtgtgtgactgcggcgagggtgccacctgtgcctgaggaggccgtgtgggtaggggtagatccgtggcggcctttatcttcaaggagtgtgggtgcaacagctacagtctcattgatgggaggccatggtcgtggctgtggccatgggagaggaggggcctggagttgccgaggaagtcacagaaaatgaccaactgatggggcctggagtgcaggaggggcagctcctctgcatggcttctcagacttgggacctgggtgcctgggatcctggcagacagaggttgtgtccagacagccagcatggaagtttcgggaatgggaactggtgggcagtgtccagctctccagaggggtgtgtgtatgcgtgtgcgtgtgtgtgtatatatgtgggaggtcacctgacccaagcatggcgggctgagtccaggaggggtctgcatgttggaggtgtacccagggatcagtgatggtggtttctgaagccccatgtccctggtgaaggaggactgaaccaaggactctgtgagggcaggtgaggcgctcacagcctcgcgaaggtggagaagggcaggggcaggagagggctgcggaggaggggccacggtgcagcaggccgtggggactgccatgcactctgcctggtgtcacatgcccacagcagcctcggtgacgagagcacggagcccaagaggtggggtgtcgtggctctgcccaggatctgagctcattggtcaaagcccgggtcaccatgcacaatcctctggcctggctgggccactgccctctgtccatctcttgcagtggtggggtcggacgccgtggactctgcacagtcctctgccctctgtccgtctcttgcagtggtggggtcagatgctgtggactctgggacctgcagctctgcctttgctggctgggaggtgcacacgcgaggtataggctccagactcctcaccaagatgggctatgagtttggcaagggtgagtacaagctgccctggagaagtgggcaggctgctgcagcatagcccaggtccagcagccatcaggttcccggggtcccgcagccatcgggttcccagggtcccgcagccacagcactgccatccccgtgctcctcagattcccggggtcccgcggccacagcactgccatccccgtgctcctcagattcccagggtcctacggccacagcactgccatctccgtgctcctcagattcccggggtcccgtggccacagcactgccatccccgtgctcctcagattcccggggtcccgcagccacagcactgccatccccgtgcctccgcaggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggtacgtgtggggcccagctcagggcaaagggcgacccagggtggccctgcccccgggatacatgctggaggtcacctgacccaagcatagcgggctgagtccaggaggggtctgcatgttggaggacgggcagcgggcacacaggcagtgggtacggcagactggggttggtggcatggcccaggaccccacgctgactagtgagcccctccgcaggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcagacactgctgagtggagacagagctgcggggtcccatctggacacttacttgcccacctgccagtgtcttgggcatttccttggcaaggacattaaagtgatttcatcacagtgtca

SEQ ID NO: 12019 - DNA, 7109 bp, Homo sapiens
cgcgtcctgagagtcagccctcgccgctgcagcctcggcgcccggccggccggccatggagcgccccccgccccgcgccgccggccgggaccccagtgcgctgcgggccgaggcgccgtggctgcgcgcggagggtccggggccgcgcgccgcgcccgtgacggtgcccacgccgccgcaggtaccgggcgccggtgggcgggggcgccgaccaagtttctctcgctgcaaagatggcgtcagtgctgcccaaacttcgggcccccgggggcggggcagcggggagggcggccgcgtcggtccgcgcgtgtccgtgggtcccgccggggctgcgccgggcggccggggagcccttcccgccgcgccgggctgggggcggggccgggggcggggccgcgccgtccacaccggccgcagccggttttcgaggcgggcgccgagcggatccgcggcggaggttgagggacccccctcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagaggtgagcgggaggcccggtgcctcgggactcggtgtgcgcaggggcggtgggtggggtgcggagacaccggccccgacggaggccaggtcagggccccaggtttgtaattaccagccacccccaagctcttcagccctggaggagctgagcagaaatgatcgatgactgggagtccctacacctccctccaccgcagttcctcggggctagagctcagaacccggagcgggtggctgtgcgtctctgtgcagaagaggctgcgcggtcggcatggggcgactgtccaggaatccctggggctcctgaccgccacctcccaacccctgccaggccggacacctcggtctggctgccagggcaggggcgggccctggcctggctcgctggggcctggggagctgcccgtgcttccagcccagtctccccctggctgctgccggctgctggccactcccacctcccaggcctggcgtgaggcccacagctgctgttgcacaaccctggttaatgtgtgatggggggaggcctgggcctggcccgcccctctgccagggcttcagacccctgcccagccccagtatctgaaggaaccacagtggagccaagcccgcgatgtggagaactcaggcttcaggagaccctggccctgctcctggcggctccgggtggctttcagctctctctgcaacctgagctgggggaggagccaggcctcatgcccagggctgggagtggggagcctggtgtgcacgcgtgcccaggcctgcacgtggaccgaccaggggaggggcccagagctctggctgggtcacccgcaccccgcccccatctcctccagagccaccccaggaaaagcccggctggacgaggtcatggctgccgctgcccttacaagcctgtccaccagccctctccttctgggggccccggttgcagccttcagcccaggtaagactcagatgtctgcatttaggggtgtgggtggggacagggctcagaacctacagccacccagcctctgtggggcaagcagagccctcaaacctgggactcctttctaaaatggactcccgcaccctcagtgccccctactgaggccaaagcggcaggacccaggccttctggcctccctgacctgctcacctccacgcggctggccacacacgtctgccaaccctttcctgtgccgggggggtttctccccaagccctggggccagctcctccaagacgctctgcccaccagtctcaccggacttggtgaacaggggcagctcaggattagggactccctggacccacccgaagttctaaggcggggggcccgtgtccccacagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaaggtgagcttgggggcggcccccagggaggggcgggtgtggcggctgagcctgaccctggcccctgttgctgcagagcccggcccaggtcatgttccagtgtctgtggaagagctgcgggaaggtgctgagcacggcgtcggcgatgcagagacacatccgcctggtgcacctggggtgcggcggggcctggggtgcggcggggcctgcgggttggctggggttgtgaggcccggccaggccaccccttcagctcccactggctggctgtgtctcccgcaggaggcaggcagagcctgagcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccaggtgggtgaggccacgggtggcagctggggcgggtctcagggctctctggaggggagtgaagccctggctgtgtctccctgtagggctgcctgacgcccgcccgcctggagccgcagcccacggaggtcggagcctgcccacccgccttgtcctccaggatcggagtcaccctgaggtgcgtgtgggctgagggcctgcggctggcaccaggtggggagggtcctggtctcacagcaccccatgtcctgtgaccccccgcacaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggctttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttccagaagctttgtctgcctctcgggaggaaggccgtggggctgggaccctgtggtgggcaagtgggtggagtctggcagctgcccacagagggccgagggtcacccgtcggccgccgccaccccaggcgaggccggaggaaggatcatctgagacgcaggaggcatctgctggagcagcaatttcccaatttattgaaagtgatcgctttgcaaggatgtctaagctaatcccgtcacagaaaggaaacgcacaggcgcctaggcagaaacttggagactcaccgcagaggccacgtgaacccacggccacagagaggcaggacggcagagccatgatttcccaccgagcgattacgagaacctcttcccccaatagtagacacatctccaatacaaacacaggtttataataagtaataggaagtcaatataatatagattatccccagaaaaaaatcaacaatcttcaaacactgccctttttttgtgtgttttgtttttgttgacaggttgaaagcatgttgaaaaaaataaatatttaagaaaagcacacacagcaccctcactacaagtagttctaaaagggctgcatacaaaacacaatataagatctaaaaaaaaccaccaccattaagtatggctttcttaagagtcgcacatgtcacagaatgagctaaaataagattacttcttttataatattgcaaaaagttccagtttttgcattttctcagttttttaaagaggaagatgtgcaaagttggaagcagtaagctgcgtcttctgagtcagttccctacgtagccctggcagtgtcctgtgtcccaaagctcagagagccccagtgtacaacctggtcaggatccagagcttgacagaaaaatcgtggtgtccctgccccctccccgcccccaaataacaccatccccaatggactgtatttcccactttggtgttgtaaacaccaaaatacaaacagacacaaacaaaaatacaaaatgtgaaatgtaatctacacatttttcctcttcataaaaaaatatttattagtttgaacatcgatttaaaaaaaaatcagtcacataaaaaaaacccttcatgacatgtcttttccctccacgcctcctgagatggacgtgctcacctgggcctcggaaatcccacactcttcagtcggcaaactgcgaacaagaacaggaaatctgccacgcagcaaacacttggggaggtcagtgggacactgttggttttagggaagaaaatgcccctgtagctccggcggggaaccccaaaacggtcagcaaaggcaggccacacggagtgagccggccagatggagcaggacatcctgagtgtggagggggaggcgggcctgggtcctgggcagggtggcctgagagcagggactggtacaaaacccagagacattggtgggtagcaaaggtctggtttccaaatgcattttgtaagaaagtcagtctgtttagaaaaagggtttaaaaatcaggggaaaggtacaaagttctgagaattctcaaagaggccggggtggggctggcctggggtgagggctggagggctccgctgcagctccctggtagccatgctctccccctgggggactcgtgccagagccacccaccttgctcggtaagagtgggcagggctcaccgctgaggggccagcgcttggcccggctcctatccccacactccgtgtgcagaaaaatcttggcctctttctccagctttgaggagcccacagcctccgagctgaggggtgtgtgtgatgacagctccagccagggcaccctgtcattggtagaaccgggggccaatgtcaaaaaacaaaagccgtgactcctgcgctgtacctggagtcctccatgtactcctccacaggacccccggccagccccagccctccccgagcagcagcggtcagggaagctggtgctctacctgacaatgtggggaaaagcctggtatacaggctagaaaaagagagtaaaaactctttccacgcagccctgaagctcagcactccggggggtcttcacacgggcaggtcctggagggaaggaggaggccaccgcgcccacctcccatctgaaggcacagcaccgcagtggtggcctgtgccagaggagggggtgaaggatggaatgtcctcatggtgagtgctgtcagaggcaggcctgaacgagaagacaggccgtggcaacggtcccgaggctgtgagtctaggcagcctgcctccgggacccccaaagccaggcggtgcaccacagcacacaccgtgggacctttgcttttcactcaggaaaagaaagaacatgtgagtgcttctgaaaacacagcaagaggacttgagcacaagctaaaggaaaaacaaccctatatagtttcttcgagtgagaaaaataatgccaaacaaaataattttatgtaactacctcgatatgtctctgactacttaaaaatttggttacccacgcggggaggtgtaagcagcacactgcagttaggaacaccgcctccagtgttagcagcaaaggcaggagcccagctccagcccgtccaggaggggtcagcaggagcggccgggctgggccatgggcagaacaggacgggcagagcccggggtggacgtggcagcccaaggctctccgaggaagtgcacacgactgagccgaggcccttgcagagggaacctggtgtggcctgaagtggtggggggcacagggctgagggtcccctcctggaaggagcccccagggctgtgtccacctaagatagcacctggagccctcggcctccagcagggtctgcagctgtgttgtgtgttaagcaccaaagcccagaggtaagacggtggcagggctctctgtgcacctggattctacaggctgccatgggccacggctgcaccacgggccacggctgcagccacaggcagtgacctggctgctaggggaggggagggcgggctccagccgggctgaccgggtgtctgtaaaactctgcacctgctcaggccaggggcctctgggccgaacacaccaccccgcccagtgcccactggacccggccacaggcccatcacgtgtccaagccaggctggccatcacaggggccactcacacacccgcaccacctgctggggacttaggaccgtgctctcccttcactcaaacccaccctgtgccctcccccaactcacttcatgtctggtcccagagcacccctcttgctggggtcgcacctgcttagcccgcagggctggtttccgtggggggtgggttcagggggaagcagaggaggggccgcgagaggggtgagcgtggccctggccccgcagtggagacccaccggacacacacacgggtggacggagcgaggcagccaccgaccctgccggcgggcgggcctaggagagccaggcgaagtccttgtcagggcctcct

SEQ ID NO: 12020 - DNA, 2538 bp, Homo sapiens
acacagtcaagtttgactcgctgctgctgagggaggccgtggtggagggggacggcatcctgcccccactgcgcacagaggccacagagtccgactcagacagcgacggtacgggtgactccagctatgccagaggtatggcagcagctgcggagcccaggagccaggaaggtggggtcaccctgagaggctcctggccggtgagggcaccaaccatctaaccaaactattggagagtgtgtgactgcggcgagggtgccacctgtgcctgaggaggccgtgtgggtaggggtagatccgtggcggcctttatcttcaaggagtgtgggtgcaacagctacagtctcattgatgggaggccatggtcgtggctgtggccatgggagaggaggggcctggagttgccgaggaagtcacagaaaatgaccaactgatggggcctggagtgcaggaggggcagctcctctgcatggcttctcagacttgggacctgggtgcctgggatcctggcagacagaggttgtgtccagacagccagcatggaagtttcgggaatgggaactggtgggcagtgtccagctctccagaggggtgtgtgtatgcgtgtgcgtgtgtgtgtatatatgtgggaggtcacctgacccaagcatggcgggctgagtccaggaggggtctgcatgttggaggtgtacccagggatcagtgatggtggtttctgaagccccatgtccctggtgaaggaggactgaaccaaggactctgtgagggcaggtgaggcgctcacagcctcgcgaaggtggagaagggcaggggcaggagagggctgcggaggaggggccacggtgcagcaggccgtggggactgccatgcactctgcctggtgtcacatgcccacagcagcctcggtgacgagagcacggagcccaagaggtggggtgtcgtggctctgcccaggatctgagctcattggtcaaagcccgggtcaccatgcacaatcctctggcctggctgggccactgccctctgtccatctcttgcagtggtggggtcggacgccgtggactctgcacagtcctctgccctctgtccgtctcttgcagtggtggggtcagatgctgtggactctgggacctgcagctctgcctttgctggctgggaggtgcacacgcgaggtataggctccagactcctcaccaagatgggctatgagtttggcaagggtgagtacaagctgccctggagaagtgggcaggctgctgcagcatagcccaggtccagcagccatcaggttcccggggtcccgcagccatcgggttcccagggtcccgcagccacagcactgccatccccgtgctcctcagattcccggggtcccgcggccacagcactgccatccccgtgctcctcagattcccagggtcctacggccacagcactgccatctccgtgctcctcagattcccggggtcccgtggccacagcactgccatccccgtgctcctcagattcccggggtcccgcagccacagcactgccatccccgtgcctccgcaggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggtacgtgtggggcccagctcagggcaaagggcgacccagggtggccctgcccccgggatacatgctggaggtcacctgacccaagcatagcgggctgagtccaggaggggtctgcatgttggaggacgggcagcgggcacacaggcagtgggtacggcagactggggttggtggcatggcccaggaccccacgctgactagtgagcccctccgcaggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcagacactgctgagtggagacagagctgcggggtcccatctggacacttacttgcccacctgccagtgtcttgggcatttccttggcaaggacattaaagtgatttcatcacagtgtca

SEQ ID NO: 12021 - DNA, 6643 bp, Homo sapiens
cccccttcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagaggtgagcgggaggcccggtgcctcgggactcggtgtgcgcaggggcggtgggtggggtgcggagacaccggccccgacggaggccaggtcagggccccaggtttgtaattaccagccacccccaagctcttcagccctggaggagctgagcagaaatgatcgatgactgggagtccctacacctccctccaccgcagttcctcggggctagagctcagaacccggagcgggtggctgtgcgtctctgtgcagaagaggctgcgcggtcggcatggggcgactgtccaggaatccctggggctcctgaccgccacctcccaacccctgccaggccggacacctcggtctggctgccagggcaggggcgggccctggcctggctcgctggggcctggggagctgcccgtgcttccagcccagtctccccctggctgctgccggctgctggccactcccacctcccaggcctggcgtgaggcccacagctgctgttgcacaaccctggttaatgtgtgatggggggaggcctgggcctggcccgcccctctgccagggcttcagacccctgcccagccccagtatctgaaggaaccacagtggagccaagcccgcgatgtggagaactcaggcttcaggagaccctggccctgctcctggcggctccgggtggctttcagctctctctgcaacctgagctgggggaggagccaggcctcatgcccagggctgggagtggggagcctggtgtgcacgcgtgcccaggcctgcacgtggaccgaccaggggaggggcccagagctctggctgggtcacccgcaccccgcccccatctcctccagagccaccccaggaaaagcccggctggacgaggtcatggctgccgctgcccttacaagcctgtccaccagccctctccttctgggggccccggttgcagccttcagcccaggtaagactcagatgtctgcatttaggggtgtgggtggggacagggctcagaacctacagccacccagcctctgtggggcaagcagagccctcaaacctgggactcctttctaaaatggactcccgcaccctcagtgccccctactgaggccaaagcggcaggacccaggccttctggcctccctgacctgctcacctccacgcggctggccacacacgtctgccaaccctttcctgtgccgggggggtttctccccaagccctggggccagctcctccaagacgctctgcccaccagtctcaccggacttggtgaacaggggcagctcaggattagggactccctggacccacccgaagttctaaggcggggggcccgtgtccccacagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaaggtgagcttgggggcggcccccagggaggggcgggtgtggcggctgagcctgaccctggcccctgttgctgcagagcccggcccaggtcatgttccagtgtctgtggaagagctgcgggaaggtgctgagcacggcgtcggcgatgcagagacacatccgcctggtgcacctggggtgcggcggggcctggggtgcggcggggcctgcgggttggctggggttgtgaggcccggccaggccaccccttcagctcccactggctggctgtgtctcccgcaggaggcaggcagagcctgagcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccaggtgggtgaggccacgggtggcagctggggcgggtctcagggctctctggaggggagtgaagccctggctgtgtctccctgtagggctgcctgacgcccgcccgcctggagccgcagcccacggaggtcggagcctgcccacccgccttgtcctccaggatcggagtcaccctgaggtgcgtgtgggctgagggcctgcggctggcaccaggtggggagggtcctggtctcacagcaccccatgtcctgtgaccccccgcacaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggctttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttccagaagctttgtctgcctctcgggaggaaggccgtggggctgggaccctgtggtgggcaagtgggtggagtctggcagctgcccacagagggccgagggtcacccgtcggccgccgccaccccaggcgaggccggaggaaggatcatctgagacgcaggaggcatctgctggagcagcaatttcccaatttattgaaagtgatcgctttgcaaggatgtctaagctaatcccgtcacagaaaggaaacgcacaggcgcctaggcagaaacttggagactcaccgcagaggccacgtgaacccacggccacagagaggcaggacggcagagccatgatttcccaccgagcgattacgagaacctcttcccccaatagtagacacatctccaatacaaacacaggtttataataagtaataggaagtcaatataatatagattatccccagaaaaaaatcaacaatcttcaaacactgccctttttttgtgtgttttgtttttgttgacaggttgaaagcatgttgaaaaaaataaatatttaagaaaagcacacacagcaccctcactacaagtagttctaaaagggctgcatacaaaacacaatataagatctaaaaaaaaccaccaccattaagtatggctttcttaagagtcgcacatgtcacagaatgagctaaaataagattacttcttttataatattgcaaaaagttccagtttttgcattttctcagttttttaaagaggaagatgtgcaaagttggaagcagtaagctgcgtcttctgagtcagttccctacgtagccctggcagtgtcctgtgtcccaaagctcagagagccccagtgtacaacctggtcaggatccagagcttgacagaaaaatcgtggtgtccctgccccctccccgcccccaaataacaccatccccaatggactgtatttcccactttggtgttgtaaacaccaaaatacaaacagacacaaacaaaaatacaaaatgtgaaatgtaatctacacatttttcctcttcataaaaaaatatttattagtttgaacatcgatttaaaaaaaaatcagtcacataaaaaaaacccttcatgacatgtcttttccctccacgcctcctgagatggacgtgctcacctgggcctcggaaatcccacactcttcagtcggcaaactgcgaacaagaacaggaaatctgccacgcagcaaacacttggggaggtcagtgggacactgttggttttagggaagaaaatgcccctgtagctccggcggggaaccccaaaacggtcagcaaaggcaggccacacggagtgagccggccagatggagcaggacatcctgagtgtggagggggaggcgggcctgggtcctgggcagggtggcctgagagcagggactggtacaaaacccagagacattggtgggtagcaaaggtctggtttccaaatgcattttgtaagaaagtcagtctgtttagaaaaagggtttaaaaatcaggggaaaggtacaaagttctgagaattctcaaagaggccggggtggggctggcctggggtgagggctggagggctccgctgcagctccctggtagccatgctctccccctgggggactcgtgccagagccacccaccttgctcggtaagagtgggcagggctcaccgctgaggggccagcgcttggcccggctcctatccccacactccgtgtgcagaaaaatcttggcctctttctccagctttgaggagcccacagcctccgagctgaggggtgtgtgtgatgacagctccagccagggcaccctgtcattggtagaaccgggggccaatgtcaaaaaacaaaagccgtgactcctgcgctgtacctggagtcctccatgtactcctccacaggacccccggccagccccagccctccccgagcagcagcggtcagggaagctggtgctctacctgacaatgtggggaaaagcctggtatacaggctagaaaaagagagtaaaaactctttccacgcagccctgaagctcagcactccggggggtcttcacacgggcaggtcctggagggaaggaggaggccaccgcgcccacctcccatctgaaggcacagcaccgcagtggtggcctgtgccagaggagggggtgaaggatggaatgtcctcatggtgagtgctgtcagaggcaggcctgaacgagaagacaggccgtggcaacggtcccgaggctgtgagtctaggcagcctgcctccgggacccccaaagccaggcggtgcaccacagcacacaccgtgggacctttgcttttcactcaggaaaagaaagaacatgtgagtgcttctgaaaacacagcaagaggacttgagcacaagctaaaggaaaaacaaccctatatagtttcttcgagtgagaaaaataatgccaaacaaaataattttatgtaactacctcgatatgtctctgactacttaaaaatttggttacccacgcggggaggtgtaagcagcacactgcagttaggaacaccgcctccagtgttagcagcaaaggcaggagcccagctccagcccgtccaggaggggtcagcaggagcggccgggctgggccatgggcagaacaggacgggcagagcccggggtggacgtggcagcccaaggctctccgaggaagtgcacacgactgagccgaggcccttgcagagggaacctggtgtggcctgaagtggtggggggcacagggctgagggtcccctcctggaaggagcccccagggctgtgtccacctaagatagcacctggagccctcggcctccagcagggtctgcagctgtgttgtgtgttaagcaccaaagcccagaggtaagacggtggcagggctctctgtgcacctggattctacaggctgccatgggccacggctgcaccacgggccacggctgcagccacaggcagtgacctggctgctaggggaggggagggcgggctccagccgggctgaccgggtgtctgtaaaactctgcacctgctcaggccaggggcctctgggccgaacacaccaccccgcccagtgcccactggacccggccacaggcccatcacgtgtccaagccaggctggccatcacaggggccactcacacacccgcaccacctgctggggacttaggaccgtgctctcccttcactcaaacccaccctgtgccctcccccaactcacttcatgtctggtcccagagcacccctcttgctggggtcgcacctgcttagcccgcagggctggtttccgtggggggtgggttcagggggaagcagaggaggggccgcgagaggggtgagcgtggccctggccccgcagtggagacccaccggacacacacacgggtggacggagcgaggcagccaccgaccctgccggcgggcgggcctaggagagccaggcgaagtccttgtcagggcctcct

SEQ ID NO: 12022 - DNA, 28120 bp, Homo sapiens
gcggcgctcgggaggaagtgccgatcggctgctggggcgaaaagggggcgccgggccgctctagccggtgaggccggcgggctctctgtggctgcggctgggaaaccgcgcggaggaggtgcccggccggggaccaggtggccgcggtttgcggggacgcggccctggccagacagaagagacgccgggcgggggggcgcggccggcctggaaggcggcgggcgcggcgggtgggctcggcggagggtgaggcggcggggcgccccgcggggaaggggctccggagtgacgcgggacccggctagcggcgagcccacggcggctcggaagggaagcgcggagcctgagcgggggtacccgggctgcgacctctgcgctgggagctgtgcctctgagccggtgtctccccgagggaaaggggacgtgcccgtgcccgtgcccgccctcaggctgtggggtcggtcccgagacgcggggctcagctggcttctcttcttgcagccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcaggttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggtaaagccctttgttgtcagatgccaaccttaggggcgtaaggggcacgcacacagggtcgggtcaggatcggccctccctttgctttgcagttttgtctcagcttcctggggcaggcgtgctttgacagctgtgtctgtgttcaggcgtctacgtcttccttctggggtgaatcaagaagcatggaaggaggccaggcgcggtggctcacgcctgtaatcccagcactttaggaagccgaggcgggcagatcacctgaggtcaggagttcaagaccacgctggtcaacatggtgaaaccccatctccttaaaaacacaaaaatgaaccggtcgtggtggcgcgcacctgtggtcctggctactcaggaggctgaggcaggagaattggttgaacccaggaggccgagtttgcagtgagtggagatgcagccactgtactgcagcccgagcagcagtgcaaggcttatgtggaagagagtaggtctccagcctatcgtcagtttttttttggtggttgttttaattttttttgagacagggtcttactttgtcaaccaggctggagtgcagtggcatagtcctggctcactgcagcctggacctcctgggctcaaccgatcctcctgcctcagcccccctaggagctgggctacagactcacgctactacacccagctaatttttatattactataattttttatcttttttttgagatggagtcttgttctgttgcccaggctggagtgcagtggcgtgatctcggctcactgcaagctccgcctcccgggttcacgccattctcctgcctcagcctcccgagtagctgggactacaggcgcccgccaccatgtctggctaattttctgtatttttagtagagacggggtttcaccatgttagccaggatggtctcaatctcctgacctcgtgatccgcccaccttggcctcccaaagtgctgggatgacaagcgtgagccaccgcgcctggccttttttttttggagacagagtttcactctcctcacccaggctggagtgtagtggcgcaatctcagcttaccgcaacctctgtctcccgggttgaagtaattctctacctcagcgtccagagtagctggcattacaggcgcccgccaccacactgggctaattttttgtatttttagtagagtcggagattcaccatcttggccaggctggtcttgaactcctgacctcgtgatccacccaccttggcctcccaaagtgctgggatcacaggcgtgagccactgcgcctggccctgttgttagttttattctctagagttcaacttttaaattttactttcatggagattttcaaacataccccaaattagagagtttagcataatcaccgcccacggtccatcatccaatgtcgtcatttattaatattttcccagtctcattttgtctgttctccctgccctatttttttctttcctgggccattttaaagcaaattccagaagttactggttttttccaattatgaatacttcatagttgcatctctaatctaactgattaggaaattacttaaaaagtaactttttggaagtccaagtccgatgtgaggacaaaaaagagtaacttctgtgtcataataggtaacacatttaatggtaatacctcttccatattcaaatatgaacaattattactgtaatgtctctatttccctaagcgcatagctttatttttcctcctttttacttttctcttagaagaaatatttaccaagccttctagtaggtaattttcttttttagccaatagttcaggctgaccgtgtaaccatccctagttctagttctagttctttgaatgtcttccttttttttttttttttgaaacagcgtcttgctgctctgtcacccaggctggagtgcagtggcacaatctcggctcactgcaatctccgcctccctggcccaagccatcctcccacctcagcctccctaatagctgatactacaagtgtgcactgccacgcccagctaatttttgtattttttgtagagacgggatttcaccatattacccaggtctcgaattcctgatccctttgatgagagatctgacacatccctgtggtgctccctctgggccaggcactgctccaagggtttcatatactttcattcatctgtgcaacagccctgtaggtaggccctgcagtcacaccatctgacagaggaggaaacaggagtagaagaactgagtggtccagggcttcaaggctcagagggctccggttgcccccagccctcgttccgtcccctgctccacccagtgctgcttgccatgtcggcatcaggcctgatctgaaagcttccggagcatcttacagacgtccaccttgccaccattcaggactgataagttctcttggatttgcgttggaccttttttttttttttaagatggagtttcactgttgttgcccaggctagagtacaatggcatgacctccacctcctgggttcaagggattctcctgcctcagcctcccaagtagctgggattacaggcgcctgtcaccacgtggtgcccagctaatttttatatttttagtagaggcagggtttcaccatgttggccaggctggtctcgaactcttgacctcaggtgatcccgccttggtttcccaaagtgctgggattacaggcatgagccaccacacccggcccaggatttctttatatattctggatatcatcccttatgaagtatatagtttgcagatatttgctcccattgtttgggttgtcttttcacttgatatagtgtcctttgatgcacaaacattttaaattttgatgcagtgcaatttattgtttctttattgcctatgtttttgtcatcaggtttaagaaaccacctcatccatagttatgaggattttcacctatgttttcttctaagagttctgtagttttagctgttaaatttaggtctttgatccattttgagttaatttttgtatatgttattaggtgagggtccactttattcttttgcatgtggatttccagttttcccagcaccatttgtttaaaagactgctttttctccactgaatggtcttggcacttttgtccaaaatcaattggcaatatatgtaagggtttatttctgagctctctctcctgttccattggtgtatatgtgccagtaccacactgttctgattattatagctttgtgataagttttaaactcaggaagtggtagttattcaccatttgctcctctttttcaagtttgttttgtttctggatcctttgcaatttcatatgaattttaggatcggcttgtccaattctgcataaaagacagtttgaattttgatatggattgcatagaatgtgtagatctgtttggggcacattgtcatctttacaatattaagccttctggctgggtgtggtggctgacgcctgtaatcccagtactttgggaggctgaggcgggcatatcacttgaggtcaggagttcaagaccagcctggccaacgtggtgaaaccccgtctctactaaaaataaaaaacaaattagtcggaggtggtgcacacctgtaatcccagctacacgagagggtgaggcaggagaatcgcttgaacctgggaggaggaggttgcagtgagctgagatcatgccactgcactccagcctgggtaacagagggagactccatcttaaacaacaacaataacagaagaaaaaaacagtattaagtcttccaattcatgaatgaaggatctgtccatttatttacgtctttaatttctttcaacagtattttgtactgttcaagtcttgcacattcttggttaaataagtattatttttgatgcttctctaaggaattgtttttcttttccttttttttttgagacagagtcttgctctgtcacccaggctggagtgcaatggcacaatcttggctcactgcaacctctgcctcccgggttcaagcaattcttctgctcagcctcccaagtagctgggatcacaggtgcctgccaccacacccagctaatttttttttttgagatggagtcttgctctgttgcccaggctggagtgaagtggcccaatcttggctcactgcaagctccacctcccgggttcacaccattcttccgcctcagcctcctgagtcgctgggaatacaggtgcctgccaccacgcccagctaattttttgtatttttagtagagatggggtttcaccatgtagccaggatggtctcgaactcttgacctcaggtgatctgcctgcctcggcctcccaaagtgctgggattacagatgtgagccactgtgcccggctggagttgttttccttagttacattttcaggctgtttgttgctagtatatagaaatacaagctgggcaccgtggctcacgcctgtaatcccagcactttgggaggccaaggcgggtggatcacctgtggtcaggagttcgagaccagcctggccaacatggtgaaatccagcctctattaaaaatacaaaaattagtctggcatggtggcaggtgcctgtaatcccatctactcaggaggctgaggcaagagaattgcttgaacctgggaggcggaggttgcagtgagctgagatcgcgccattgcactccagcttggggaacaagagtgagacttcatctcaaaaaaaaaaaaaaagaaatacagtggatttttttatgttaatcctgtattgattgctgaattggtttattagtgctaataggattttttatgcactatttaggattttcgatatatacaatcatatatattcaatatatacaattaatatatatgtgaatagagataattgtagtctttgtttctagtttgcatggcatttatttctttttcttgcttaactgccttagctagaacttcaagtacaatgttgaataaaagtgactagagcgggccgggggtggtggctcacacctgtgttcccagcactttgggaggtggaagtgggcagatcacttgagatcagcagtttgagaccagcctggccaacacggcgaaaccccatctctactaaaaatacaaaaattagctgggtgaggtgatgtgcacctgtagtcccagctacttgagagggtgagacatgagaattgcttgaacctggggggcggaggttgcagtgagccaagatcatgccactccactccagcctggacgacagagcaagaaccctgtctttaaaaaaaaaaaaaaaaaaagtggctagaacaaacatctttatcttgttcctgatcttaggtggaaaacttttttgttcctgatattaggtggaaaacttttagtctttcactgttgaatatgatgttacttgtaggttttctgtagattccctttatcgagttgaggaaattctcttatattcatagtgtgttgagtgttttttatcatgaaagggtgttgattttttttttaaagatagggtcttgttctgtcacccaggctggagggcagtggcatgatcatggctcactgcaacctcgaattcctgggctcaggggatcctcctacttcatcctcctgagtaggtgagactacaggcatgagccaccatgcccagctaattttttaatttttctgtagaggtagggtcctgctttgctgcccaggctggtcttaaactccagggctcaagcaatcctgcctcagcctcccaaagtgctgagattacaggggtgagtcactgcactgcacccagctgtgtgggatttttcaaatgcttttttcctttagatgatcatgtgtggtttttttcctttcattttgttaatgtggtatattgattttcgtatgttgaaccatccttgaattcctcagataaagcacgcatattcatggcgtattatctctttattattattatttttgtagagatgagatttcactctgttgcccaagctggtctcaaactcctgggctaaagtgatcctcctgcctcagcctccgaaagcgctgggattataggcatgagccacttggccctatcttttttctttttcttttttttttttttttgagacagagtctcactctgtcgccgggctggagtgagtggcgcgatctcggctcactgcaacctccatctcccgggttcaagcaattctcctgcctcagcctcctgagtagctgggactacaggtgcccgccactatgcccagctaattttttgtgtttttagttgagacggtgttttgccatgttggacaggctggtcttgcactcctgacctcgtgattcacccaccttggcctcccgaagtgctgggattacaggcgtgagccaccgcagcgagccttatctttttaacagttaaaagtttaaggccttatcatgtaataacattgctggatttgatttgctgctgttttgttgagaatatttgcatctgtattgataagggatattggtctgtagttttcttttcttggcatgtctttgtatagctttgatgccagcataatattggcctcatagaatgagttaggaagtattctttatattatgggaagaggtaaaaagggattggtgttaattcttcttcaaatgtttgatagaattcaacagtgaagtgatatatacaatcatatatagagagagagagagagagagagagatggacttttcttttgttggaagtttattgactattgattcaatttccttattgaaattgacttttctttttggaagctaaaacgtataactgtagtgaaagtttctgaacttttctttcattggaagttttttgactactgattctttatttgttataggtctattcagattttctgtttcttcttgagtcagtttggtctcgctctgtcgcccaggctggagtgcagtggtgccatcttggctcactgcaacttctacctcccgagttcaagtgattctcccacctcagcctccccagtatctcggactacaggcgcacgccagcatacctggctaatttttgtatttttagtaggaacagcatttcaccatgttggccaggctggtctcgaactcctgacctcaggtgatccacccgcctcggcctcacaaagtgctgggactacagacataagccaccgcgtccagccttgagtcagtttagatagtttgcatgcatgtttctaggaatttgtccattttgtttatgttatctaatctgttaccatacaattgttcatagtatccttttatagccctagttatttctgtaagatcagtagtaatagctccactttctctcttggttttagcaatttgagtcatctcttttcttcttctttttttttttttgagatggagtctcactgtgtcacccaggctggagtgcagtggcatgatcttggctcactgcaacccctgcctcccaggttcaagcaattctgccttagcctcctgagtagctgggattacaggtgtgagccaccacacccagctagttttgttttgtttttttgtttttgagacggagtctgtttctgtctcccaggctggagtgcagtggtgcaatctcactcattgcaacctccgactcccagattccagcaattctcctgcctcagcctcctgagtagctggaactataggcgtgcaccaccacgcctggctgatttttatatttttagtagagatgggatttcaccatgttggccaggctggtcttggactccctacctgaggtgatccgcccaccttggcctcccaaagtgctgggattataggcatgagccaccatgcccagccagtttttgtatttttagtagagatggggtttctccctgtcggccaggctggtcttgaaatcctgacctcaggttatccaccagccttggcctcccaaagtgctaggattacaggcatgagccaccacgcatggcctgtcttttcttcttggtcattttcgctaaaggtttgtcaattttgttgatcttttttgttgctgatctctattgttttcccattctgtttcatttatttccattttaacctttgtttccttttttctgctggtttgggtttaatttgctctttttttcccctaatttttcaaggtatacagttaagttattgatttgagatctcttttttcttttctttttttttttttttttttttttttggttgctgttgagatggagtctccctctgtcacccagactggagtgcagtggcatgatctcagctcactgcagcctccgccgcccaggcgattctcctgcctcagcctcctgagtagacgtttcccggccaaggtgtttctttttgaatgtaagcatttacagctacagatttccctctaaacactgctttcactgcattccataagattgttttttgttgttgttttgttgtttgagacacagtctcactctgttgccgtttggagagcagcgatgcgatcatagctctgtagccttgagctcctggactcaatcagtcctcctgcctcagcctcccaagtagctgggactacaggtgtacaccactgcacctaactaatttcttttataagtttttgcagaggccaggcacagtggctcacacctgtaatcccagcactttgggaggccaaggtgggtggatcacctaaggtcaggagttcgagaccagcctggccgacagggagaaaccccatctctactaaaaatacaaaaattagctgggcgtggtggcaggtgcctgtaatcccagctactcaggaggctgaggcaggagaatcgcttgaacctgggaggcagaggttgcagtgagccaggatcacaccattgcactccagcctgggtaacaaaagcaaaactccatctcaagaaaagaaaaaaaaaagtttttgcagagacagggtatcactttgttgcccaggctggtctcaaactcctgacttgaaggagtcctactgcctcggcctcccaaagtgctgagattatgggcaagagccaccgcaccctgccacttggctgttttgttctgttgtatttccattttcattgatctcaagacatcctaatctcccttttgtttttttgttcgacttactcgttattcaagagtgtctttatttctgcatatttgtaaattttccaaaaaagtttttctttctttcttttttttttgagaaagggtcttgctctgtcgcccaggctggagaatggtggtgcacaatcttgcctcactgcaacctctgcctcccgggttcaagtgatcctcccacctcagccttcccagtagctgggattacaggcacacaccaccacacctggctaatttttgtattttagtcttaaacgtgctggtcagactggtctcgaattcctgacctcaggtgatctgcccgccttggcctcccaaagcactgggattacaggcgtgaaacaccatgcccagcccccaattttttttttttaatagagagaaggtctcactcaagcccaggctggtcttgaactcctgagctcaagctgtcatccctcctcggcctcccaaggtgctgagattacaggtgtgagtcacagtacctggccttctttcaagactttaaaaatgccatcttggctgggcacggtggctcacgcctgtaatcccagcactttgggaggccgaggtgggcagatcacgaggtcaggagatcaagaccaccctggctaacatggtgaaaccctgtctctactaaaaatacaaaaaattaaccaggtgtggtggcaggtgcctgtagtcccagctactcgggaagctgaagcaggagaatggcgtgaacccgggaggtggagcttgcagtgagctgagatcacaccactgtactccagcctgggcaacagtgcgagactccatctcaaaaaaaaaaaaaaatgtcatctcactgccttctggtccaatagtttctgatgagaaattggctgttaatcttattgaggaacatttatatattgactagtcacttgtctcttgctgttttaggagattctctatctttgggtttcagcagtttgattataatgtatcagtgtggatccctcaatttataagctacttggagttcattggacttcttggatgtgtaaattcatgtctttcattaaatttgcaaagtttcagctactattctttgcatcttgaaatactagttttgtttctttctgtctgtttgccgcttatggaactttatgcatacattgatgtgcttcatggtgtagcacaggtcccttgggctctaggcatttttctttgttctttttttctttctgctcctcattttggataaattcagctgacctgtcctcaagttcactgtttctttcttcttccttctcaaatctgctgttgaaacttctggtgaaattttcactacagttactgtactttttagctccaaagtttctatttggtttctttctgtagtaattatcactttactagtattctctatttggttagacatggttcttttgttttcctttagttcattatccatggtttcctttatttttaaatttctttttatttagttattaattttttttttttttgaagcggggtttcactcttgtcacccaggctggcaggcaatgtcacaatcttggctcactacaacctccgcctcctgggttcaagtgattctcctgcctcagcctcccaagtagctgggattataggcatgtgccaccacacccacctaatttttggtatttttagtagaaactgggtttcaccacattggccagactggtcttaaactactaacctcaggtgatctgtccgcctcagcctcccaaaatgctgggattacagatgtgagccactgtgcccagcctctttttttagtgtatttaaggtaattgattgaaagtttttgtctagtcattcaaatgtctaggcttcctcaggaacagtttctattaatttctttatttttaaaaaattttttttaattttcttttttttttagatggagtctcactctatagcctaggctggagtgcaatggcttgatcttggctcactgcaacctctgcctcctgggttcaagcgattctcctgcttcagcctcctgagtagctgggactataggtgcgtgccaccactcctggctaattttttgtattttcagtagagacatggttttgccgtgttagccaggatggtctcgatctcgtgacctcatgatcctcctgcctcggcctcccaaagtgctggaattacaggtgtgagccaccgcgcccagcctattttttattttttgagacaaagtctccctctctcacccaggctgtagtgcagtggcacaaccctggcacactgcagccttaaccgtccaggcttaagtgagtctcccaccttagtctcctgagtagctagaactacaagcatgtgccaccatgcctggctggttgtgttgttactgttttagacacagggtcttgctacatttctctgactggtcttgaactcctgggctcaagcagtcatcccaccttggcctcccaaggtgttgagattacaggtgtgagccaccgcacccggcctgttaatttctttatttccggtgaatgggccacactttcttgtttctttgcatgccttgtaattttttgttgaaacctgcacaatttgaagatgataatgtggttactttgaaaatcagatcctccgccctctgcagggttcattgttgctgtttgttgtggattgtcgtttctcgtttgtttagttactttcctgacctttttaaataaagactatattctgtcaggggtgcttgtttctgttcttttaggttagtggttagcttgtgctttgaaagagatttctttaaatatctagtggcaaaaaggataaagaggccgggcgcagtggctcacgcctgtaatgctaggactttgggaagtggaggcgggtggatcacttgaggtcaggagtttaagatcagcctggccagtatggtgaaaccctgtctctactaaaaatacaaaaattaaccgggcatggtggcacctgcctgtagtcccagctactgggaagactgaggcaggagaatcgcttcaatccagggggcggaggttgcagtgagctgagattgcgccattgcactccagcctgggcaacagagcgagactctgtctcaaataaaaaaaaaaaaaaaaaggataaagagtgtcttccatcctttccaggttgcctctgtactggggcaagtccttcagtgtccgccaggctgttcacggcttttcctcagcctttacttctcgctcccatggagcctaaggatgaaccagaggtgaaagttgagggcctcctcaggtgtttctgagcccctgtctagccccagctgtgtgcatggccttctggatttccaagcatgaacaggagctttccaaagcccttagaccttcatgtagctcttttcccagcctcttccttcctaggcttttctgtcagctctttgcccatctgttgttgtccctcccccacaacttcaggtagtatctacctgtaaatgccttcaggccaggcgcggtggctcatacctgttatcccagcactttgggaggccgaggcgggtgaattgcttgaggtcaggagttcgagaccagcctggccaacatggtgaagccccgtctctagtaaaaatacaaaaattagctgggcgtggtgggtgcctgtaatctcagctactcgggaggctgaagcaggagaattgcttgagcctgggaggcggaggttgcagtgagctgagatcgtgccattgcactccagcctgggcgacagagtgagactccatctcggggaaaaaaaaaaaaaaaaaatgccatcaacagcacgaccctggaggctgccccagccctgagagagttcgagggggtgaaacaaaggcaagcccttcagggagacactagaaagatccaaatgcataagcaggattccttgagaaaaggtctgtatcatcccttctgacaccagcaagccacatcagaaatacaggttgccttccccatggctacatgtgagctggtagtagtggctgagcagaaatagcccagctgtcctcctgaaatttagcagggtcttacttcattgagcagtcatctggttcgtagacaccagagttacagaaaagtttattgggaggttttgacagtttaatagaaaaaagtttattgtgacagttttgacagctgaatagaaaaaagtttattgtgacagttttgacagcagaatagttgctttgctggagagacggatctttggagctgccaactccatcattttggtgatatccagctctgttgctgaatttttagctatgctgttttaagttattttcttagtggttgctctagagatgacaatgtacatctttaacttaccacaatgtacttcagattattactaacttaacacttaaagtacagcatttttttttttatggagtttcactctgtcacccaggctggagtgcaatggtgtgatctcggctcactgcaacctccgcctcccaggttcacgccattctcctgcctcagcctcctgagtagctgggactacaggcacccccaccacacccggctaattttgtatttttagtagagatgaggtttcaccatgttggtcaggctggtctcgaactgctgacctcaggtgatccgcccatcttggcctcccaaagtgctgggattacaggtgtgagcgactgcactgagcctaagtatggcaacgtgtctataacatagatctacttccgttgtactatgacatagttccccctccattttcctatagcacagtcccaacctcccttttcctctgacatagttccatcctccctcctcctatgacgtcctcccttctcctctggcatagctccatcctcccttctcctatgacacagctccatcctcccttctcctctgacatagctccatcctcccttctcctatgacacagctccatcctcccttctcctctgacatagctccatcctcccttctcctatgtcatagctccatcctcccttctcctctgacacagctccatcctcccttctcctctggcatagctccatcctcccttctcctatgacacagctccatcctcccttctcctatgacacagctccatcctcccttctcctatgacacagctccatcctcccttctcctatgacacagctccatcctcccttctcctttggcatagctccatcctcccttctcctatgacacagctccatcctcccttctcctctggcatagctccatcctcccttctcctctgacatagctccatcctcccttctcctctgacatagctccatcctcccttctcctctgacatagctccatcctcccttctcctctgacatagctccatcctcccttctcctctgacatagctccatcctcccttctcctctgacatagttccatcctcccttgtcctctgacatagctccatcctcccttctcctctgacatagctccatcccctcttctccttcatgtattattgccatatatacatttatgtatgttataacttcagctcttcagcgttataattattgcttcaaaagtattttgaaagaagttgcctggaggcagtggcttatgcctttaactccagcacttttgggggctgaggtgggcagatcgcctgagccagggagttggagaccagcctgggcaacatgacgaaacccatctccaccaaaattacaaaaaattagtctggcatggtggcacgcgcctgtagtcccagctatttgggggaggatcccagctaaggtgggaggatcacttgagcctgggaagtcaaggctgcagtgagctgagattgtgccactgcactccagcctgggtgcagatcttatctcagaagtaaagggactaggaatggtggcttttatctctaatcccagcactttgggaggctgaggtgagtggatcaccggaggtcaggagtttaagaccagcctggccaacatggtgaaaccccgtctctactaaaaatacaaaaagtagccgggtgtggtggtgggtgtctgtaatcccagctactcgggaggctgaggcaagagaatcgcttgaacctgggaagcggaggttgcagtgagcaagatcgcaccactgcattacagcctagatgacagagcgagactctgcctaaaaaaaaaaaaaaaaagaaaagaaaagaaattaagatctggacactgtggttcatgcctgtaatcccaaagccttgggaggccaaggcaggaggatcacttgaggccaggagttcaacaccagcctgggcaacatagcgagactccatctctatttaaaaaagaaagaaattcaaagagaaaaaaagtatacttgtttttttgtatcatccatattttacctttcttttttttgcccctttttctttcctgtgaatttgagttactgtctagtgtcatttccttttagtctgaagaacttcatttagaattttttttttttttttgagacaaagtctcactgtgttgcccaggctggagtgcaatggtgcagtctcagatcactgcaacctctgcctccctggttagagtgattttcctgcctcagcctcccaagtagctgagactgcaggcacctgccaccacccccagccaatttttttggtatttttagtagagacagggtttcactatgttggccaggctggtctcgaattcatgacctcatgatctgcctgtcctggcctcccaaaatgctgggattaccatgagccaccacgcccagcccatttagaatttctttttttttttttttttgagatggggtctcgctcttgtttcccaggctggagtgcagtggcacgatctcggctcactgcgagctccgcctcccgggttcacgccattctcctgcctcagcctcccgagtagctgggattacaggcgcctgccaccacgcccacctaattttttgtatttttaggagagatggggtttcaccgtgttagccaggatggtcttgatctcctgacctcgtgatccgcccgccttggcctcccaaagtgctgggattacaggcgtgagccaccgcgcccggctagaatttcttgtaggacaggcttgctagcaaccaattcagtgtttatttgggaatgtctttatttcagcttcattttttgaaggatagtttagctggctatagaattattaattgatcattcttttcagtgtttaaaagtgtcatcatgctaccttctgggttccattgtttctgatgagaagtcatctgtcaaattgtccctttgtacttgaagaattatctttttttctcttgatgttttcaagattttctctttgtctttggcctttagtagtttgtgatgtatctaggtgtggatctcttggtgtgcatcgtatttgggcttcagtaagcctcttagattcatagattaatgttttgttttgttttaccaaatttggagagtttttactcatcatttcaacaaatttttttcctgcccctctctcatctccttttgggagtaccactgcatgtatgttggtgtgcgttctctaaagctttttttttttttttccaaccttttttctccttattcctcaaactggattatttatttatttatttatttattttttaattttttgagacggagttttgcttttgttgctgaggctggagtgcagtggcgcgatttcggctcactgcaacctccaccaccttcgaggttcaagcaattctcctgcctcagcctcctgagtagttgggactaccggagtgtgccaccaccatgcccagctaatttttgtatttatagtagagacgaggtttcaccatgttggcaaggctggtgttgaactccggacctcaggtgaaccacctgcctcagcctcccaaagtactaggattacagtcgtgagccactgcacccggccaggataatttttaatgaatttttttcttctgccatctcaaatctgccgttgagtacatctaattaattttttttttttgagtcggagtctcactgtgtcgcccaggctggagtgcaatggcgcgatcttggctcactgcaacctccacctctcaggttcaagtgattctcctgcctcaccctcccaagtagctgagatgataggcgcccgccaccacgcccagctaatttttttgtatttttagtagagacagggtttcaccatgttggccaggctggtcttaaacccctgacctcaggtgatccgcccgcctaggcctctcaaagtgctgggattacaggcatgagcccggccttgaatttttttttaataggctttttgtttgtttgtttgtttgtttttgagatggagtcttgctctgtcgcccaggctgaagtgcaatggtgcaatctcggctcactgcaacctccgcctcccaggctcaagcgattcttatgcctcagcctccccagtagctgggactgcaggcaccctccaccacacctggctaaataatttttgtagttttagtagagacaggatttcaccatgttggccaggctggtcttgaactcctgacttcaggtgatctgcccacctcggcctcccaaagtccagggattacaggcatgagccactgctcctgaccatggctttagtttttagagtagttttaggttcacaacaaaattgggtggaggatacagagatttcacatatactccagacccccacacatgcaacagcccctccccacaacaccatcatgctccctcaccagactggtacgtttattacaatccataaacctacacagacccatcattgtcacccaaggtccatagtttacattagggctaactcttggtggtgtacattctatggactttgacacatgtataatgacaggcatctactattgtggtatcagacagagaagcttcacaacctcattctctgtactttacctgttcatcctgccctccccactacattcactaaaaatgtcctttcagtgattgtcctttttaactctggaatttccatttgatttttttttttctttttttctttttttttttagacagagtctgcctctgttgcccaggctggagtgcagtggtgccatctcggctcactgcaaccctctgccttctgggttcaagcagttctcctgttttagcctcccaagtagcagggagtacaggctcatgacaccacgcctggctaatttttgtatttttagtagagacggggtttctcaatattggtcaggctggttttgaacgtttgacctcaggtgaggcacatggtgaaaccccatctctactaaaaatataaaagttagctgggcgtagtagctcacacctgtagtcccagctactccagagactgaggcctgagaattgcttgaacttgggaggtggaggtgcattgagctgagatcatgccactgcactccagcctgggtgagagagtgggactcggtctcaaaaaaaaaaaaaaaaaaaaaggattctctatttcctgaatcattgccatcatattttcatttaattatttgaacatacttatagtagctgctttgaagtctttgctaaactcaacatctgggcccactcagagtcagattatatcaactgctttttttcctaaatatggatcatggtttcctgtttacctgtcttataattttttttgttgaatactggacatttcagatgatctatgtctggattctgagttgttttcctgagtcttgtgttctgtttgttttagttaagttgtttggacttaaactgcaaaacttgcccacccacccctgcagcctctgatatctctgctcagatttttaaattcttttttttttttttttgagatggagtcttgctgtattgcctaggctggagtgccagtggtgccatctcagctcactgcaacctccacctcctgagttcaagcaattctcctgcctcagcctcccaagtagctgggattacagatgtgtgccaccatgcctggctaattttttgtttttttagtggagatgaggtttaaccgtgttagccaggatggtctcgatctcctgaccttgtgatccgcccacctcggcctctcaaagtgctcggattacaggtgtgagccaccacgcacggccttaaattctattttttagtctggcttcctagcagttgcttctgtgtttgcatatggtagtggtcagccagggatttgggcaagagggtgtgctcaaacactcctaacccaaaaggctccccaccacaccatgtggtttcagagcacgttgtgagttcagccagcccctctctctttgctttcacttcaccctggcctctcttggagctcccaacacctgcagtggtttcctcaagagccaggcccttcctgggagagctgagcccttctgtggctctcattttcagagtcttcctgttaagtatctggctggcccagtgctcactccagctgggatcacagccccaaatgatcagggctgtcagttttctttgtaagtgtttatcgagtcaccacttttaactacgaggcctgggttttcccttctgtcccacatccacctctgctgctgctggtttttgcagccagccttgacctggtaaatcactcagatttgctgactcaggagtaggagccaggggcagccccaggtgcaaaggctgtagacttcccagtattctggcccaaggcccaacatttttcaagaagaatctcttctcagtgagttctcagctttggtcagtttccagaactctgaaaagttctaaatcagtgagttttgataattttgtctagttttagattattttttctttttttctttttttttttttttgagatggagtctcacttcgtcacccaggctgaagtgcagtggtgcgatcttggctcactgcaacctctgccttttgggttcaagcgattctcctgcctcggcctcccgagtagcataattataggcgcacgccatcacaccggctcatttttaaatttttggtagaggtggggtttcaccacgttggccaggctggtctcaaactcctgacctcaagtgatccgcctacctcagcctcccaaagtgctgggattacaggcgtgagccaccgctcccggcccatattcgattcaacgacctctctacttgagtgtggctggaactcagaagcttcttttagttttagatgttgtttgttttcagggttaagtctttactaattctggaatgtatttctgtcaatgctgtgaggtaggtgattgggttgggatcttttatgtatgaaaacccagtttttaattttctcttgtgaaatccatcgtctttctccttgcaccccatctgtgatgcttcctctgccacacgaggctttctgtgtgagggggggctcttcctggaggctctcttttgctccattgatcgatttgcctgttctcttggttttcagttaacttcatggatatgccattaacttctctccatggttagaaatttaggttatttccaagtttttcatatttggttaatatctttgtggccaaatctttacatacattctccttaaaaatcatgtcactgaggcggaaggattacatgagcccaggagttcaagaccagcctggccaacatgacaagaccttggctcaacaaaaagattcaaaaattagctggcatggtggcacactcccatagtcccagccacttgggaggctgaggcaagaggattgcttgagcccaggaggtcaaggttgcagtgagctgtgatcctaccatgcacttcagcctgggcaagagagcaagactctactgcgcacacacacacacacacacacacacacaaaataatagaagcactttctgggttaaagagtttacaaatttcaaggcttttaatattgtcaaatattctagaagaggttttactaatgatggtgtgggtgtgctgaaggggcgtatttaatcgaattcactctgggtttaaccctctctttttgaacatgttctcagtctcctttcagccagtctctgctgcagtgcatttgaggcacagtcctgtagcccctggcgcccccggtcattggcagggccctgtgtgcctaagaacagtaggcactagaaggaaccgcccaaaatcctggcctggggaggtgtacgaggccacctttgtctacgcatgagacaaaatccctgttccacctcactctgctccacccacccgttcctactggaaagacagccttggctccatgtcacgggctgaaggcctgtcctcagttgctccttttttgtttttttgagacagtctcactctgtcttccaggctggagtgcagtgacacaatctctgctcactgcaacctccgcctcccgggttcaagcgattcttgtgcctcagcctcccgagtaggtgggactataggcacgcgccaccacacccggctaatttttgtatttttagtagagacgggtttctccatgttggccaagctagtctcgaactcctgacctcgtgatccacccgtctcggcctcccaaagtgctgggattacaggcgtgagccgctgcacctggcccctcagttgcttttgtggggttgaaagaacttcctttttgaaacgatggcatggcagcagtggatggcggttggtttttcatgtctttatttggcaaagttgaagattgcagttctgtctgtccccacatttcctcttcattctctctctctctctctctctctctctctctctctctctctctctctctgtgtgtgtgtgtgtgtgtgtctcggttttggttttaattttactggttcactgatgcctaaaagtcaaggcatcactatttcataagcaggttctcctagtttgggggaggactcagtcatgcacatacacacccccagcacatctgccttgatgcactggtgctgtggcctgtgcagtagtgaggctgtgggagctgctgtcagaaggctgctgccacactgtgactccagcagaggcgatgggacacacggggcatattctggagcagccaagtccatcccgagagagaatgcgggtgtctgtgtgtgtgatgtgtgtgagactgtgtgtgtgtgtgcatgtgcatacatgtgtaaagtgtacagttggcccttgtgtgtgtgagattgtgtatgtgcatacgtgtgtaaagtgtacagttggcccttggtgtgtgtgtatgtgtgcatgtgcatacgtgtgtaaagtgtacagttggtccttggtgtgtatgtgtgcatgtgcatacgtgtgtaaagtgtacaattggcccttggtgtgtgtgtgattgtgtgcatacgtgtgtaaagtgtacagttggcccttggtgtgtgtatgtgtgcatgtgcatacatgtgtaaagtgtacagttggcccttggtgtgtgtgtgattgtgcatatgtgtgtaaagtgtacagttggccctgtgtgtgattgtgtgtgcatatgtgtgtaaagtacagttggccctttgtgtgtgtgagattgtgtgtgcatacgtgtgtaaagtgtacagttggcccttggtatctgcaggttccatatccatcatttcaaccaatctcgagttgaaaataattggggaagaaaaggatggctgcgtctgtacactgtataacaactatttacatagcatttacatcgtattaggtactgcaagtaatctagggatgatttaaagtacgtgggaagatgtgcgtaggttatatgcaaacactatgtcattatatataagggacttgagcatccttggattttggtttgcacagggggtttcccatggataccaagagactacgtgtgtatgcaagtgtgagtgtgtatatgcatgtgtgtatatgcatgccatgtgtgtgcatgtatgtgtatatgcatatatgagtgagtgcacgtgacagtctacacgtgagggtgcatgtgtgtgcgcgtgtgggtgactgcatatgtgtgtgcatgtgtgggtgcgggtgcatctgtgtgtgcatgtttgggtgcgggtgcatgtgtgcgtgcacgtgtgtgtggatgagaggtcgcatgtgtgtgggtgagggcgtgtgtgtgtgcatgtgtgtgggtgagggggcatgtgtgtgcacgtgtggtgggtgaggtgtgtgtgtgcatgtgtcagggtgtgtgtgcgcgcatgtgtgtgggtgagggcctgtgtgtgcgtgtgtgtgggtgagagatgtgtgcgcatgtgtgtaggtaagggtgcttgtgtgcgcatgtgtgtgggtgagggcgtatgtgtgtgggtgagggcacgtgtgcgcgcgtgtgggtgagatggcgtgtgcgtatatccatgtatgactgcatctgtatttgcatgagttcatgtgtgagtgcatgtttatacgcgtgtcagggtctctgtgtatgtgtatgacgtgtgagtacatgtgttaatgtgtgtgtacatgtgtatatgcctgtgtgcatgtgtgtatgcatgtgtatacatgtgtacttgtgtatgtgtatatgtgtatgtctgtatatgtgtgtgtatgcctgtgtacgtatgtatatgcgtgtgtgtatgcatgtgagtgcatgtttatgcgtgtgtatgtgtacttgtgtgtgcctgtgtgagtgcatgtgtgtgtacatgtgtatatgcgcgtgtgcgtatgcgtgtatgtgtacgtgtgtatatgcatgtgtgtgtatatgcctgcatgtatatgcacaagtgtgtatatatgtgtatgtgtgagtgtatgtgtgcatgtgtatctgtatgtgcgtgtgtatatgtgcatgtgtgtatgtgtgcgtgagtgtgtgcatgtgtgtgtgtatgtgtgcgtgtgtatgtgtgtgcgtgagtgtgtgagagtgtgtatgtatacgcacgcgtgtgtgtctgtctccctcaggacagtgcccaggcggatgggtcagtgctcctgggttggtttgcccctggtggcccatgtctgagccctgccccttacggctctgtctgcaggttctcccatgggcaggtggtctctctggatgagctgcgccccttccaggacccagacctgagctccctgcaggccggctctgcgtgtctggccaagcaccaggatggcctctggcacgcagcacgcatcaccggtgaggctggccgtgggggcctcccgggaacaccctcccaggccccacgtgtgttgtcactgtgtggctgctccctgcttcctttgggttgagtgtcgggactctggctctgggcccgaaatgagcacacctaccctcagcctctgccctgccttgctcctcatgtccagggtggttcccttcagtggcacctgctgtcaaggattctgacctgcagcttgtctctgcccccagatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagaggtatggcagcagctgcggagcccaggagccaggaaggtggggtcaccctgagaggctcctggccggtgagggcaccaaccatctaaccaaactattggagagtgtgtgactgcggcgagggtgccacctgtgcctgaggaggccgtgtgggtaggggtagatccgtggcggcctttatcttcaaggagtgtgggtgcaacagctacagtctcattgatgggaggccatggtcgtggctgtggccatgggagaggaggggcctggagttgccgaggaagtcacagaaaatgaccaactgatggggcctggagtgcaggaggggcagctcctctgcatggcttctcagacttgggacctgggtgcctgggatcctggcagacagaggttgtgtccagacagccagcatggaagtttcgggaatgggaactggtgggcagtgtccagctctccagaggggtgtgtgtgtgcgtgtgcgtgtgtgtgtatatatgtgggaggtcacctgacccaagcatggcgggctgagtccaggaggggtctgcatgttggaggtgtacccagggatcagtgatggtggtttctgaagccccatgtccctggtgaaggaggactgaaccaaggactctgtgagggcaggtgaggcgctcacagcctcgcgaaggtggagaagggcaggggcaggagagggctgcggaggaggggccacggtgcagcaggccgtggggactgccatgcactctgcctggtgtcacatgcccacagcagcctcggtgacgagagcacggagcccaagaggtggggtgtcgtggctctgcccaggatctgagctcattggtcaaagcccgggtcaccatgcacaatcctctggcctggctgggccactgccctctgtccatctcttgcagtggtggggtcggacgccgtggactctgcacagtcctctgccctctgtccgtctcttgcagtggtggggtcagatgctgtggactctgggacctgcagctctgcctttgctggctgggaggtgcacacgcgaggtataggctccagactcctcaccaagatgggctatgagtttggcaagggtgagtacaagctgccctggagaagtgggcaggctgctgcagcatagcccaggtccagcagccatcaggttcccggggtcccgcagccatcgggttcccagggtcccgcagccacagcactgccatccccgtgctcctcagattcccggggtcccgcggccacagcactgccatccccgtgctcctcagattcccagggtcctacggccacagcactgccatctccgtgctcctcagattcccggggtcccgtggccacagcactgccatccccgtgctcctcagattcccggggtcccgcagccacagcactgccatccccgtgcctccgcaggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggtacgtgtggggcccagctcagggcaaagggcgacccagggtggccctgcccccgggatacatgctggaggtcacctgacccaagcatagcgggctgagtccaggaggggtctgcatgttggaggacgggcagcgggcacacaggcagtgggtacggcagactggggttggtggcatggcccaggaccccacgctgactagtgagcccctccgcaggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcggacactgctgagtggagacagagctgcggggtcccatctggacacttacttgcccacctgccagtgtcttgggcatttccttggcaaggacattaaagtgatttcatcacagtgtca

SEQ ID NO: 12023 - DNA, 5177 bp, Homo sapiens
cgcgtcctgagagtcagccctcgccgctgcagcctcggcgcccggccggccggccatggagcgccccccgccccgcgccgccggccgggaccccagtgcgctgcgggccgaggcgccgtggctgcgcgcggagggtccggggccgcgcgccgcgcccgtgacggtgcccacgccgccgcaggtaccgggcgccggtgggcgggggcgccgaccaagtttctctcgctgcaaagatggcgtcagtgctgcccaaacttcgggcccccgggggcggggcagcggggagggcggccgcgtcggtccgcgcgtgtccgtgggtcccgccggggctgcgccgggcggccggggagcccttcccgccgcgccgggctgggggcggggccgggggcggggccgcgccgtccacaccggccgcagccggttttcgaggcgggcgccgagcggatccgcggcggaggttgagggacccccctcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagaggtgagcgggaggcccggtgcctcgggactcggtgtgcgcaggggcggtgggtggggtgcggagacaccggccccgacggaggccaggtcagggccccaggtttgtaattaccagccacccccaagctcttcagccctggaggagctgagcagaaattatcgatgactgggagtccctacacctccctccaccgcagttcctcggggctagagctcagaacccggagcgggtggctgtgcgtctctgtgcagaagaggctgcgcggtcggcatggggcgactgtccaggaatccctggggctcctgaccgccacctcccaacccctgccaggccggacacctcggtctggctgccagggcaggggcgggccctggcctggctcgctggggcctggggagctgcccgtgcttccagcccagtctccccctggctgctgccggctgctggccactcccacctcccaggcctggcgtgaggcccacagctgctgttgcacaaccctggttaatgtgtgatggggggaggcctgggcctggcccgcccctctgccagggcttcagacccctgcccagccccagtatctgaaggaaccacagtggagccaagcccgcgatgtggagaactcaggcttcaggagaccctggccctgctcctggcggctccgggtggctttcagctctctctgcaacctgagctgggggaggagccaggcctcatgcccagggctgggagtggggagcctggtgtgcacgcgtgcccaggcctgcacgtggaccgaccaggggaggggcccagagctctggctgggtcacccgcaccccgcccccatctcctccagagccaccccaggaaaagcccggctggacgaggtcatggctgccgctgcccttacaagcctgtccaccagccctctccttctgggggccccagttgcagccttcagcccaggtaagactcagatgtctgcatttaggggtgtgggtggggacagggctcagaacctacagccacccagcctctgtggggcaagcagagccctcaaacctgggactcctttctaaaatggactcccgcaccctcagtgccccctactgaggccaaagcggcaggacccaggccttctggcctccctgacctgctcacctccacgcggctggccacacacgtctgccaaccctttcctgtgccgggggggtttctccccaagccctggggccagctcctccaagacgctctgcccaccagtctcaccggacttggtgaacaggggcagctcaggattagggactccctggacccacccgaagttctaaggcggggggcccgtgtccccacagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaaggtgagcttgggggcggcccccagggaggggcgggtgtggcggctgagcctgaccctggcccctgttgctgcagagcccggcccaggtcatgttccagtgtctgtggaagagctgcgggaaggtgctgagcacggcgtcggcgatgcagagacacatccgcctggtgcacctggggtgcggcggggcctggggtgcggcggggcctgcgggttggctggggttgtgaggcccggccaggccaccccttcagctcccactggctggctgtgtctcccgcaggaggcaggcagagcctgagcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccaggtgggtgaggccacgggtggcagctggggcgggtctcagggctctctggaggggagtgaagccctggctgtgtctccctgtagggctgcctgacgcccgcccgcctggagccgcagcccacggaggtcggagcctgcccacccgccttgtcctccaggatcggagtcaccctgaggtgcgtgtgggctgagggcctgcggctggcaccaggtggggagggtcctggtctcacagcaccccatgtcctgtgcccccccgcacaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccatcccctccaggcccggggctgaaacagcccgaggacagccccaggggctggccttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttccagaagctttgtctgcctctcgggaggaaggccgtggggctgggaccctgtggtgggcaagtgggtggagtctggcagctgcccacagagggccgagggtcacccgtcggccgccgccaccccaggcgaggccggaggaaggatcatctgagacgcaggaggcatctgctggagcagcaatttcccaatttattgaaagtgatcgctttgcaaggatgtctaagctaatcccgtcacagaaaggaaacgcacaggcgcctaggcagaaacttggagactcaccgcagaggccacgtgaacccacggccacagagaggcaggacggcagagccatgatttcccaccgagcgattacgagaacctcttcccccaatagtagacacatctccaatacaaacacaggtttataataagtaataggaagtcaatataatatagattatccccagaaaaaaatcaacaatcttcaaacactgccctttttttgtgtgttttgtttttgttgacaggttgaaagcatgttgaaaaaaataaatatttaagaaaagcacacacagcaccctcactacaagtagttctaaaagggctgcatacaaaacacaatataagatctaaaaaaaaccaccaccattaagtatggctttcttaagagtcgcacatgtcacagaatgagctaaaataagattacttcttttataatattgcaaaaagttccagtttttgcattttctcagttttttaaagaggaagatgtgcaaagttggaagcagtaagctgcgtcttctgagtcagttccctacgtagccctggcagtgtcctgtgtcccaaagctcagagagccccagtgtacaacctggtcaggatccagagcttgacagaaaaatcgtggtgtccctgccccctccccgcccccaaataacaccatccccaatggactgtatttcccactttggtgttgtaaacaccaaaatacaaacagacacaaacaaaaatacaaaatgtgaaatgtaatctacacatttttcctcttcataaaaaaatatttattagtttgaacatcgatttaaaaaaaaatcagtcacataaaaaaaacccttcatgacatgtcttttccctccacgcctcctgagatggacgtgctcacctgggcctcggaaatcccacactcttcagtcggcaaactgcgaacaagaacaggaaatctgccacgcagcaaacacttggggaggtcagtgggacactgttggttttagggaagaaaatgcccctgtagctccggcggggaaccccaaaacggtcagcaaaggcaggccacacggagtgagccggccagatggagcaggacatcctgagtgtggagggggaggcgggcctgggtcctgggcagggtggcctgagagcagggactggtacaaaacccagagacattggtgggtagcaaaggtctggtttccaaatgcattttgtaagaaagtcagtctgtttagaaaaagggtttaaaaatcaggggaaaggtacaaagttctgagaattc

SEQ ID NO: 12024 - DNA, 13208 bp, Homo sapiens
ctgattttggtagcatcctttggtctcttctagtctgggagtcagagaaagtttgcatcaaaatgtcatcagggtaagtgcgagtgtgagtaaaggtagatgtttttagggcatctctggccggaggtaacattttaacatttcagagccaaatttttagttttggcaaaaacatgttttgcaactcaaaacttctcttcctgctttaccctgattagttgctagttgaaaacgctcggtatctcaactgtgtccttccctccctattgccaccccttctctccagctgctaacttgcgaactcagggctgtgcccagcgtagacgtttatagcagttgcagggaggtaggtgggaagaaaggagggaaagaagacagggaaggaaggtggaagggaagaaagaagaaattcattatctatccacttttagacttggagataacatttttctccaggacacggtgcaggcctgagcagttaggacagtcgggttcaaatcttaatcccccactgaaaacactgtgtgacgttggacaagtgacagaacctttctgagcctcagattttcctcatctctaaaggaagaatgtgagggattgatttcagtgaaatagctcccgtcaaatgctgctgctaccatgtttagcaaattgtttaacacataataagcattcaacctgagagttttattgttactttatttgggtactgagacctctgtttctggggtggcactgcctgacctggggtggagttacaccgtgtatcctaggtccaccaagtctgtggctttacatagctaagaggtttgaacaaccccagagcttctatcatacaggatttcatagagattcagataccagcaaagccgttggaagctgtgatggataagtttatgtgtcaatttggacaggctgcagtattcagtcatttaatcaaacaataatctaagtgttgctaaggaggtattttgtggatgttaacattgacaacctgttgactttaagtaaaggggattaccttggataatgtgggtgggcctcatccaatcagttgaaggccttgggaccaaaaacttggaggagaaattctgccttaagactgcagcctcagctcacacaggaatttccagcctgccagcctgccctatggattttagactttctagccctgagaattgcatgagctaattcctgaaagtaaataagctaataaatacttgtatattatgttattgtattattttatataatacaatatataaactatatcacacaattatgttgtgtgatatataaactatatcacaattatgttacctttgtaattgatatataaactatatcacacaattatgttacctttatataatataataattacatgctatttctaataaaatttctattacattatatattctatattatgttatgtgccaaattataaattataaatacatgtaaatttatgtataaatactaataataatttataatttgctatataacataatatggaatataatgtatatattccatattatgttatatattatattacatattatgttatagattatattccatattatgttatacagcaaattataaattattgttttttcttaatgatatgaaatatatatatataaatatatatataaatatatatatataaatatatatatataaatatatatatataaatatatatatataaatatatatatatataaatatatatatatatatatatatatatatatatatatatatataatctattcttggttctctttctccggagaaccctgactgatacagaagcttctagcttaagtgtgtatatggtatagacaaattttagcaggactctttcttcagctcttctgtaataggaatccagacttgaattcttaatgaaaaccaaaaagaggacaaaggcaggagcttctggctaggtggggaccaatgtggggatggatttcctaatcctaacctgaaaagggaatttcagggtagaatggatgacatcccaaaccccagaccagtgtttagtccctgaaaggctccgtggagaagtaaacaacttgggtggagtgcacagttttgtctgttccgttgcagagctttcctgggccttttccccaagctgggttgtggtggtttaaaattagttcttgtttggcctgcgagggaggagggaatttgcggagtctgggctggactcagccttttgctgtggaggttctgagggctgtgtctgtgacttgtgcacattgaaagtggagagacttgggctcaagacctccacgtgaccaaacctctgtccttgtcgtcagagctgtccagaaacctaaatggaactgaagtccaccaccctggtctgatctgggagacacctctcctgtcccaaatagagctctctacctacctccctctctgagatacctgcgatctgcaggaggaattactccttttgggcatgacctgtaagcaactgctccattgcaagtctcgttcccaaaccattactgcccatgagcacagtgacatttaatttcatctttaggattcatttccatcatttcaagcagggtcatcttggaacaggacacaggataggtaagctttggtggggatgggaggaggaaggttgcaatgctagttgcctatttaggaaagaagccctagctcactgggatgaaaacattgggggctggcgagcggatgatgctgattgttctatcaggggataaaagagcagaaaaacagacattcattctctttacaagtgtgttttcagctggcatgacacctcctttgactctggagttgttttccctgaatatctttgctttccccttttcggacattgattccaatgtcagcgtaaagctaaacatggctgactacacatctggcctggtccttgtgaaaatatctaagctattactgaattcagagctattgctgattggtttcttaagtggacttgaaatgtatagctttattcaaataatcatatcaacaagccatattgctaacaggtcagcatgggtagttgatgactaataccacacacacacacacacacacacacacacacacacagatacatatgtgcacacacaccacttcacttcattgtgagctgaatttagttataatcattccagtctcagtaatgtttgatttatttgttttattttgtctgataaaaacagaagtgatgaaagatgatcagctttagttgttaatacttattgatacatatttagatctttgattggcagttcagtcttatgaccactaaaaaagagagacccttggaggaaagattaactttataagaatgttaggattttaatagcttagataaagttttttaaaagttggaaactagaaaatttgctttgaatttaatttgtaaaaaggacttccagacctctgtcatatagacagtagatttctgttccaattgcagataactatgtaatctgttattcagttaagaatgtttatatagtttgtgtttaaatagacatatttaagcaatgaagaaagtattgtaactaggcaactattgattatctacccagtgtgtccattcctgctactcccttcctagcagaaccttgattaggtcgaggtttaaacagcaatgtgtcaaggcaggtggaccaggaggatcctaagggagggaacttgattgatctgggccaatcgtaacactcttgaacatcccttggtcagcaattggcttagaggtgggcatcctaaacttggcatatgagaaagacagtaggaatttgctgggcgctcttgggaaatattgcataaaacaattcatcaaaattggcctttcctttttgccttgacttgccatgtaagaagtaatgcctaatgctgcgacagacaaattgcaaccatcagggaaagccaggagactctgagagagaccaattattgagctgatgaatgaacccttcctgaagccacctacttcctcacttattggtgtgtccttactgtgtaaaccccttttaactgggtgttttgtttcttgcagccaaaaacaatccattgatacacttggtgacattaattgagaaaaaaacaatatgggtaagatttagtcttcatatttgttttttgtccttagtaaggcataatgtaattaaccaaaaaagaattgattatactttttgtaactcttgtagccattgtcaaaagataaagtgatttggaaaacatgcacatatgcatgtacacacacacacacacacacacacacacacacacacacacactctcttcaatccattcttgaggttgatatattagtttccaggcatttgttcagtatttctatatctaaaaatttgtggaaggatccgagagatccagattcagtttttatagctgtttgcaagtatgctaagttggcaatgcatagatgtgtagagaaggagagtaagagacacagggagcaacgtgagtgaataatctcaagggatgaacagttcccagctttgctgggacttctttagccatatcacatcacatgcttagaagtcaagtttgctaggtgtgttttacagatagaaaagtcaaggtgcagataagtcaggacctgcacatagaaattcagtgatctgagttcccagtgcccccaaaggattttcattactgcatattacctctgttttatttcctcttatgaaaatgcacacaagctcaaccctctgaggacctgttgcctttttgtgaacttgagtagaacagagatcaagccactttgctgtggctgttagactggaaactcagagttggtcatgagaaaaatggttttcatttccgtgaacccagccatctgaactggtcaggctctaataaccaagtttagggaagctcatttggaagaaatgaatttgcttttggtattttggaaaggtctcagggccttgccaacatcagctgctgatggagttcctgactgtgtgtgacaggtctcagcgccctgcttccaggttgctcgaggtacccactccctggtaatcacctctgattttaaacttcctaacagtctggccatggaggcatggtatccgtaacatcccccaaaggagctaaagaagaaatccacaatttaccatgagcatttctcgtctgaagattgccaagcgattcctccaggacattcctcaaggtgtgtatgaaaaatagtgtccaccagggactgacgtggttcaggtaccattgctgctttggggtggaacatttctgtaaagtgagaacaacatagggttaggagctacgtgaacaaaccccctattgactaggaacaagacataaaaactttctggtagacgcagatctagtggggaggacatggcagagtcaacgccctccaattttctatggattacatcccatctccctctcagtgacatggctgcagttgtgcttggcccatgagggtgctgttctcctttccttatggaaattggagaatgtgggaagaggagactttgtttttctttttaagtgttctctttttaaagaaaaacaattggactatattttttagagcagttttaggttcacagcaaaattgagcaaaaggtaaagagagtgattttactttttgtaactcttgtagccccctgcccccacacacatgcacagcctcctccactattaacacgccccatagagtggtacattccttacaaccaatgggcctgcactgacacatcattatcacccagagcccatagtttccattagggttcactctgggtgttgtatattctatgggtttggaccaatgtataatgacatgcatccactattataataccatacagagtgctttcactgccctaaaaatccccttgcttcacctatccatgcctcccttctcccaccttctggcaaccactcacctatttactatctccaatgttttgctttcttttcagaatgtcatatagttggactcatatagcatatagcatttcagattgttttctttcacttagcaataagcatttaagtttaagagactttttattttgttctgtaagatagcctaacatttttcaaaagtaggactgttttttaaacagatttttatcagaaggaagaaataatatgtggacactgtgaaatggctgtgtttataaaaaataagttttagacaacgaaaatatacctatagaattgctgatattaccaacgaacttttgtcttcatctctctggcttcctgtctctgtgccatctggtctcttagactgtttcactccttataaactgattggcctgaccttcctgctcttgttgaagttacattcaattgatattttcttattttaaataagcatattccttagggtctattctatgaggaccaggattgtgatttagaggaaaaatcttgttctctgtgtatttatgcagtgctatataattgatataccttgtacccaacaaaggcacagtgtcttcctatttttgcttctcccttgcactgctatctgaataattcttcagacaaatctgccccttcattctgggggcttttcatttagagactacaggaatttggtaattgctgcaatgtagaaaggtatcaccttccaaaatattggaaggtatcctgatatttcatgttctacctaataacacctttcaggactcatgttcttaggcaaatgctttggggaatgtggcagtgatgtatgtgctggggaaacacagaggcaagcatggatgaaaatcactgtggaatattgaagaaggcttccaagaggaggtgacatttgagcttgatcgtgaacacgaagtaaggacagaactaggagctcaactagaggaagaggcaaatggtatactagtgtagactgtgttaatgtgtagacaactgaaagaagtggcatatttgggaagctttaggatgtccatggtgaaaagtacctacgaacaagaggtgagagagatggagggaagaggggcagaggatgaaatttcatcaacattgcattgtatttcttccatttgtcctttcagatcaatttctgttcatccaccttgtcctgggagggacatcaatgggtttccatgtcctttggcttctggttgagttcactcagtggagaaccctggcaagaggcaggaaaaggggaggaaggtaagatcagggtattttctccagtggcttcctacatgagaagtcattttgggttggctgtttcccccaagtgaagatcattgactctctaaagctggccaactcaacttgtccttttactaattggatcaagtaattgctacctctgtttgtccttttgagtctaaaaatggcaagccccaggttactgcattgtcttttgtgatttccctataccacacctctgtaaataaacctttcttaaatcatccctttttgaatgtgccatctgcttcctgttgtggctctgagctatataaatatgatgtgaaaaacctaggacacaacgtagatcaaagagtgcctggaagaatcttttttcccccttattttattttattcttcccatatttaccagtgagatatctttatattacccctgagatctgaaaccgtaaaacataaaacatagaagtgttttttttaaacattttattttattttttatttatttaatttttacattttattttattttaggctttatgatacatgtgttgaatgtgcaggttcgttacataggtaaatgtgtggcatggtggtttgctgcacctatcaacccatcacctaggtattaagccctgcatgcattagctattagtcctgatgctctccctcccccgcaccccctagcaggtccctggtgtatgttgttccactccctgtgttcatgtattctcattgttcaactcccacttatgagtgagaacatgcagtgtttgattttctgttcctgtgtcagtttactgaggatactggcttccagcgtcatccacgtctcagtataggacatcatctcattcctttttatggctgcatagtattccatggtgtatatgtatcacatttttctttatccagtctaccattgtgggcatttgggttcattccaagtctttaataagggtttggtcttacctgatttatgttagaaggaaaccatttgtttggaatgaatagagtaaatcttttgggaaaatagaaaaaaagattattttaaaatcatgtgaatatttaggtctaagagttgtccatgaatccttagctcagtgttcatagatccctacaaacaagatctatgaatagaattcttggaatccttaagttaggataggaaaaaattacatctttattttttctaacctctatttgaaatgtagtatttctttccatcacaagtgtatgtgacaagacacaatagtgttggtcattactaaggctttatcaccgacaaaaatcataggtatttttatatcacactgcagtgttgtaaaaatctcaagatatcatctatactcttcactgcttcgaaattatggtagttggtagacccaccttcaggtcttgttattggcggcattaataaggaagtgtatatgttatgtttcacaattttattttctaaatactttcagattgcaactgcatttccatataatttattttataattcgttgtgtttcaagttatgcatttacacatgtaattctaaaaagaagtccatagacttgaccacatttccaaaagagttcacagtaaacaaattattaaaaatctctgttaattcatagatactcattccagaaaatacagcaatggctgcatatcaggaatatctttttccagaaaaaaaaatatccgaagttactagatattctgtagtttctgtatgtggagtttctggggtaaatcctttgagttcaatatgttgactatgtgctatgtcatctcaaatatttgaccttattctgtttttcttctctgggtcattgtatgttttgtaactagatttcctatttggtatttgtctcccaaattttaagagcaaaacttgtcatctatcgccttattttaattctcactatgtaaacttgtaagaactaactcacaacttggtgtctcataactcacttctgaaatatccaataaaaaactgccaagttattcaccattgtttattttggtcctagtacactgtccatgccctggttgaatatctcgccaaatttcctccaatttattgcaaaaccaattggcagaacaatgaggaaacctgtctggggccaatttcagcaattgatggtgccgccttctctccccacctccactttccactaatccatcaagtttcttccagatctagccattcttaatgggaatataacaccttggcatagctccaaacatgaacaaaaaatattcttcctgtccttactccgctgtttccctcccctctgcttctcatccttttctcaaaactgacaccctccaagtacttcttctcccagcagagaggatggcctacctggcattgcaacatttgagaatgaaccttattttgaaaataggtgatcatgctcttatcaatacaggaaatgggagatttaaagctcttcccatcaaggtgtgaaccttccacaaagcagcagctctgaaatatttcctgtgtggttggcataggtgaaagaactgttttgcagagcctattgagatcaaaactagggagtgtctttgcagcctgttgttagtcaaagtagttatgtattgctgatggtgcttttctaacatagaccttaaagctcttttatgtgggctgtctttttgctgcatttttaagacagagcaagaagctgagattatctgctcccactgtggtttcaagactagaaactcaaggaggttgtaggcttgtccaaataactttggacaagtatactttgatacttgttcaatgtatacttgatactagtatttcactagtatcaaaaccatagtgaaatacgtgaattaaactctgctgccattttgttttttgtttttttattattattttttaattatactttaagttctagggtacatgtgcacaacgtgcagatttgttacatatgtataaatgtgccatgttggtgtgctgcacccattaactcgtcatttacattaggtatatctcctaatgctacccctcccccctccccccaccccacgacaagccccagtgtgtgatgttccccttcctgtgtccaagtgttctcattgttcaattcctacctatgaatgataacatgtggtgtttggttttttatccttgtgatagtttgctgagaatgatggtttccagcttcatccatgtccctacaaaggacatgaactcatcctttttatggctgcatagtattccatggtgtgtatgtgccacattttcttaatccagtctatgattgatggacatctgggttggttcgaagtctttgctattgtgaatagtgctgcaataaacatacatgtgcatatgtctttatagcagcatgatttataatcctatgggtatatacccggtaatgggatggctgggtcaaatggtatttctagttctagatccttgaggaatcgccacactgtcttccacaatggttgaactcgtttacagtcccaccaacagtgtaaaagtgttcctatttctgcacatcctctccagcacctgttgtttcctaagcattatgttgagttgattttcagatttctcccttaggtaacaaccagaaagaattttgggatattgtgttagttaaggtgcatgcaggaatacagaaagcacattaggtgtttcaacagaggggatttaatttaggaagttggttatatatatttcagcctttttggaaggctgaagtaatgaaatgggaacaatgagataacatagagatagtaacttcaggaagaagctacccctaccagggctggggaataagggaaaagattaggtctattgcaacctaaaggatcagaggaagggtcttgaggagttgaagcccagcctctgagggggaggccctatatggctgctgatggcatcccaggagattgaaggaggaatcttatagagctggaattcaaatatctaaggaaggagcaatactgacttcctagagcttgtacctctgagaaagcactttgaggctgactctaggagatgggggctgtatccaactgctgctgtagggatgaagtattgctgctaggtagcactggcgggagcagcaagtaaaaaaaaagtggggaaatgcattctgccttctcctgattccaatctccctttactgccccctattgccagaatctatctattaggagcaactagcaaaggaaaaacatgatttacagagactcttttagcgtcccagagcagggtattggaggtttgggagctgggagacagtagcttactacatcacacaggtatgtaggacatttttggattaccagaggatgtaccagtcacccataaggatgtttggtatcaggaagaggatgatttaatatgaagtctacaggtcatatatgtatgcctagagctggcaggtgagtcactgggacttgagatcctaggccttctctcgtttgcatagtcatcttgcttggggcagagagagtggggttggtgtgggaagaagattgcagcatgcagggttgtgggtggtgatcccagtgtcccttgtccagccatgcaggtactagaagcttcagagcagttgggctgaggctacggtcagggattaggtggggaggtacctggcagaatatctgaaggaccacaccagcattttcttgtagagcagtcaatgtattggtttagacaaacatttgcacccacttaaggccccagtttctggaattataaggagtggaaagaatcttgattataaaaatctacagattaatgtgctcatcgaataattatagaacatctagtatatactacccattgtgctgggaccagggaatgtgaagatgaatcaggtaaagatgaatctgccttcagaggagctcaaacattaacagaaaattatagtcactttatttctggcagaatgggaacagagttgagggagaggcaacttactagggcacattagggacagcttcacccaggagcatgaactgagtcctgctatcaggagggatgttcagtagatggcaagggtcgggggacaaagggccatggaatgatgaagcaacgtgaacacagcccagaggtgtagcatagattggtgcctttgagaaagtgggagggacagcaggtagaaggtcagggtctccactgaggcagcagcttcacctgccttctctttccaaacattctatcagcagcctgaccggtttgaatttcaccttctgttcaccttggatgagagcagtaatcatcacgatcccagggaacagccaaaggaagagaaaaggcaaaagatttggacaagactcatgaagactaacagctcttggataattgagagaaggcagctgcgtgaacagttttgatgcaatcatgaaggcagggcccagtgcctgtggcatctgcctttttctggaaccaatccatatttccttgtggttttctaaggtgcagagagggcacattgggaactttgcttggggtctttttcacatcttagagggaaggtccctcaacatctgcattggcggagtgtgatcctcatgtccctctgaatgatctggacttgaggtaaccagccccttccaggaagctgtcccatgagtgaagcctcagcagcagcctctgtcagtccctcccccacagaacctttggcttccatttgaccagccttgacatccagtgtccaaacaccgataaaattgattccactaagcgtgggaaagtcctggagcatcgattgtttcctcctctgcacccccgataccctggcattagcactctcccagaatgtaccttgcttgtttgattggaggaggtcaaagccctgatgaagaatgagtggaattccacaggattggagcagtcttgataaatgacagcaggggatggtgtggggaggggaaaggatcagaggaagtgtggataaatgaatggcttaaaaaataatccacctttgcctcccccttttctaccagtctgtctagtgcttcagggtgaaaaaaaaaaaaaaaag

SEQ ID NO: 12025 - DNA, 4339 bp, Homo sapiens
agataacttcccatactataggcagttggacaaagatgtaaatgccttgtttacaaatgctacccagatctcctaattaggaccacacatgcggagaacccaacagcttttggacttatcggccaatggtcttcttgggaaggtctctcctagtcatgggaattgtctttttattgttcaagcttttgcatagacctggaagaggcatccattgctgttacccctgagtttataatcatgctgcaagtccagtggggaactttggcacaaagcattgaatgagatgggactgcacttatgtagcctgcatttcttgagaataaagatttctgttcatttagtgcagtggttatcatctgggggaaaaccagtgagtagaggccagggatgccactaaaatccctacactgtgcaggaaagctgtcagccctttgtcccacaagagattaactggttccaaaagtcagtagtgctgtggttgagaaaccctgtttaccacctgtaggttccagagagctcggatggtggtggtcattgtgctaagtttcaaattcagtatttaggtttggtttttagcttataggcaacaaattggctgactatggggtgaaaaggaagcacctcctttatcaagattggcttcaaaagatgtctgcctccccttctggtgggtcctgtgtccattcacagtgtgagaaatggaaaggaggtcactaagagacttgcaatggatgtaataactggatgcagaaactctggatctgaagggaatgttcatgactatttcatccctcctgctgccttggagaaccaaacgcaggagccacccaaggtgagactggggattatgcagttttcaacgttgcttcccatggactacttctccttccatcatttgcagattttttggtgtcttttttcttctggagactctccccttttctctgagcagtgttctggctatttcagatctctgcatctatggaggaacacatgctagtttgttgttgtgtggccaaatgccagcaagtcattgcattgtgttaccactagcaactctattagcctttttaagtgaggttcttgaaaaaaaataatgcgtagctcaattttccaatggtgaaaccgtaggtatcataatactttaaggaagaaaacacttttggttgcaggtctcttttactgcttttcaaatggttgtgtgtaagcaatcatttactcttaatatctaccttatccatggtaatattccaagcaagatattgtatactcttccttggaaacacccttgagtatttaacaagatagagtcctctagataacatagccctacttgcctaaatctaaactcttgaatataatgaaaagtctcccatctggaccatcttggaatagtcatggtttatagctgttaaactccaaatcagttacgtctcttggcattaaatacgatttgccttccagtttgtctcattagcacttttcagccctctctgacttagagtcccaggccgttgatgagggcacaggtgggccgtagggttaagcagaaggaaggaagccaccccctgcctgccatgctcagtgatggaccactgggtcctacccaatctattttcatctcccaaggccttttatgaccttgctttagagaaagaaaaccgcccttcaaaggcctcgctctgtcaatttcccccaccatatgttcttattaaaatgtttatgacactctttatcttaggcttattatcttaggattggtattgattaataaaacatgctacaaactaaaacttactatttagattttaaaaagtgggaataacaataacacatatatgattttaatcattttctaagcaaatgtttctagatgcaaagtagtctcaatagcaatggagaacactatcagggcatattattttcaaactagaaacacattgaatatatatttgtttgggtcatatgcctcatgatttttttttatgagactagataaagtatattgcaaggccgatagcagcagagcatttattgacatattttaggtgttttcctattgactgtagtttgtctttgtttgacaaatatagccctgtcaattcctttgatgatggtgttttcgcaaagtactgtatgttcagatattagcattaacagcatatggtaaataagctgtttatattaaagattttcattgtcttattataaaagtagttatgctcattgtaaaattttggaaagcatagaaaagagtaaggaagaaaataaatataattcatgatcccaccacccatttataaccgtaattttttaataaacatgtggatacattaagatacagctatactgcatacatacacacatataaacaagtaaaatatataattattttggtaactctattgcataaccaattttatatacttctactaccattttactatgaacattgcctatcaggacagaattctttataaacagttttaaaggctctgtggtaaaacattatgagggtgcagcataatgcttactcactcttagcagtatacaagaaggctgttttcaatttttcactatgattaacgatgccataataagcagcattgtctcaatctcatagattttgtgagaggtaaatgagatggttcatgtgaagttcctaatataatagtgatagatgttcaaaatgccttcctctccagctttcttcctctccctccacctatgtttctccttttctacctttaatgcatttttttttccttaaaaataagaccctagaattatagctacttggtgaacgtatatacacttttttttaaatttgtagtaatttttacttccccatcaaatgcagttatgtgcatctagttcttgattggcttgagatgccttgttaacctctgtcccagtctcaatcccatgttaaaatatagaaaggtgggaatgaaggtgtgctctgaagtcagttatcacgggtaggagggtctgtgagtacatttccaagtccttgctgtcttccagtcttatctagctgaaaccatcagcccatttggttcctgggcgtacccagatagaatggtgatgctttaagagttccatctgcactaggcatctagaatttgatttgttgtggaaggtaagatccaaacaccttcttgtccacaaaacccattgaattgtgccatatttattccattcataagattggatcctttctcccatttctgatttatatatactttacctccttcttgcaattgtaatcctgtcctacacactagtctgtttggctgggcttcaagcttctgtctggttcctgccgactccttacccctggggaaatgcagtctgtttccaactggacaggccatgtggaagcatattgctaccactctgccaggtgtacttagaagtttttgctctcctctttcaccttcaagaactaactaatttctttgagcacttatagaattccagatcaaggctaaatttcccattcctcttaggtgtgtagaccatctctcttctcaaagcactgaccctggggctgatcagacaatcagttttgagctcatccgtcccagaatccttccttcttcatggcattggcaaatgccaccaacttctcagcctgctcagggtcaagccagctcatgaaaggacaccctctggtgtgctttctggctgtttcaggaccacaagaagaagcagcagctcgcaagaaacatgttgctaaatagacctggcttctatgggaatcccggagttaagcattcccacccctttgggccacctttcacatttgattgattttttttcgattggttgtttgcctgacctgatcagagagtttggacaggagtttctgttgacactttatttcactttgggtaaagtttaaacatgacttatcacaaccctgacacatctggaaggccatattttgcccccctcctgttgtctacctctttcaatgatgagaatatagggcataaaggccttttttgtacacgaggagaaagttcattgccttgggtccttttagaggtaagtcttaggccgtctaggttataatcactgctagatgatccttctcttttttcccattgttaaaaaccttcatacttactttatttcccacaggtgaaaaccatccatttcttggagaagtgccacggtggggttgcaagtcccaggatcaagttttcgatgtgtctctttttcccgtaaagtggctgaaatctgaagctgaatctgcaagtgtcatggagtcattgaatctcacagtctcaactgataaaagttattaaaggtcgtctggttcagccttcta

SEQ ID NO: 12026 - DNA, 20845 bp, Homo sapiens
agcgtcaggtgcagaatggcccctctcctgatgagatggacatccagagaaggtaacccagcacccgcaggggccaggctggtcatctcccaatcaggctgggtggccaggggtgccttcagcgggtgaggatgcaccagcagccaaggccaggactcctagaggcatacactgcgggagggtgcaaggtgcaagccagaccaggaagaaagagggggccgatgcgcagccgctggtcccggacaccaagaccaggaatgactgtgggagtctggcattctacagagagtgctgctgacctccagcgggacggctctcagggtgacccagcagggcccaagtgctgctcccttgttgcctcacttgcccttccccaacgtagcaggaggcagtccaggcatgagggattcagcctgttggggcagtcacgcccatgggatggggctagggaccataggaatgaaccccctcaccccatggagcttctaaagtgttaccacagtggggaagaggaagggccaaggctgttgtcccgaaattacagagtcgtggtgagtccccatggagcagcctcccaaggtcacattgctctgaaatggcagagtcaggacttgaacccaggtctgccctctcagcgatgggtcctctgcctcttctgtgtcgagggaggtagggcctggcccgggccttcctcactcagctttgtcagatagggagtcaagctgcagctctctgtggctacacttatgtccagccctggactaggagtcaggaaagccggcttctgcccccacctacccctctcaccaaatggcatacggacttctcccaagacctcctctcctctggccttttcctaagactgagaaatgaatgccttgcaaccttgggcaagttcctgctccaagcctccgtttcccggtttgaagatggtgttggctttgctccccacctgtctcacccactcaccctcagggcttttcttactgttgtccccatgagccagctgaagccgagaatggaagtgacttgcccagagtaaccagagagtcaggcagaacctagactggcagtcaagtctcactccagctgcagctccctgccgggacccaaggctggtcccacccacaaaagggcgtgaaggagtgagccaccagacgccaggtgtaagcgtacaggcgtggatggctaaatgggtacttcatttctctcgaaactgcttcatcacccgcagtgctgaattctgtaccccagggcccaatccaagctgtgtggggtcactggccgtccgggaatgggcataccgcctggcggtcggggtgtgaacagcaggggacacacacacaagcacatacacttgtcccaaggcaggaccacacacatagctgcccccagacgagaccacgtacggacggacacacacacctgctgcaagacgagaccacacacatgcgcacacacacacacctgccccaagatgagaccacatgtggatagacacacacacacacacctgctccacggtgggaccacacacagacacagacacacacacctgccccaaggcgggaccacacacacacacacacacacacacacacctgccccaaggcaggaatacacacacacacacacacacacacacctgccccaagacgggatcacacacacagacacacacacacctgccccaaggcaggaatacacacacacacacacacacacacacacacacacacacacggcagggagactctcgcttgtcccacgcaactttactggaggtgggcaggggcaagacttactcagtgacgcagagactccaagcatccaaacagtaccataggttcagacctgacttgagtatttttcacacatcctcattttaccatggtgttctaggtgtgtggctcctgctggggaggtttcagcagtttgagcagagacactaatgtagatgctgctgggagcttttcagaccttaatgctaaaaggggcttttccgtaatttttttttttttttgagatggagtcttgctctgtcacccgggctggagtgtagtgacgcaatcttggctaactgcaacctccacttcctgggttcaagagattcttctgcctcagccccttgagtagctgggattacaggcgcgcgccaccacacccagctcatttttgtatttttagtagagatggggtttcaccatgttggtcaggctggtctcaaactcctggcctcgtcatccgcccgcctcaccctcccaaagtgctgtgattacaggcgtgagccaccacgcccagccattccataatgttttagttaaggcatacaccctacaagaaccccatgaaatagatgtttctggcactcccaccaagcccagagctgccttcagaacaatccttagccctgtgtttccacagcacatgttcagtttgcaccacacgagctgagctcttgatgctgtctgtggcctggatgatttcttaaagtgcctcccactccagaactcgatccctggattctggagatgtatctgggcctcagtgtcctcactcagcttgcctttaagagcaccctgaggccaccctgccataaggcactgggatgtgagttcccactgctgtgcacgtagcagtgtgccacggtgcaccaaatggccctctagacgaaggcgggcctatgaccgctcagtggtaaagaaaatgaggagtgtggcctttgtgtccatttctgctggcaaccaaaacacacctgagaactgtcccaggaagcttggccaggtccactaagaacaggcgttcctgaggctgggtctgttgaggccacaggctcccaaaagccaggtgcgcccatctagcccagggaagagcttggtcactctggggagtggaatcacactggccttccataaggagctctgtgttcagtgtgcctgagactcaggagacagccggtgctcccacttgcgggagctggacccagtcacatccccctcctctgttaagtggaggcagccgtggcacacagtggcgcttgtggagcgctggcgaaacctgactctgaagccggggccggcgggtacagcacaggcacagagtgtggtggtctccagagtggaggagtcagactgccctgctgtgattactttccagacaagtgatggagcagcaccagcagcagcgtcaggaatctctagaaagaagaacctcggccacaggtgagagccctcctcccctagggccgactcccatgctgctgccaggtggcagcccctccacgtagatgaggcccagggacacacggggcgctctgtgagcagctatggggagcctaggtctcaaagtgcaaccaccacttcagatggtgagggtagcaagagagcagagcagaggcttggggagtctgctcagctgggtctggccactacctgccaaccttctccggagtggacattcagcaagcacctcctgtgtctcaggcaccgtgctaagggctggggacacaactatgactgcagatgcagttcctgccctcaggaagcccgctgtccactcaaggagacagtgaacccacccttgtcatgtcacgtagtgaacactgtggcaagtgacgtgcaggtgctgaaggcctaccttgggtcaggaagacttcccacaggaggcgctgccacgcgtctgtcttggacgttcggtggagcttagcacgttaaaggagaaggacgagggttttccagaaattgtcatgttcactgataggcaaaggactggataatttaccaagtgctttcatgtcctttgtcttgtttaattttctcaaacaccctatgaagtgagcaggtgactattatcctgttgactgatgagaaacccgagcccccactggttacaggaacgctctgctcgtgagatgctggctgaccccatcacccccacctagctgctgctggcctcctgctccccggccagtctgcatttctgatgcaggtctgacactgtcatcatgtcgtcccttccccatcactcttggaacagcctgtgcctgccctctctccctctagtgcctcgcaagcacttcccatccttttcctccttcctcacacttgcctccccccttcacctaactgaacccctgctctccggtcgtgtcccagctccacagtcacttccgtgaggacgtcatggaggacgtccgtcttccatgaacttctggccaggctggagcccctctttgtatgccaacatggcgccgtgtgcctgcccttggtaacacttgtcagcttgccacagtcctccatctgcgtttacctctgcgattcgttgactgttcctcataggctgtgagcaccctgagcagagagcttgtggctggttttcctcagcaccatacccagcacctagcacagtgcctggcacaaaacaggcttaggcagcactggcggaaggggctggatggatgatgctggagcccagcactcggcattgcgccctgacccatgcccccagtcggccctgggacccacaggacctgccacggcccccaacgacccaagtgtcagtcacagttggatcttggtgaccaacttctgcctagggggtgctaggtgcttagaaggagcagagaagagaagaggcacagactgtaaccagacagcttcctctccccctggaaaaacatgattggagcaagaggaaattgcctgggctcaaggaatgttaagcaaatagaggacacctgtgggtccagccaggccccggagtactgaggacaccagaatagggaataattgtgccagagccaagttcatcccgcggaggcttcctggatgaagcaggcctggagctgtttctcatccctttggggagcagcctgcccctgtccttcctccggggaacctgagctgagagcagcaggcttggcccccagctgggtgctggagctggctgagcctcactgttgtgtttcagggcccatcctcccaccaggacatccttcatctgcagccagcgcccccgtctcatgtagtgggcctccaccgccccccccacccccagtcccacctccacccactggggctaccccacctcccccacccccactgccagccggaggagcccaggggtccagccacgacgagagctccatgtcaggactggccgctgccatagctggggccaagctgagaagagtccaacgggtaagagctcctgtgtgcggggtgggaatgggaccgaggggacccttgtgccatctgcagagcgcttgtgttccttcccgcatctgcgagacacagcaaactgcttccctgcccaaagctagctggcccttggccacttgttctcaaacgagaaatcacatgggacagcactttgaaattatgaagttagcctttgagcctcacgttgaccttcacacgtggggcaagaactatgtccccctttagagatgaggaaattgaagcacaaagagcacgagtaatttgctcaagtcacaccgtttacaaattgcagattttggactcaagcctgggtctcctgaatctatgtccattgccctttccactgtaggaagctgtatgctggcaactaggtccacccggctgtttcttccctaacccttgctcatatgttctagaactgtgcttgtaagaatagctctaatacagacctttggcttacattgtgtttccttcccacaggatagtctcttctcccctccctccctccctccatgtgtcatggctggtcttggcaaagacactaaccatgagtctgcaggcctggggagtgtctgcgacttgtgtgacctgggctggtccttgtccctctctcgattctggttttctcccctgtggggttggagaataatggaccagatggcccctgaggccccttgcagtgctgctgccataggattcacacgcacacagtcccctgcatcccctcacatcgttgctgctcctgttctgccatcagcagcagaatctaaaacgcggcctcctttttcctcagccagaagacgcatctggaggctccagtcccagtgggacctcaaagtccgatgccaaccgggcaagcagcgggggtggcggaggaggcctcatggaggaaatgaacaaactgctggccaagaggtgggtctctacacctcccgagacttggtgtgcctagcaggaagctcctgcccccgcccccagcgctgcacagagaatcctctcttgaccccagaatctttgttccctgggtttagccaagcaggggaaactgttacttaagttttcccttcccaaggggttagtctgaagcgcaagcccacaggagtcctctaaactccagatccttcattttagctcagcaaatatttcctgaagcatctaccatgtaccagccctgtcctgagcagagataaatgtggagacaatttcagagataaatgcgggaaaaagaacagtccttgctcttaagatcctaacagaaataagatgtggccgcagtggtcgagtttgcagaggacactctggtgaatgtgtggtgaaggcaccccattctccagggttctttatggaggactcaggagaaggagttatgaagggtaggagcccagagggcattgccctgagcgacggagagagagtagttccatctacatcccggccgggctcttgggcctgagacctggccatgtgtgtctgctcgctgcagcgggtgtggctgcagcctgccattgtggctctccgctgttccccaaatgaaacccgagcagatggggagatcgtccaggtctttctcaaaagggatgcaaagcttggattttatttttaaatatgacttggcatcaggaatgtgctcaccttggactaccaatatcgtggctcacttaggcaccagagggcacgggagtaggcctcacctgccagaacagaggaagctgcagcgggggccctgctcccttggtaaccccacctccaccccctgccactttgtcgccttctcctggccctcccagctgccttccaattggctgacccaagtgagaactctgtgtgcccagggtcttcacactgcagtcctagttcctctcattaccttcccgtggctccatgaggatgatgcgagatgacagaggcccacagctgcaggcagctggtgtggcgcttcatggcagggccacagcctgggtttcctgccaaggggctctttgcttgcatcacagatggcagggaggggaggctccccgtgtgtcagggagcagcaaggtggatccgcagcacgggcgtctccggagcctctactgggcctgggcgtttgtacatcgccaagacaggaggcaggcttctgagcagtttcctgtgagagtaagtccaggtgtgtggggcttacagtggccacacaaaggcgaatggctccgtgggtgagagagccgggagggctcgcagaacgatgaggacgtcccgtgctgtaagagggacagtgggcagagttaaggtaaggctgggaaggctgacgccccctgtgcctggagagctaggtgtggaggaaatggaccaaaagtcaggctggaagagggagcctcctggtgcagggcatcgggttccacctcagagcactcagaggcgaggatgggccacagagaaatagaaatagttttggaaaagaaaatatgaatgctttccctaagtcctagaccaagctgaggggaagcacctttctgtctgagaacaggaaaaggccagtattgccaggagccagtgagatgccagatgccggtgggagagtcaaggccctcccaagaacaaacatgctttgcatagctcagcagggatcaatcaggtgctctctgaaatccacctcagtgatggctactgggtggagccgacgatgaaagtgcccttgccaggtttcttttcatgtaggttgtctcccgcctctgagggcatgcagttgagtctcccaacagtggagggcaggagggaaatgaacgtggacagaaagctcctgttcagcagcactttcacagacactcatcccgcctacactccccgtgagcaggtggcttggtcagcgttctgtttctaggagatgggacactggctgctggggggtagctggtgaggtgtaagtgatcgtggctaggccagttaggagactctgacagtccaggaagagatgataggggcatgcaggaaggtgttgaaggtgaagacaaaaaagacaggcaggtacccagatttagagaactgaccaggctgacagttataagaagctggtgtcagggatgattccctggtttctgggctgagggacgaggtgggcagacctgtcctgagatgggagctaaagaagggggcccctgctgtagctgaggaggctgccaggtaggcccatcacagacaggtgacagcctggccacggcccattatcacacctcagaccagctccatgcttgatgggcagctcatctcaagttgaaaagccacagaagcgtatctctgggaaacactgagggtctgcctgcctctgtagacctgggaggtcagcagataccactgaggccaaaaaatatgggtgaggttttagagtacatgaaacggggattcatactggggaggtgcacgaaccgactcaagggcgtcacgtggacctattccagggctcctcttctgagcatttccaggctctgagtggcattctagattggggagggcgtggctgggttaactgagttccaagacacaagggccttagagtgacacaagaaagtgtccagtgtcccgacctgtgggacagactgcagcccagagagatgcctctctgtcccgtgtggccaggccttcagtgtcctggggacagagcgtgcccgcctcccctccacgcctcagatgctacagctgctgccagtagagctaaacagacatagaggcatctcgccctctctgcctagaccagttttgtgtcccaggccatgaccacacggagggcctggacatttgcctgggcctggctcctcaccagacggggcctagacaagccgcctccttcacgccatcgttttcccacacaggtttatctgaggaccggggtgagtctggcagggtggaggcagaagagttctgggacagtgagagaacgtgaggagctgatctgtatcttccccttctctgtgcctaggagaaaagcagcctcccagtcagacaagccagccgagaagaaggaagatgaaagccaaatggtgagcaagcagcccgccccaccctcaggctccccactgagatgagcgcatcgccagggaggctctctggtctcaggcgaggcctttgggacatgcgtgggatgggcgcttcatcaggtgattcacaggaggggcggagggtctctgcggtgcttgtccctgcgccaccctggccccagcagcaggcctgccctcactgagcaccccctaccagacactgctccacccttggagctgcagcctgaggcgctggccgctgcaccgcagggctacctcgccttcccaggagccccggggagcacagaccagccagggtctcggcgggactgggactccaggagtacactgcagaggggcacgtctgccagaagcccagagaggtttttattttcaaattatttctgtttctaaagactcctcttccagcaggagcttcaggtgagctgtggcaaaggagccctggacccctggctcttgtccttaccaggcagcccagagccagcctggctgccagagctcccaacatctgcttccagttagggcggctaattctcttttcctccatgttaagcttttcctataaaaagactcctactgacagggctaagtttagccttaactacaaatgccttgaaggttccacctcagtgcagaatcagagaggaaataaaactgccagggaccagagcaggcttcctgccctgtcctcccatcagtcagggtcatgctggtgttaccctgaggctatagccctcccagctgatccacgcctctcagccccgtcctgggcacatatgggtccctttgccccaccagccaactcccattcagcctgcacttccctgcatcacccttacaccttaaaaaacagcctcccggccggctcaacacttcacacttgtagtcccagcactttgggaggccgaggcagacggatcacctgaggtcaggagtttgagaccagcctggccaacatagtgaaacgtcatctctactaaaaatacaaaattagcggggcatggtggcgcatgcctgtaatcccagctactcgggaggctgaggcaggagaattgcttgaacctgggaggcggaggttgtagtgagcagagatcgcaccattgcactccagcctgggcaacaagaacgagactccgtctcaaaaacaaaacaaacaacaacaacaaaaaaacagcctcccgacccccaggcctcacaaagctcctcactacttgatcccagccccggtcttctcccgaggccctctgcacaggcacgactgcttgtggagactcgttgtctcctgccagatcttaggcccttggagggcgaggcctgggcttctcacacgtccaccattcccataccttgcacatgctgtggagtttagccaactgacttgccatgaatttctgaaattgcaggccacgggataatcacagacatcaaaatactgtggcctcgctccagccacagccctggggatctgaagacatcgctggcctttcttagtcaggtgccagtatgttgcagtcccagcccctgaaaactaaaactctcgctcctggagctctaagaagaatggatttcaaagcccaggggcttctggaagaggaacattcttgaaaccttcaaccccaaggatagcactctcctcctcagacccccatcttttctgtcttgtttttcacaggcccctggctacagctggttcttgtttgccatggtcccttctcatacccaggactagcgtctaaagagagcagggccttcagaagatccacacaccacacaagtgcagtgggagggagagaggctgatggccggcactcgttttcttgttcatgcttcctggtatttccccaattctctgcagtgaacatgcactaagtttatcattaacagagaagaaagaaggcttatttgaaagacgaaaagagccccaaatgtggagtccggtgacttgggcaggccctctgccatggcagagctggccctgggccaatggagttactgctccgaggaccagttccaccacctgaaaacctgcacccaggcatggccgcctcacagactgtgcgactgccagaggtggggtgcaagtctctgtgcccagggcctgggagtgctgcggccacctctttcccagcctagagtcaaagcataacttcccttttaagcagggagggttttaaaaaaataacatacaagaaaagatgataattttttagtgactctgatgtcaccctgtatcgctttcatcgtggcccccacatgtgtgtgttgattgacataatctgttattcagctgtctttaaaatgaggaggcctgagaacctcatcccagcacctgcaggctggcacctgcttttgcctctcgaccagagcctcccgggacttactcgttcaccacacagatacgcagggcgttcctgattctcgtgtggggatgtagtgagcagaggagacaaagcaaagacctctgcccacggtgacaagggagaggttctttgcttcagatcagaatgacacatcaggttgggtggccgcctgtcaacagctcaaatgctgtgcattctgcttcatcaagtggaaggattactcttattacttaatcagtggcatgttcctgatgctgaaaaaccatcctgacgcacatgccatgcatgatgagtgttaggtgtccccactgctggatgaacacgtccactgttcgagcactgccacagacctattacacgggcaggtgtgtgtgctgcacagggggagcaggccagtccacggggtgctcatgagaagtcagtgagatgacatacgggaggcatccggcccaaggggggctcagggcttgcgggtgttgagggccagaaggaagttctatatcaccctgctgagagcctgtagctccctgtagccttccccttccccagctttgtccactggctcgattctctccccactgagattttgcgttttcacttttaaatatttaatgttttgctaattataaaagtcatatgtgttcattgggaacatttggaaaactgaggttttatgaagtgtccaatgatgtcctgccctggccccaggtggccttcctaaacagactcccttcttctccattttaggaagatcctagtacctccccctctccggggacccgagcagccagccagccacctaactcctcaggtgagagggcgccccccgctgaccccagtgaggcatgaggtctcagagtgggaggggggacccttcggacaggaccctctgatccagcctctttagtatgcctgagcagagggccaggccacagggaagcccatttcttatgggtcccccagagcctcccccaggagcccatgtgggagcacaggaagtgctagagcagagccactgtgatgggtccccagggtgacctgcgtgtcaccttcccaccaggaccctgagtcccgcacgagagaaggcacttgcctgacggcacatattcagggtgggagtttgtgtccagggctcctgaggcaggctggggccagtgctcttaagaggtatcagtgtcaggactcatgtctcccagtgaaacgccagctgatgaccgacattacagagatggcagtagatctcgctccacccaaaacgcagccccttccctggctcaggtttctctctgtctaagctgtggcagatgggaggtagttaggagagtatgatgaggcttcgcaggggaggaagaccccagggttggttgttcattcgacaaacatctttgcagcacctgctctgtgccaggcctgtgctcatgagcacagcgaggagagacaggggcatcaggctgccctagctgggcagaggaggctcttgccagctgttcgcgtgtgtctctggggcatgctcaggttgggtgtcgcctccctgtgaaactgcacgccatgtcctctcctcctaagatttttgcctggtgtcttgatttgccaggatgcataggttcctggctgatgaacgtgatcaatacccctgccctgtttgcttcttccaacagcccagtgagtgggctacgtggttcccatctgtgtgcaaagtggtttgctcaaggccacacacctgggacatgtctgtagccccaggtctagtgcctgcaggcccagcgcctgtcccagaaggtggctttgaggaaaactgcctcaatcccaccgttggtccgcagggtgccaaggcttagctctgggccaggcagctgccccactaccccctagagattttgtcttctgcctctgcttgtcctgcacagtcaacgaattcaagttaatgcaacaaatcttttggagtagaacaaaatataatccaataccacttaaaaaagacaagccagccagaatgggacagagccaggcgcagcatgggaggcagactaaggagcccctcagtagcaggtgccgggccgaggggcctggccgccacaccacacgtgggagcaaggctgtgctgggatgtccggggaggtcgtgcttgctcgccctgtggctctagtcactgggtcccttaccagcaggctcacattccagagagacctggcacagtgaagggctcagaaccagatcacaggtcagggtcaacctgacctaggccatgggggactgagaacaaggtgccaggttttggcttaactcaatcagaccttcctgccacggggctctgcacccttggcatgggtgagggcttcctgttggggtgtttaggggattggggtggctactgagtcccttcacctgtgaggttcttcatccatgaaatgaactgacagaggctggccggaagccctgggagcggagcaactcggtggagaagcctgtgtcctcgattctgtccaggtgagctgccccaggaaggcctgagcagcgaggctggtggggcagaggcgggcgctggcgccgattcacatgtctgtttcattccattgccgtagaaccccgtctgtggcaaagagccccgaagctaagagcccccttcagtcgcagcctcactctaggtaccgaacaaccctcctgctcacatgtcccccagggtttggggctcctctgtcccccgtcccgtgactaacacccttgcacgctgtctcacgtcctggcatttaacaacttgctctgcgaaggtggtctgttctttcagacccaggacctcggggtcctgtcagtcagctgctccgtcttttccctctgagagagagaccaagggcaaggagggcagtgacctgtccacagaggtagtgcaggggggggccaacatggagtcccagctctggactcactacgtgtgacagtgggcaagttaggggacctctccaagcctctgttttccccccacaaagtgaggtctgttaacccctgctgcacagggtggtggtggggacagctgtgagcaacagctggacatggggtgtggtcactagccagggctgcaccctacagttcaaccagtcctagcactggcgctgagccctacccctttcctccagcccagagtccttcctctgcggccggcacacagaatcagtttccccacagacatactgaccatatttcccaagccaaaagctggcatgacaacatgatagaatatttggaactgagattgcccaaaaaggcagaggcagccagccacatagtatctggaggtacatgtggcctgaattggaaggcctctagaacctgcgtcaagaatgtctccatcgccaccacaaattgaagggaaaccacccttatcacagagcaggaggcattgaaactggccttgcagagctgaacaggtggtgagagcagagcagtgcaggtggacagagatgaggaagtcttagcagtcagctggggtttgtccaaggcttgtggtcagccaggccgtgtgctggggacagtccctgcctgcaaagagcaccgtgtgaacaaggccactgtggtcctgaggggtgctctggacagggtgcagggccacatggtggaagggacagggtgctttgcggagtggggtggggcaagcctctgtcgggagctggcattttcgttgacccggacgaggaggagtctgctctgcggagatcatggggacagcctcccaagctgaaggaagggtaagtgccagggccctgagcctgcagccacccgccaagctcccccgcacctccacctggaagcagacaggccatggggcaggggaacgggaagggtgaggaagagggtgtgggggagcgcggagttagaagtttgcattgtgttcatgcgcagggcccagtcatggaacttgaggcacagggtgccatggtggaggctgggaaggggaaggcaaccagagtgggcaaaacgagggccctggagcagacacggcagcaaggggagcctgcagcgctcccagcggactccgccacgtcctgctggtggagcaaaggcgggctgccatgttgtgagtggccaagggtcgctcactgggcaggaacattgtcaaggccattcatgcttggaatagggtctctcttcagctctgaggcaaatctgttctctaattttcagatgacttcaaggggaacgtgtaccaccacccctctggtgcgtcacattgcttaggaagcctgctgtgtttatcactgggtggctgtcagggctgagatggagagggccagggcctggcgaggtggagcagtcggcccaggtgtcccagcaattgttgctggaacagggtctggaacccacaggagaggcctgaaggacccagggccctctggctggatgcgtttgcctatcaggacccagaattacttacagacctgtttagggctaggcttggcctctttcttgagctcatctggaggggtgtggcaacactcattcttcatccttattctccctggctgtgggcaacactggtcctcagtgtcaccagatggtcctcctctgtgcccatgacccctcagcagccaaggctggccctgccagataaatgtgtgtgcccatgatcacacccaggggcacaggccacatacgtttccctgaaaccttgggctccagcctccatcccgtccatgtgggagggaacttgggtcccagcagtgtgtctttcagcaccaagtcatgtttaaaagaccagagagacaagcattttgccaagatcttccagggaagatgcatgtgtgacacattaacattcaaatcaggccagcgcggtgctcatgcctgtcatcccagcactttgggaggccgaggcgggaggatcacttgagcccaggacttggagaccagtctgggcaacacagtgagaccccatctctacaaaaagttaaaaaagaaaaaaaaaagggcacatgtctgtagtcccagctactcgggaggctcacttgagcctgggaggttgaggctgcagtgaggcatgatacgcctctgtactccagcctggttgacagagtgagaccctgtctcaaataagtaaaaataaaattcaaatcggttaccttagtttggaaacttttcaaagaagtagtccacgagaactaccttgaaagagcaaaaccagccaggtgcaggggctcacgcccataatcccagcactctgggaggcccaggtgggtggatctcgtgaggtcaggagttcaagaccagcttggccaacatggtgaaaccccatctctgctgaaaatacaaaagttagctgaaaatacaaaagtggcacatgcctgtaatgccagctactggggaggctgaggtaggagaattgcttgaacctgggaggcagaggttgcagtgagccaagattgcgccattgcactccaatctggggaacaagagcaaaactctgtctgaaaaaaaaaaagcgacaccacatgggaggatgtttcttgggggaggtgtgctatgcccgagcaggctccagcaccaggggcgctggtgtgtcaggagcgcgcctccaggccggtgtgaactctgcaacttcacattgtgcctcctgccgccgctgctgcttccccgagccccaagctcaacctggagcatgagctcccaccctgaggaggaggctgtcaatactgtgtttctttccagggaggcaacgggtgggtgcgatgttgtcacttaagttgccacctctgcataagagctctctgatcagaaagcagtttctttgttgaccccagccagccttggctctcgggttgggaaatacagtcacggtatccatggagacctcttgaggtggagacgggcgttaaatccttctcaggcagtctgaggtggccagagtctgaagcaagcagcctctatggagcgaggggagcaggtgggcccagcctgagcggggcctctgcacagccagctttcccccacacctgtctccagccagggcacccacaggccctttctctcccaggatgaagcctgctgggagcgtgaatgacatggccctggatgccttcgacttggaccggatgaagcaggtgagcatgccctgtgcccttccctcaagaggctgagggcagccagcaggcgggggaccgtctctgaccagcatggccaggcaggccctgggggcccacatgtagctgccaaaaggccagtcagggagcagccacggcagaaagggggtgcccaagcctgtcctttgtccccagcccctgccatcaccagaactaggatgtccctcaacctttctgggcacctccctcaggcctgcctctggggctttctgccccgaggaagcccttagtttcagtggcgtctacctgagggaggtggcagcaggattttcccaggcctcccatgccgtcccccctcagcgtgggaagggggccacgaggagacaagggtgacagatgcaactctggagaggcccaggagaccccaagccctttggacatggcccagcccaggccggcttttccgtctccactgcctgtcccttcacctggacactcctctcccaacaggagatcctagaggaggtggtgagagagctccacaaggtgaaggaggagatcatcgacggtgagtgcagccccaccggggagggtggcacccaggtgtggccgcaggacaagggtccctgtcacccaggctgggggcctccagttttgagctggagcccatactgcactgggccctgtgagagatttcattcttaccatctctagttgaggaaacaggctcaggaaagctgaaagctaagtggcttgcctaagaatttgtagctccctggtagcatgacacccgaatctgaccttccacatccccggcaccttcctggaagacccacgtgggaagagcatggaggggagaccccagcatcgttccagagccaggtctggaggagccacctgagctgctgtcattccaccccctggcggtttatactgccttcttgatactgccacctccagtcactggtgttgggcttctgaggtgaccactctgccttcctgggggtacaggaagaccaaggtctacagaagcaccttccaggcttgagctcgttcacagcctgcctggccctgggctggggaacaggcagggagcagcctctggctccagagcagggtgggtctcaatgcatcacatccgtccttccggttcccagcagagcctttgaatgctctgcctcagatctgcagccagaggaaaagggggagtgggcagggcagactcagtctagggacgagctatgcagcacagccagtgccagctccccacgtgcctccccaaccagggtgataaaggctgacacctgggtgtgtagctgggtctggcccccagggcatcacagtgaccggggcaaaagggtcccacaagcgcacaggggtggaggctgatggcagagggaagaggcaggtgggagcccaaagacccaggcctcctcccccagccggcccacccttgtttgagcagagagcactcagttcctgtttgtccagttcccccaaaggcctgggctggggagataaggagttaacaaatgaggggaatgaggcagcctgggcgataggcaggcactcagccaactggtcacaccgccttactgctgggtgccgtctggccccaggcatagctgggtcagaaacccagggcccaccacagcctctccacctgctgtgggtgcagccccaggtggaacccaccctggctgagagcccgggggtaggcatgggccataccaggggctctgagaagcagctcccatcccccagcccccacaaccttctcctggctgttggctcttggcccagcaaggtccatccagagagaggcctgagttgacatagaggagggggagtccgggaggggatggataccagaggaaggagggaaaggcccaaatttgggaggccgggggttggagcactagcttggggtgatgaggaagctggggggaggcaagagaggaccctgcctctcctgaggagtgagcagagccagggcagtccctggggtccagggccaagatttcctgctgacccctgcaggagctgggagggcagagcctcagcctccactatgttgggggaagggctcccgggcccccggcacctggacacccacctgtccagagcctacagagaccctgcgtccccacacagcagctcctcacaccagagttctggtgcccagcactcctcagcagcagtgaggccacaggcagggcacaggcctctgtccctacgccaggtcctcccctaaaagggcagtggcagcaggggccgccgcagaaggaatggcagatgagacccaaagcctttggtcatcaccccagaggtctatgccaaagcctgggtggggctcccaggagatggaacagggacacataccaggcaggtccacgccaggggtgcggggccctgatgaggaaccgggctgcactggtcatggctgcacctgagccgccgccacctgtcccgcagccatcaggcaggagctgagtgggatcagcaccacgtaaggggccggcctcgctgcgctgattcgtcgagcccatccggcgacagaggacagccagaagcccagccagccccagactccagtgcaccagagcacgcacaggagcctgggcgcgctgctgtgaaacgtcctgacctgtgatcacacatgacagtgaggaaaccaagtgcaactcctgggtttttttagattctgcctgacacggaacaccaggtctgctcgtcttttttgtgttttatatttgcttatttaaggtacatttctttgggtttctagagacgcccctaagtcacctgcttcattagacggtttccaggttttctcccaggtgacgctgttagcgcctcagctggcggtgacagccggcccagcgtggcgccaccacacaccgcagagctgtccaggcacagctccgtccccagcgctcatggtgttgaaactgtctgtcatgcaccacggtgtctgtgtccacacagtaataaacggtttactgtccgcaccctcgggctcaggccctcgcattggtccatcacgctccgggctggggatgccccttttcagagaagggcccgggaccacggtgaccaggagtcgtaggagcaagatggcggtcttcgacaggaagctgggctcagaacattcccaagccccgggaagg

SEQ ID NO: 12027 - DNA, 188 bp, Homo sapiens
ctacgggatctccaggaagatggtccctcaagtgcaacccacacccccgaacctcagaggactccacgtgcattctgacgggcagggccctgcgagcgtcctgttcaggggagggatggacttggggcttagcaggcaccaggcaaatgcaaggcagctttgccttctcctcggccccacaaagtctc

SEQ ID NO: 12028 - DNA, 779 bp, Homo sapiens
tggtgagatggactttctcagaatatgaggactgcatgcttggcacactttaaatgtgtgtttcatttttaaagaggattaaagccctcatatggttcttttcctttaaaaaattattgaaggcagcacaaattggtaatacaaaaaaatatggacatgaaagctaatacctaaatagattaagcagttaacagcagtacagacaaaacttaatgaacccataaaatagaatgtggcaattcacattgaaatgatggaagttctggatgaaatacacagaaaacataggcaaggaaaatagtcaaaggttttcaaaactggaagtggaaacaaagatctcagccagactgttaagaaagtgtatagagtgcctctcagcataatgttcaaagatagacatccacttgtcaatgtcttaatcacagagtaaaaatttattttagaaaaataaaacgacaactttactcagatgttatagaaaagatgccaggtgcggtggctcacgcctgtaatcccagctctttaggaggccgaggaggatggatcacgaggtcaggaggtcaagaccagcctggccaagatggtgaaaccctgtctctactagaaataaaaaaattagctgggcgtggtggcacatgcctgtagtcccagctactcgggaggctgaggcaggagaattgcttgaacctgggaggcgtaggttgcagtgaactgagatcacgccactgcactgcagcctggcgacagagcgagactccatctcaaaaaaaaaaaaaaaa

SEQ ID NO: 12029 - DNA, 137 bp, Homo sapiens
agagttcatgaatcacgctgtatctgctcagactctagtgacatcaaagtattttaaatgaacaaaatgtctttgggaattctgctttttggcaatctggacccttctgtctgcactgtgtgtctcttgtgcaactt

SEQ ID NO: 12030 - DNA, 252 bp, Homo sapiens
gtcttcagcatcttataaagggaggaatggtaataaatggccacatttattcattcaacccatactgagcactaaccctgtgcctggccttgttctaggcatgaggatatggtggtgaacagtgcccttgtggagctaacattttagttggggaaatggacaataagcagatctgtaacatagtgttaagtcctacaagaatggaaagcaggatgagagacagtggcaggggtgagttcttttacattatga

SEQ ID NO: 12031 - DNA, 1230 bp, Homo sapiens
attttgcccacatgaattattatttctttttcaaagttacaactttggactttgctatctttcaggttttgctcgtaatctgtcagaaggcaataatgctaattacacagagtacgttgccaccagatggtatcggtccccagaactcttacttgggtgagttaccgtcccaaaatagaatgacatttccacatctgctgattctattgtcatttgctttgagttcatctatggaaaataagaacttcagttaattaaatgtgtcagttacatattgcagtataacaaactacctaaaacttaatggtatgaaacaagcacctttttgtttgctcagaattctgggtgtgggggaatcaccagtttgagttcagctggatggttcttctactggtctctcttggagtcactcacgaagttatagtcagctggtaggtcttctgggagctggttagtttaggggtctcagctggatcagaccatctctgatccctggaaacttatcctccagtaagctattccaagtttctaagtgtgatagttggagaattctgtgctattaagagggtaagccccaaagcaacagcagctttcaagcctttttttgtatggcttttgcctcgttggccaaagcatgttacatgaccaacccctgattcatggtatggagaaataaattccatctcttgatggggcaagtggcagagccatattataaaatggtatatgtatggaaatggaagaaattaattgtagccatctttgctaataaacttccacattaagaatgtgaatatccacacagtttgacattctggcttatctatttgttcatttattaattcttcaagtacttatcaagtatctcttatgtccaaccactttgccaggcacatagagtaaatattgaaccagactgagcacagtggctcacgcctgtaatcccagcactttgggaggccaaagccagcagatcgcttgagctcaggagttcaagaccagcccgggcaacatggtgaaaccccgtctctacaaaaaaatacaaaaattagccaggcatggtgatacctgcctgtagtcccatctacttgggaggctaaggcaggagagtcacttgagtccaggaggcagaggtcgcagtgggctgatatcccaccactgcactccaacctgggcgtcagagcaagactccatcacacacacacaaaaaaaccccaaaaaacaaaaaaa

SEQ ID NO: 12032 - DNA, 351 bp, Homo sapiens
gaaccccattcaaaaatacaaatatttcttcaaagcgtgtcttatgaagaaacattgattatctgaagttaggggttttgttttacgctgggattgtttttattttttaccgtttcattttaagaaacagtattttccatgtctcaaaactgacgtacaccttgatttttactcttaattttaatgttctgattctctataactattcacagtgaacctatgttgtgtttggtgagttagatgggtgattaacttatcctcctgccttattttgtggctatgcagtagccctaaaaccttttcaaagggtgggggtaaaagtagtggtagagtctgtaattggtaactaag

SEQ ID NO: 12033 - DNA, 7736 bp, Homo sapiens
  misc_feature (6435)..(6435): n equals a,t,g, or c
ccttcatttaaaatcctactaaatctctgttgttccatctgactgccaaagccccacatatgcacctcctactgttgattccagaaaccaatttatgaataaaatagtttttaaaccacaagtatttaaaaggtccatttaagcttgaggtttgaggctctcaagaaaaaaggaaagagagtgtacacattgggtagaggatgctgacgaaagagatagaacaaatcttggtgtctgggtatttcagtttggaaaacagtatataaatttcagtttgaaaaagtctgcttgacaccttctatgtaagcccaaaatactagagtatactgagtaacgattaacaacttgtatttccataggtgtggatgaggtcaccattgtcaacattttgaccaaccgcagcaatgcacagagacaggatattgccttcgcctaccagagaaggaccaaaaaggtacaggcaattccagggatggagggcatttcttgttgaatttttgtttcctcagacattgctttttcttttcatgaattgtggctctcatgcgcaaaagacttgtgggacccttggatatctaagattttcttcttaaatccttgtaagagtcactgcacatgtgtgtgtgcgtgtcgcgcgcgcgtgcacctcaggtcatcaggcattaggttctcataaggagtgtacaacatagatccctcgcgtgtgcagttcacagtagggttcgcgcttctgtgagaatctcatgccaccgttgatctgagaggaggcagagcgcagatggtcacgctcgctttagagtgcttgggagctcctgtgtaaggacagtaccctcccccaacccaggctacctggagggagagcttctgggaatagaaagttaggaatagggaacaacaacaataacaacaacaggcaccatttattgagtgcttactttgggccaggcactgtgctcagttttgtacatgtagcaactcatttcatctttatgacttctgctggttcttgataagatgtttctaatttaattttaggatactagcctccactgagtgttgatcctaacaagctcctctcattttaaaaatatacacttgaattcttaagctttttgcaacgagtgggcttagttgttagttcatttggtctgcaaagctatcttcaacatgccatgctcctactatttaaagggtctttgtgtgctttttccctttgcttgtccactagtggttaagaaacaaccagtgcgtgttcgtcctttattttgtcagttgtaggaaattttatttttaaggacgtgctgctttatttttaacttcttgctattaaaagcttttgatttattcttggacagtgcagtaagtgtggcttcctgcagctcccgtttgacttatggctttcacttgtagccacagtggaggtgagctggaaggattctagaagagatatttctgcccttgggattgacatgaccagcagggtcctgggagttgcaggtcaagccttgctacacttccatcccccgcactctaaatggttggaaaggacataaataggaaagcatctggcttctttcatctcaagtgcattaaaattcttctttcactagaagtgtattaatcttgtgtagtgaggcatagaggggagtgttttatttctgcagcttcccaaaggggtctgtgagctggtagagccaagttcccagtggagcagaaggctcatctctggatagcaagcaaaaaatttgatctttcagctgtcacagagtatggtcttggaatacatttgggtgtgtacacacacacatagaagcctgaaacttttttttttttttttttttttttttttgtgacagggtcttgctctgtcacccaggcttgattgcagtggtgtgattcggcttactgcaacttctgccatgtggactcaaatgattcatctcagcctcccaaactgctgggattacagtcataagccaccacacccaaaacctagatcttggttttagattagatatatgtagaacaaagctcccacataccctctaggagggaagatattaccagaattatgatgaggtcccaagatctcacaggctttgctgtgtgctggggacagctcatcatcctactaattcttgactctcagccttaggccaaggagaattatgtatcttttataaaagatatgtaaactacttgagatagtttcaagtgaaacaatcggctgtttgtgaaataaagaagaaaatttgtgaaataaggaagatttgtgctgcagagttctttagggatacgggctgcagctgcccaggtgatgagcttgaagaacctaggcccggctggcagagtggagaggagctgggagagacagctgcttttacgactctttcatgttctagcagacgccagatgcgaggcttctccttacagggaagggttatgtttgatttatcatacatttctggagtttttgtttagtttttgttaaatgcaaagctctgtgctggacattgtgagaaacaggaagttgaacgcccataaggagtttagaatagaagtggaagaagtcagtaggtgcccaaatgctatttgaggtttgaatagagaatgggtagaggggagtgtcaagggtaggctaagtttggagttacctaacctcaaagttccaaactgggagactggtgttataattgggagctactgcttttacagtcccctcctaagtgccgtgtgttcccgggacattgggaagcaggagaaaatgggtggtgaaagccaggtggcttctaagatccatgtcagttctaacacttttgacatctacgaatgattcagcatggttgtctctgaagcatgctgcaaatcacctctcgtagcctgcaagtacctgtaggggctaagctttgtagatgccacaggtgctcttagaaagcaaggaaagaaagaagagagagaagaaaaaaaaaaaagcgaaaagaagaacattatttcagtaggaggcttcagtcatcagccatgatttgtaggaagtttagctcgaggaagcatcgctaaaagacacattgagttggggtgtctgtctacatacatgggtgctgaccagacctctgacaaatttttgtgttcatggtgacagtggatccaacccttaagaaattacatgcagcagggaattcaagggggccagttcgggggtgttagtttcctatcacttccattaaacaccgtccgagtttggtgtggacaaggagatattttctcagtattagatgaagtgttttgcataggaaagtttcatgacctcacttccaactgtgttgcggcctctggttccttctggtgactttgaggagtgccgctggaatggctgcccccacgtcttttacagtatatcgggaggccacaagatctgcttgccaggaggctgtctgctcaaacatctccttcttagcaggggccttgatctccgaaagcgtcctgccttccacggagtgttactgctttcaagcatattgcaaagtgcctgcactctcacagctttcttaggaatcacatacgactccagtttccttttattgaccggggaagacggcaaaattaacttggattttaaggaatttcgttgaagcaaagcctgatgtttatgtttctgagatgtgggtctgttgaagggaatgcagttgagggcgtttgacccaagactccggagtggtcaaagactcacaacctgcttcacaaaaagatccctcttacttttgttttactcactagttttaaagtaaaataaatattttccttatgattgcctgttatcttgaaggaacttgcatcagcactgaagtcagccttatctggccacctggagacggtgattttgggcctattgaagacacctgctcagtatgacgcttctgagctaaaagcttccatgaaggtaaatgcatgtgagatgtcatctctgtcaaatctgctattaattttgtgaattacagctttctgagtgtaatttggtgattttcagttttgttgaattctcatttggaaccattttttaaaaatgaactgaagttatatgtctcaggatttgtaccaaaaatatttcaattacttgttttaagactgtaaagaaatttcatgatgctgagaagtcagttaccagctgctactactcagcacctgggcaattggaataccatttgggaaaactacttccttgattacacttcctcctttaaaaagatatgttgtgatattaaggcaagaaaaaaaaactcatagcttttgttaagtgaagcttgcaaattctgcccatcctttcgtgggtgtttcttcctcccatactctctctgtcagtaccatttgtttcaaattcaggcagaatcagaacatcatagtgcatataaggggtaattctggatgaagaatcgtacctgaatcgtacctgtgagaaagtaactgtgaagtctcaatgcacgttatcttttatgtttttcttttgtaaagttcttttgaacctggaattttaggttaaattaagtaaaaactgtagattggaaacctcctgaactttgtgcatacttaaaatatcaagttttttgttttgttttgttttgttttttgagatggatttcgctcttgttgcccaggctggagtgcaatggcgcgatctcagttcactgcaacctctgcctcccgggttcaagagattctcctgcctcagcatcccgagtagctgggattacaggcatgcgccactacgcccagctaattttgtatttttagtagagacgggatttctccatgttggtcaggctggtctcaaactcccgacctcaggtgatctgcccaccttggcctcccaaagtgctaggattacaggcgtgagccaccgcgcctggccaacatcaagttttatataaatgcaatagatgcacacacattaatgtatgttgtactgcaacacatttggacccttttcttagtgtgggtctgcagcatttgaacagtccgacactgccctctgctgatatacatgggtaaagtctgcgctgtagatgagggaaaccattggtcttgattttttattccgagtctgttttctctgatgccactgttcctgaattatgaacagtctgagctgtaagcctgtcaccagagctaatgtcacagttcagttgtcatccttttcccagagaacacaagagtgagggtgcttcggacactgggcatctccaaagcctggaatttgatagctcagggctgctgtaagatttgttgttaagtctctttcttcctttagttcttcagcttagcccaagctgtgctcagtttattttagcggacttgtctgagtttcctaagtagactgtactgcagaaaagacgtcattaagaatgataaaatgtcgacaacatttcatgatcctggttgataaaaatagcgctcctgaaaaccgagtctgtggacctttggaggcagggatgagtcagcctctcctaggtttcttctgaccatcaacacttcagatcagtttgtcttattttcatcaagaatctatttagttgtgattcgagtggctttactggtatctattactaggtattagggacttgaaacagacctttttgagctgtcagtcactgttgtaatctatgtaattgggcccaatggaaggtgctttaactgctgaagctttgaccctgtgccagctcttccattagctatcacagttgaatacccgtccaaaatccataaagcttgaagtgacattaactgaactatgcttaaaaaaaaatctgttttgacttctggcagtaccggtggcagtatctgccatatgttacagtagaatttgcccttgtgataggaattgtggacagtctgtggagagtttgggccgggctttggaaattgccaaggtcacctttgaatgtagacataaaaacactattggaattctcagatattaccactggtatatcagtgatggaaggaaacacatcttacattattctgcctgtcttgcaattctacaatgtcaggatataacatttctcccactgtgtgttatttttagactatatttctatcatccttgagattgaacaactgcctctcaaaatattcaaagatactcggtagtcatttaataacatttgtgtagaatgctgtatggaccttttgctaacaaggggagaatttttggctttgctggaacctctacaaatcatgattccaaaaaacaaaaagaagagccattggctcaaaggttagatgaagaataaaattcaaaattaaccattaacctgaggcttagcttatattatacaaactactttttcggggcatataaacgctaataagtttaattaatagctgacacgcttttcatgtggcgaagtttcttaaagtattaacaccaattaattgatntacatattaaacagttgtaattctacttagctcaaagtgatagccccatattcggaaagacatgtataaaagaatcctgattattaaatctggactttgatcatgacgccagctttgaaatacatgtttcattgagtccttacaagctatctgacatgctcaaaagtgtatatattaaatttgaatacatcacccatcaaattcttattccttaataaagtgttggtgtctaggtttatttggcacttcattatctctttttgcttccctaaagtgcctgaagagtgcataattatcaagcaaaaatggaaggacaagaatgaaatttttaacattaacccaattttacatttcaaagagtgcagctaaaaattttttcttaactatacctttgcctggtaaaaagacttactctaacaatgctggctgcaagtgacaacataaaatttctgtattcctttattttagcgagaattgtttaacaaagaaatttctaatctgttaaaatagtgagtggttattgtagaaagtgaaaaataataataagaaaaagttactttatctacccacagcaaaaggcaattgccagttttagtattttggcatattctattgctgcctcttcctattcactacttttttttttttttgagatggggtcttactctgtcgtccaggctggagtgcagtggcgcgatctcggctcactgcaagctccacctcccaggttcacgccattctcctgcctcagcctcccagggtagctgggactacaggcgcccgctaccatgcccagctaattttttgtatttttagtagagatggggtttcactgtgttagccagaatggtcttgatctcttgacctcgtgatctgcctgccttggcctcccaaagtgctgggattacaggcgtgagccactgtgcccagcccctattcactacttaaaaaaaaaaaccatattaacagttgaactccaacatgccagttccaccatcttgtgctctggtgaagcattttttaaaggaatagaaaatgccattactttgtgctaaggggtaggagtatagattcttcagaaggaatgtagaaagcaggatgctaacagacccaatccatgtttgcaatttacttgatggagatcagagaagtaggctaatggtggggaagcatttccctgctgatgttcgtgcttcctggttcacaggggctgggaaccgacgaggactctctcattgagatcatctgctccagaaccaaccaggagctgcaggaaattaacagagtctacaaggaaagtg

SEQ ID NO: 12034 - DNA, 680 bp, Homo sapiens
gggagagggagactcagcagcaattggatttctatgtttaccttggctactctaaaaatgagagctaaagttatagatgctacagttaagatagcaagcatattggtatggacttgctttgaaatgagcatatacattttaaaaagttatttatttttatacccagaaattctaactttatactttttgatctaacacacttgagaattcaaaatacttcctctgtcaatctgctgtttgtctttgtctcaagcgttacagttttgacctttctgtttcttcaggactcctctgattttcttcaggccaagccatttgtagtttgcaagtgactttgtaggtttagcaactctactctctcacccaagagttacctatccagttatggcaaagactgtttctttcattaaacaaagttattaatcagtcaggagagagacttttcacattctgaatttacaaactgtgctttcttaagttaaatggcatgttaggagtatttctgatatgaaattggaaacttgcagacaccagaaggcattgcttatctttgtaaatacacatgttccaattaaaataggtactaaaatattttggtggcacctcaaaactcccaatttagatttaatttagattaaaacacttactctttttaataaagttataaaattaattattaa

SEQ ID NO: 12035 - DNA, 31304 bp, Homo sapiens
agaaaattagacggttttgggtgagccagcaaggaggcaggagtgagtcagcgtgcgtctgttaacacgctgggcttagtggttctagggacctacagaggctccagggtgggcggcagtgggacctggcgcctgtgctttctgttatttacacatggctgtggtgacacccaaggggcttgcagtactcggcagggcactgagggcgaagctgtcttctcccctggtgacacccctcgggggtcttttgtggtctgggtagctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggtgagtgaagctgcagtcgtagtgaggggactagctgcattttcccaccagaacgcctcccaggagcctgggcatctgcattttctcgccaggacgcctcccaggagcctgagcacctgtcttgtcttggggcccaggggtgtggctcttcctcatgctcagatggttctcactgggagtggactgagggctttgaagccctcctcctggctccctgacatcctggggcttgtttttcatgcaaagcgtatgttgtcccacgtagctggtctcctggagggcaggccagtcctcagggtcactgtgggtggcctggggctgtccctgcacagacctcggtccccgtggtgccaggcaccctgtgtctgcagctatgttttgtcctgtatgtttccttccaggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggtagggactctttttttctaggtctggactctgggaagcccattgtgcgcaaacgtccttagtcatcaccccatgaggtggggctgtggcgcctggtctctcaggagagtccagagaggggtcctgcctagagtcactcagcctcaggtagggcccacctattcaggctcattctggagtccgtcttcatctcaggagcttcctgtcacagcaccggcctgagcccgtgtgtctgaactcaacacccgtctattcctgacgggatcattggcagcattgtgcgccccctgatgggtgtgacctggggtggcgtgtccgcctggtgggtgtggcctgggtgggtgtgtccccttgggtgtggcctggagtgggcatgtccccctgatgggaccccaatatgcatggactgagtgtgggtgtgtcccctgaagggcatgtcctggggttgggtgtccccactgatgggtgtgacctgggatgggcgtgtcccctggcgggtgtgccccctgatgggcatggctggggtggctgtgccccctgataggcgtggcctcggggtggtcgtgtcccctctggtgtgtgtggtctctggctgtgcaccctgatgggcatggcctgggggtgggtgagccccttgaccagcctggcctgggggtggatgtgccccttgatggttgtggcctcagggtgggcatggtcccgacaggtgccttgatattgagtagagcctgtcgactccatggttgtgagactggattgtgccactctggctgcttcggggcaggcactgggcaccagcccatctggggatcagggagtgcttagggggagcatagagtggtcacagaaacagaggctgcttgacgtagactggagatggctaggccagggcgctgtgtggccatccgcagggcgccttcctctccagatggcacctttccattcgctaggggacacctttcctgcaacagcctagccgaccccgtgtcaggggttgtgcttctgtcacgagacgcctgcagactgtccggtgacaacatgttacccagcatttctgccctgggtgggacgttccattacaccccatgctggtctctccacaggacctggcgcaggtggtggacgagctcatccaggaggccctgcagagggactgtgaggaagttggctctgcgggtgctgcctacgcagctgccgccctggggtgagtggcatctcgtgctcccctcctgctacgtgctgcggggagctgcacccagtcctccagaagtttcctctcataaagttgcctgcgtttttggagtcataatccaataagttattgccagatacagtgtcaggaagattttcccctacattcttctttttcaagatggttttgctatttggggtctcctgagataccatgcgaattttaggatgagtttttctgtttctgcagaaagtgctgttgggattttgatagggattgcgttgaatctgtagattgttctgggtggtactgtcatctttttttttttttttttttttttttttttttgagatggagtcttgctctgttgctcaggctggagtgcagtggctccatctcagcctcactgtaacctccacctcctgggttcaagcaattcttctgcctcagcttcccgagtagctgagattacaggtgggcaccagcctggctaatttttttattttttgtggagatgcttttcgccatgttgtccagggatggtctcgaactcctggcctcaagtgatccacctgcctcagcctcctaaagtactgggattacaggcatgagccactgcacctggccagtattgtcatcttaacaatattaaatcttctaatctgagaatgtgggatgtctttccatttatttaggtcattcttaatttctttcgacaatgctttgtagttttcaacgtataaagtttttgcctcctaggttaaattgtttttttgtttgtttgttttgttttgtttttgagacggagtctcgctctgtcgcccaggctggagtgcagtggcacaatcttggctcactgcaacccccacctcccggattcaagcgattcccctgcctcagcctcccgagtagctgggattacaggcacctgtcaccaagcctggctaattttttgtatttttagtagagacagggtttcaccattattagccaggatggtctcgatctcctgacctcgtgatccgcccgccttggcctcctaaactgctgggattacaggtgtgagccaccgcacctggccttgttgaggatttttatatccatattcatgagggatattggtctgtagttttccatttctttttttttttttttttttttttgagacggagtctccctgtcgcccaggctggagtgcagtggcgtgatctcggctcactgcaggctccgccccccggggttcacgccattctcctgcctcagcctcccgagtagctgggactacaggtgcccgctacctcgcccggctaattttttgtatttttagtagagacagggtttcactgtgttagccaggatggtctcaatctcctgacctcctgatccacccgcctcggcctcccaaagtgctgggattacaggcgtgagccaccgcgcccggcctcctttttatttctttattccttttttttttcttttttgagacagggtcttactttgtcacctagacccgagtgcagaagcacaatcacagctaaccacagccttgatcttctaggctcaagccatcctctcacctcagcctcccaagtagctaggaccacaggcgcatgctaccatacccggctaattttttaattttttgtagagatggggtctctctatgttgcccaggttagtcttgaactcctgggctcaagcagtgctcccacctcagcctcctgaaatgctgggatgacaggcatgagccactgtgcctgctcagtctgtagttttcctatagtgtctttggtctgtctttggtattagagcaatgctagcctcataaaatgagttagtaaatattccctcctcttcagttttttgaaaggatttgaaaaagattggtggttagtttttcgttagtgtttaatagaatttaccagtgaaaccttctggtctcatacctttctttgtttggaagtctccttactagttataggtctactcacatttttctgtttcttcatgagtcagttttggtagatggtgtgtttctaacagtgggcttaatttttctgctggcagccaaacaagtacaggttgcatatcccttcttcaaaacgcttggaaccacaagggttttagatgacagatatttttggattttggaatatttgtattatatgtaccagttgagtatctcttacctaaaaatctgaaaatctgaattctaaaatgctccaatgagcatttcctttgaaaagcatgacatgttgtgctcaaaaagtttgagattttggagcattttggatttcagatttttggattagggacactcaacctgtgtgttttttttcccttgtcaatgacttggcttttttctgatatttttctttctttttttttttttttttgagacagagtctcgctgtgtcgcccaggctggagtacagtgacgcaatcttggctcactgcagtctcccgctcccaggtccgagcaattcttctgcctcagcctcctgagtagctggggctacaggcgtgtgctgccgcgcctggctaatttttgtatttttagtagagatggggtttcactgtgttggccagaatggtcttgatcttctgaccttgtgatccgcccacctcagcctcccaaagtgctgggattacaggcgtgagccaccgcacccggccttgactctgattttgaatgctatcccctttgctccgtttagtgtttctaatgctgctatggaggatttgttaacagctgcaaccacgggcattttgaggcacattgcagctgaagaagtgtctaaggaaagagagcgaagggagcaggagaggcagcgggctgaagaggaaaggtaagtgtgtcttgtccatgcagccgaataaggagctcagtgtggacacaggcaagaactgaccctagccacgatgctcctgctattgtccactgtgctaccattccacccctgctgacccactcatgccctcctatgcttcagcccagggggtggatggagctcctcaggccacacctacccgtgagcagtggcccttcccagccaggaaaggcaggggaagggaggtggtgtcaggggagctggagtaggggtggcctaccgactcaggcagcacacctcaatccctgtctgcgtggccagggagtaaaacaaacagcacttatttttattcttaaacattacccttgtgtattttttctcttccctgtaggttgaaacaagagagagagctggtgttaagtgagctgagccagggcctggccgtggagctgatggaacgcgtgatgatggagtttgtgagggaaacctgctcccaggagttgaagtaagtgaaacgctggtgtcttgctgtgccaggagagtgagctttggctctgccctaggctgtgtcttgcaccactgaggatgggctattggaaatggatcttgcctgtctaagctactttgattttgtgaccaaatgtatttgatgcagtcctctgtgctcccttggctaatagaattttattataaaaaattctcttttatatgagggctgccaccacatgatcatagtcagccatccttattagccactggcatttatcatatatttgagacacttccaattgattgcacaagtcagatgttgctgatgagaagattttgtggttgtctgcatggtaatttacaaattctacgccaggcacctgtagtcccagcaactcaagagactgaggtgcaaagatcacttaagctcagaagttccaggtagtgtgctatgactgcacctgtggtggccactgtactccagcctgggcaacatagtgagaccctgtctctaaaataattaaaaattctgactattttattaagataaaggtttatttcttaactgttacgagggcccctatggacctataatttggcaccctgttccacttaattctttttaccctgtctttctaggtgtctgtagtttaagtattaaagcttcttttacaatgaagatagaattacattttaatactgaggatgcagactcttgcactttttttttttaaagacggagtcttgctctgtcgcccacactggagtgcagtggcgtgatctgggttcactgcaacctctgcctcctgggttcaagcgattctcctagctcagcctcccaagtagctggaattacaggcatgcaccgccatgcccagctaattttttttttttttttttttttgaaatggagttttactctgttacccaagctggagtgcagtggtgccatctcggctcactgcaagctccgcctcccgggttcacgccattctcagcctcctgagtagctgggactacaggagcctgccaatatgcctggctaatttttcatatttttagtagagacggggtttcaccgtgttagccaggatagtctcgatctcctgacctcgtgatccgcctgccctggcctcccaaagtgctgggattacaggcatgagccaccgtgcctggccgccagctaattttttgtatttttagtagagacggggttctaccatgatggccaagctggtttcgaactcctgacctgaagtgatttgcctgctttggcctcgcaaagagctaggattacaggtgtaagccactgtgcctggccgactcttgcacttttcttttttttttttttttgagacggagtctcgctctgtcgtccaggctggagtgcagtggcgcgatctctgctcactgcaagctctgcctcccggcttcacgtcattctcctgcttcagcctcccgagtagctgggactacaggcgcccgccaccacaccaggctaatttttttgtatttttagtagagacagggtttcaccatgttagccaggatggtctggatctcttgacctcatgatccacccgcttcggccttccaaagtgctgggattacaggcgtgagccaccgcgcctgactgactcttgcacttttcaagcaagccctcagtgtctgtgggccccaagtgcagtgtcttccatgctgattgccctgtttctaggaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtgagtcctgtgttcctacaggcaaaatccacacacacggggaagagtcttttaacaaattcaaaatatatgagctattagtttctgtattcagtggtaaaaggatgagggaaaatgttatagcaatgaatacctaaaatagactaattggattatactgcatttcagaaatacttgattacacacacacacacacacacatacaatataaggggaaaagtcaggagttagattgggacgtggtggctactctgtatgtcaactgatatttatagggtgcctgccatttgcccactgcactaggtgctgggagacagctatgaacaagccagattatggctgcatgcaccaataagggtgaattctcaaaatataagtagtggagaaaaagcaattaatagggaatatacaaatagtgtatattcaaactaaataggttgtttcagatttatatatagtggtataaccctaaagaaaagaaggaaaataatgatcataatctcagcatagtggttacttttgggaatgggaggtggtgcctctcatggccacaacttctcaactgggtgtaagtgcacaggtgcttgatgatttattaatcttataactgggcatatatgtgttacgtatgttgtatgattcatttcataataaaatttaaaatcagtaatagtgtccttggtagttggaacagtataaaagggagtatggggagaagtgagtcttccttctacaacagacccctgtccattgtgcgagcagcagctgcttgcgaaaccatccagagactttctgtcctttcttgtggctcttggcacagatgggctcatgatccctgctttgctctgagccttcctttgctccatctgatatgaggtggaggcttggctgtagcagcatgctgagctgtccccgttgccagtggtcttgaggtcagtgcgataatgtaccataaatgaccttcctggtcttctgttgatggactttcatgtggctctttttttttttttttttgagatggagtctcactctgtcgcccaggctggagtgcagtggcgcaatcacagctcactgcaacctccacctcccaggttcaagtgattcttctgcctcagcctcctgagtagctgggactacaggcgtgcgccaccatgctcggctaattttgttttttttatttttagtagagatggggtttcaccatattggccaggctgctctcgaactcctgacctcgtgatccgcccgcctcggcctcccaaagtgctgggattacaggcgtgagccaccgagcctggacgtagctctttttagctctggtaaagactgttgcagtgactgttgttgtacagacagacatctcacccgtttgcacacaggcacgtgtgtggagataaattcctatcagtggtggctgtgggtcaagggatatatgtatctttttttttttttttttttttttttgagacggagccttgctggtacacacagcctggagtgcagtggtgtgatctcggctcactgcaacctccacctcctgggttcaagggattctcctgcctcagcctcccaagtagctgggaccacagtcgcccaccaccatgcccggctaattttttgtattttagtagagattgggtttcactgtgttgcgcaggctggtcttgaactcttgagctcaggcagtccgcccgccttggcctcccaaagtgctgggattacaggcgtgagccactgcacccagctgggtatatgtatcttaaatctgtatccatattgccaagtcagcctccaaagctcattcagtattaactgttaacgttcggtagtttcattgctcaccacactcatttgatgtccttccttccccatgcctgagttctgactgcaatgtgtttctcagtttgaagaccctgaaaacactctgtgatgatacattttcatgtccccaggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggtcagcatcagctgtcgcctgcctcgtcagggctcccctgcccccacttggttttaccaggagcggaattaatgtgtgtgtttggagggtgaagataggtgaagcctggaggcgaagataggtgaagcctggaggcgaggacaggcacagggttgcattttgaaggttgtctcccacagttgtggacatgtgacttgttccactggcaaagcagagctctgagttcaccttgaaagactcagcgtcctggtgcctgagtctgactctgcatcacgtgttcttttcctgctcgtcccagtttaagtacctgccacttccatccttgttggaggagccggaggtccacgctggcctgtgtcttccgatcccatccccgccccatccctctgttcctcccgccgtctccttcacacactgccccctttctgtggcagcatcttccagactccacctccaccctccattatttccctcttgaggccccttggtgtggccctggtcctccctgccactcctcctggttaccccgagcagaaccggctcctcagggccatgccaggacccccctcagcctgcattcctggccatgctgggcttggcctttatttagaacccatgtaggtgccacctcttgcctggcctcagggctccctggcctcccagtgggtggggactggggaggcagcctggagggcctagcaggcacaccgctggggcctcatgtcatgtcttgtcctcctcctggtcatcactggatgttccctctgaaaactgtcttgtgggtttcatttagccccatcaggttctgcgccggcagtggggtggcagtcccagcctgttggaggcatgctgtgaggccagggctgggcctggctcctctgacccatggctgccttcacatagtgacctggccttctcctggagtcatggcttcttgtgtcccccctccgtagctgcccttgtcagcctcagtctccttgtctgagccctccaccctgccccctcagcccagacctctgccctctgcccttctgcgcaccccctggtgatagccctgtcacccctgtctgtcactgacagcccccatcatgcatctccaactgaggcctcttccctgagttccagacttggtttccagttggcagttcaacctctaaacctgatttttccccaccctgccccttcctgctcataggatgccgtcctgtcctcctgcgcttagggcacaaacctgggcttgcatctctctcagacccagcaccgagggcatggcagttctctccacctcactggaatgttgctgcagcacctgtctgccagcttccaccctgggccccaatcgtgtcctcagcaccacaacagagggatcctccaacagctcagccaggtggcgttgcctctcggcggcgtccctagcgctccccgagtctctgcattgtggacccaacccctccctcgctgccctcactgctctccccaaacacaccaggtccagctatggcctggcatagccatgccctctgctgtttccagaagttgtcacgctggctccccctgtttccttcaggtctttgctcacatatcacctgaccaccctgagtgagactgcaacacgcaccctgcctggctccagccccacctggcagcatttgcccacagtgccgacacctcacacatgccaggccagccacttagagatgctgttctctccccattagagcctatgttctcaaagggcaggattttgtctgtttattgctgaatctcccatagccagcacacagtggatacttaacatgatatttgtggaatgaaggaatcctctaacccgtttcattggcagaaaatgtgtttttcagtctcctgagtattccccaggggacactagccagtacttctcactaagctcctgcggggacactgtcattctgctttcctttgcaggttaaggcggctcagaaacaagacagctcaccagatgaaggttcagcacttctaccagcagctgctgaggtctgtcatgctgcacccttctgcgcaccccctggtgatccccgttccccaatctgtcacactggcagcccccttcatgcatctccaactgaggtctcttcgatgagctccagacttggtttctagtttgcagttcaatctctgaacctgattttcctccaacctgccccttcctgctcataggatgtgtgtgctgctcctgcaagggtctcacacactggctaatccacggtggtctgttcctcccagtgatgtggcatgggcgtctctggacctgccatccctcgtggctgagcacctccctgggaggcaggagcatgtgttttggaagctggtgctggtgttgccggatgtagaggagcagtccccagagagttgtggcaggtcaggaagggttttcccctgtggggtttccaagaggtggagtgggcagggcagggttgtgggccagggccgggtattcctcttatgtgtgatgggaactcggaagtgtaggtttatgttttaatgcttggatttacagtctgttttgctcatgattttaagttgaaactttagatttgattatttcaatttttattccataaacttggtgtattagtccgttctcacactgctttaaagaaatatctgagactgggtactttataaagaggtttaattggctcggctgtacaggaagcatggctggggaggcctcaggaaacccacaatcatggtggaaggctaaggggagggaggcatgtcttacatggccaaagcaggaggaagagagagagaagggggagatgccacatgcttaaccagatctcgtgagagctcactatcatgagaacagcaaagtgggaggtgccacacacttctaaacaaccagatctcgtgacagctcactgtaatgagaacagcaagggggaggtgctgcacacttaaccaggtctcgcgaggctcactttcatgagaacagcaagggggagtttccacacacttaaccagatctcctgagagctcactatcatgagaacagcgagggtgagttgccacacacttaaccagatcttgttgagagctcactatcatgagaacagtgagggggagttgtcacacaaccacatctcgtgagagctcactatcatgacaacagcgaaggggagttgtcacacacttaaccagatctcgtgagagctcactatcatgagaacagtgagggggagttgtcacacacttaaccagatctcgtgagagctcactatcatgagaacagccagggggattccacccccatgatacaatcacttcccaccaggcccctcctccaacattggggattacagttcaacatgagatttgggtagggacacaaatccaaaccatattacttggcaacagtcttagaccaaaagcatttaagagttgattgttatttcaagctgtgttaaggtacattgatagacctgcttcattttagactcttcagtaagatagtttatagtctgtttactatagttccatttttttccccttaaagaaacttttggcattttaaaaaagaaaaaattgacatgatcttattttctgtaaccacatagcatacagaagtcatatttttaaagcaactacagtctctgtgtttttttgagacagggtcttgctttgttgtcacccaggctagagggcagtggtgtgataacagctcaccgcagccttgacctcctgggctcaactgatcttctcacctcagcctcctgagtagctggaactacaggcgtgtgccaccatgcctggttaatgttttttttttaaagatggggtttcactatgttgcccaagctggtcttgaactcctgggctcaagcaatctgcatgcttcagtctaccaaagttttgggattacaggcgtgagccaccacacccggcttacagtttatttttaaaatagctttattgaaatgttattcacataccataaacttcacccatttaaagtgtacatttcagtgatttttagatatattcacagggttttgcaaccatcactgttaataattccagaacaccttttcacttagaaagcctgtattcttttttttttttttagatggagtctcactctgtcgcccaggctggcgtgtggtacactttgttcactgcaacctccacctctcaggttcaagcaattttcctgcctcagcctcccaagtagctgggattacaggcgcacaccaccacgcccagcttagttttgtatatattttgtagagacagggttttgtgatgttgcccaggctggtctcaaactgggctcaagcgatccacctgccttggcctcccaaggtgctgggattacaggcgtgagccactacgcccagctggtgagtcatttcttaaaatagctgtcttctcatttgctaagttcgtatgtcacttaagaattcttaaggtctcaggtatgagaaatttgatctgtaaaaaacatgtatttcaaactctagggatgttttctattgctgaaaatcttaatgcttcagaattttaagtcacattagaatgagccagttccattctaatggaatggagtgccccctcctcctgcccaattaagaacaagtagaagccgggagcagtggctcatgcctgtaatcccagcaactggggaggctgtggagggaggattgcttgagcccaggagtttgaggccagcatgagcaacatagtgagaccctttgagtgacactctacaaaaaaaatggaaagattagctgggcatggtggcccgtgcctgtagtctcagctactgaggcaggtttgcttgctgcggtgagccaagtttgtgccattgcactctagcttgggcgacagagcgagaccctggctcaaaaaaaaaaaaaaaaaaaaaagaacgagtacagatcgttgctccattttaaaacaacagcctgttttgtgcagatcagcttcatagtaagatgtggtatttgtggacctaggtctgtgtgatatttttctttcttcttttcctgaaagtctttataattcaaatatagaattagattcttcaagtgttttttttgttttttgttttttttaaatctgtagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtgaactataattactttgtgtttacttctgtgttttcattactttcacttactcccagatatcactggaaccatgcaaatactgcttattccctaatgtggttttgaaagactgggaggctcagaagcaagtattatgtctgtccgtacatgtcgtttaaaaaatttttttaagccagtcaaattgagtagtgggcaccaagcccagcctgcttctttactttttctgttttaatactatatattggatttcctaaatgtaatatgtacacaaaacttttaaaaaatgaggaaatgtaaaagaagtataaagatgatgataagagccatccatgctcttgccattctgaggtaacagtaacttcttggtgcaaattcttcccttttcctgggattacaaagtcacatttcatctactggaaattagtttactgctgctgttaccttcattttcatttaagaaagtaacacttccgtgtacttaaaaagaagtcaaataatgccacccacgtgatttaaaatgagacatagtagctcctccttcctctcttaactcctttcttcagggctgcatttttctcctgtttccagatcacacacttacacagccatttctcagtttatccatttaaatgttctctgctgacttcccattaatataaatgtattagttaccttattcctaaataactaattactcctaacatagcagcttaaaataatgtctgttatcatggtatctgtgggtcaggaatccaggtgtagcttagcttgggtcttctggctcaaggtttctcatgggtggaaatgaaaatgttggctaggattgtggcctcatctgaaagcttgactgaagggtatctacttcccagctcactctagtgagcttgtgtcaggattcacttccttgcaggctgtggccaaagacttcctcagttcctgccacatgggcctctccccagctgacagcatggcagctggctttcatcagagtgagcaagaggtgagcctagatggaagtctgagtgtgtttataacctaaacttagaagtgacatcctgttgcttttgttggcttctgtctgtcagaagtgagtggctaggcccagctcacggggcaggagatcacacgtgggcatgaacactaggtggaatcaggggggtcctcttggccactgcataccatactaggtacagcgtggcctcttgtgccatggtccttgctcggccttccacgtcttcccgggatagctacactagcactttgtattacttcagtgagtggggtcatattttgatggctctgtgactgctattcacctcagaaccagtagtgttctataaccacaattatttttttcctgcaagaaatagagttgccttattgtctcacttaatgtagttctctttatctctttaattttactggggggccgtatatatctcggtagagttttccaaatgttctgtcacttcacttgatccatccatgttccctctgtcctggaactctcatctgtgggctggtctccatccaggcaacatgtgccttagtgccatcattgtgagcatatgtgtccctgctcctccacttggaagctctgtgaccttgggcaagttccctagcgtctctgccacctgtgtatgggtactgttacttattatccctattttactcagagacggtaaaataaactgcccaagcctctgcaggtgctgtctggtggagatgctcatctggctcttgaggataaaatgagtgcaaacacagactgcacaggacagtgcctggcacaggccaggtgcttgctcagtgttgccattagcagcagctgcagtattttttcttggttcagccccttgttggatgttatatgtcatgcgaggggaattttctgagtcttttccattatgaaaatgattttattaacaaaataccttaagctgggggaaagaaaaagaaaatgcatttatttcattctgacatttgcttcatagtttagctacgtttgtaaaattataggtagaaaattattttcctggccgcgcatagtggcttatgcctgtaatcccagcactttgggaggccgaagtgagcggattgttttgagtgcaggagttcgagaccagcctgggcaacgcggtgaaaccctgtctctataaaaaatacaaaaattagctgggcatggtggtgtgtgcctgtagttctagtagcttgggaagctgaggtgggaagattgcttgaacctgggagttcgaggctgcagtgagccgtgatcgcaccactgcactccggtgttgacagaggaagaccccgtctcaaaagaaagaaaattatttgccttccagttttgctccactgtcacctagcatccattgttgctgtaccattcctgttcctttctgtgtggcctggttttctctgtggaagccttttctctctgttcatggcgtcctaaaaattcactttgttacactggcactggactagcttcactcactgtgcagggcttagcaggtcctttcaggctagagactcctatttcacttctgggacattttcatgtctttatgacactctgtcttttttctgttctctcttgaacttctattagatagatgttaggcctcatcaattgatcctctgagtttcttatcctattttctatcctattttcaatctcatctcttcctactgtgttctgaaagagttccttgactttattttccaattgtcctactgaattttttattccatatatattacttatttcctctttctttttatcatgactttttcatagcatcttattttttggatgcatcatcttatctttccaaggaaattagggtttttggggtctaagttttctttggttcacgtattatctggttcctcttttttttttttttcctctctgttactccagtttatctcttttatgttggaggccctcctcagatgccttacccaaggctatctgtctatatctgagtgaggccctaaaaggctagccaagaagttctgtgtttggggtggggtggatggtagctaaatggcaagccaggctttttggagggactcccaaatgtctggatctggatggctgttccctagactgttcagtttttctggaaaggacttgtgccatctgctttctggggagctgctggtattctcagggtagggttgggagtggtttggcgctgagtcccttccactgtgcctgaccatggccctgcatctggatcctctcaggactcctgttcaggggcccagggggactggttttgcatagaggttgcctgcagtggtgggtgccgccaatagggtcaggctctgaacttcacctttggctcctggtgtctgcagcgcctgggtatacagggcttttgcaggctcagtcaacctgactccttacacacccacatctgcagcctttaggtatggcatcctctgcttccctaacccagggattggtcacacctatttgctgctttctagaaatgtatcagaatccctcatctgctgctggcttgccttccctctttctattattatgggcttatatttttgtttatttttgtagagatggggtcttgctatgttgcccaggctggtcttgaattcctggctcctggcctcaaacagttctcctgccttggcctccccaagtgctgggattacagtcatgagccactgtgcctagctttaacttttttatacctgtttaaggttaattaaagttatagtaatatggtcaaacacaattctagctggaggctaaattacctgttgacctggctgtttcttgcactaattctgttgcatttattctcatttttgtttctataaatttaaaatatgaacatgggtgggcgcggtggctcacacctgtaatcccagcactttgggaggccgaggcaggctgatcacttgaggtcaggagttcgagaccagcctggccaacatggtgaaaccctgtctccattaaaaatacaaaaattagctgggtgtggtggtgggcacctgtaatcccagctactatccaggaggcagaaattgcagggagctgagatcgtgccactgcaatccagcctgggcgacagagtgagactccatctcaaaaaataaataaataaaaataaaataaaatatgaacatgccttatatctgaagggcagatatagaaattatttttctagggtgattgtcctctgaatatatgaagaaacaatgttatttgacgttttctttaaaaaggaagtctgaagctaggcatggtggctcctcgaacctgtaatctcagctactcaggaggctgaaccaggaggactgctcgagcccagcaattcaagaccagcctgggcaacataataagacccccttctcaaaaaaaaaaaaaggttgaggggagtctttgctaacaattggatttagggaaagaggggccaggaattaaaataactacaggaagtaagataactacagggtatgcccagctgtgcccttggaggcctgtctggagtacagtcagtatttagtgcacggagagctttggctgcacttgctctggggcagatcagtcactgctgatgcgtcccatggtgcatctctcctgatgatcttgatgctgttgcaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtttgtgaaggaagtctcgtttatgaagcagcattgtttaataaatgggtggaggccctgggtctgaggatggtccagtagtgttggggtcaggaatcactgagacagcaacccctgtggtgactgtccactgcaggactgggtggggtcagcacagtgagatatgttagcaggtgtgctgacagcagaatgcaagtgaccttcatctatgtctgtcttaaaggtctgatgctacaggacttggtttcagctaagctgatttcagattacactgttaccgagatccctgataccattaatgatctacaaggttcaactaaggtaaggtttcatcatttttaatggtctgtcaagatattttgttttttccccttttgctgtatcttgaattgagtgtatattagcgtttgcattgtctttttcttaagagacagggttttattgtcacccagtatagtggcatgatgatagctccctgcaacctcaaactacagggctcatgcaatcttcccacttcagtctcccaagtatatgggactactgtggtgtgccactgcgcctggcagcagttgtatgttttatacagataactttctaaaaacataagcagaaatcaaaataaaagataaaatttgcccacagtcctgctatctgcaaattaaattgttcatgtaaaattttttagtgtttttgtttctatgaatttaaaatatgaacatgtcttatatctgaaggtcagatacagaagttatttttctagggtaattgtcctctgaatatatgaagaaataatgttatttgatgtttcctttaaaaaggaagtctgaagctgggcgtggtggctcctcgcacctgtagtctctgctactcggaggctgaagcaggaggactgcttgagctcaggagtttgagaccagcctggccaacatagcaagacccccttctcaaaaacaaaaaaaatagggcagggggagtctttgctaacaatttagagaaagaggtgccaggaattaaaataactataggaagtaagataaccatagggtgtgaaggcaccttggcacatagtgaagctgttagtccttccaaaaaggagaagactccatttctgtgcatggtgaaggggatgttcagggctggtttcctgagggcctgggcctttccatggggcaaccatgcaggtcacactcctcctcaggccaggtgggatctgggggctctctttagtgcccctactggacatgtctccagagccctagaaggctaaactcaactgcataggacacttctgttccccttcctaccacagttgagagcccagtactctggtattacctgctgtgggcaaccttgggggatcaagccctttcagaaagctgtttttgaaaaacagtgtgaattgttcaaccaagtctcttctttcttctcaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctggggggtacgtgcttgacctggggaggtctggtgggtggctgcagccaagtctcaggcttccttctcactgtagtaaccgtctggcaggtgttgggcaccagtgtgagggctgcacgtccacctccgtgtgtctccatgctgtgctcgcctgcaccttcctttggtcctttgggttcatgagccagaacaagctgggttttgtggagtgggggctgttagcctttcctgaccagcaaggcagtccatgggagttcactcagcttcaggagaaaagtgacaagtggtactgggaggaacaccaaccctgatcctgtcctgcctgcccacagggtccctgttttcagaacagacaaggggcaaagagcatggggaccatgtagccctgtccccaagccgcagccatggcactcagtgctgatttaacattctttctttgtcaaagaggccttcttctatggctctggctgtgcccctgttcctggctgaggtctttgggctgttttgacacagatccgacaggccatctggctggctcaagcccagtatggcatggggctgctccttcctatgcactcagaagggaatgagctgcttatctggcagaagttgtggcattagcacagacactcccctttgggcctcaggcgcccttctaaattgtggtgtgtggtctgtagtaggtctaactcatgctcattattgaaggaacccaaagggaagcaaaccactcagcacaagccctcggtgctctggttaggttggggttccccaaaataagctaagactgcttataccagactcatctgggtgcttgttaaaatacagatttcctaggcacaaccacaggcctgtacagtcagaacttctgggtagaacttggctagcaacactgttaagggggactgtctgcatccctcacctagaccctgggagcaagctgctcttccccctcaacaactgtggttctgctgtgtttagaaagcagacttctcaacttcacagttgccttctcctgagaaaatgttttcatgtacattttcacctgtattttggccaaacctgtaactaatgaggcactttctccccagccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcaggtaattagagcttgatgcaatgggatcagctcctcacgagactttcctggtccagtttctgcaaaggaagatgtttagttgatgttgctgcttttcttttgggtctctatccttcctttccttaggacttccctcttcaagtgagtgacttaaaaacattgagacaggctaggaagtttctggtagagcctgaactcacctccctgaaacaggccccctaggatggctcttagagaggattttgtggcttttgagtagtcattactggccctgccagtctcgatgtaagcttgtctggactttgagtgatgcatggaccctgggagcctatttaacccaagtgtggaagtcacataattgtgtgactttaatcaaaggtcttgcacttaaatcagtgaatttaagcacatgccacctgtcgctgtttaaatattatttgtacctgtttttgtttttttgtgtgtgttttttttttttttgagacagggttggccaggctggcctctttatctgtttttgtattgttttctcagaggcgctgagtgaagatggtcagatatgtgtgtatttttttaaaaacgatttgaaaaaatatgatgttcctttgtcgtgggaacaagccaggttgcagacgcagaaggagctacagctgagagagggacggtgaggttcatgttcagtatgtttctgttgcttgctaaactgtatttttcttgcaaagtaaatagaaattaacatcctacatgccaaatccagtccactgtgggcagactgtgacaaatcctcaaggaacagatcattcccatgcagtagaaactattctagaacaaagttaaagcatctcacttcatttatcaggcatacctgaccctgaaatcatacctaaccaggagagtacagctgacatttcatctcacttccaaatttggttccaaagcacagtacctaaaaaagttcacaagtatgctttctcccaggataaacaataacagtgaaaatctattaatgtaatttgttgccataatagaaaaataagtggtaattttagcaggcgttgaaatacgtttcttaaaatttatacctgttcctgataaaatttctttattttgggtactttctttagcttgggttaaaaaaaaaaaaagtcctaacttgataaggctacctaacataaaactaccaaaatagaaaaaaaacatgcttcttggtagaatgttaggaacagtggaatcagaaccagcctgttgtcccgactattattcactattgtcctggaaatcctgaccagtacagggatgtgggatagacaggcacaaatactgaaaggaaggagaaactgtcatttccagacagtacagttgtcagtccaagaaaagtcaagtccatagaaccattctcagttcaataaggtgatcagatagatagatccacaacatgttaaaaaaaaaaaaattctcattcacaacaataaacctgaacagaaagggcacaggatggtggaactttgctgttccttcttgttccccatagagatccttgaagtaccttctccaactccatgatactctaaaaactgttcatcttcataataggagtggagcctaatccttggtctcctcacctcctggtttcccggaatgtctttctcattaacatatgagttctcagggcctgtatgtgcaaaggaaacctgaaccattgaggttcagactaggttgttgacaggatacaatgctgtgaagatgtcagtactggtaagttctaaaattcatcaggataaacaaatatgcatcaattgctgagaaagttttaaataagactaacatggtttgcttggcctgataccaagacatacagtaaagctccagtacttaaaaccatgtggggatgccagagtagataaatggatcagaataaagagtcagaatatgtgacaaaagtgttaggccaaattattgaaattagtggggaaaagacaaacattggcatgtgtttagaaaaaaatgtcagatgccttctctctcaccatttgtaaacattacttccaaatgtatccaagagctatctataaaaaaccttgccaatactagggaagaacagaatctggaaccctagggtgggaagcaagacatgaagcagagaagctccaaaaacctagctgcctcttgagagcagaagcttccaagaggaacaggcagtctcaatgcctctgtgcataagggtccctacagtgcaggggctgccttccctctttgctccactccctgacttgatggaagcttggaagcaggcatggggccagcatgagctgttccaggagggcacatgtgtctgaggcacatgttcttacatgttaatgcacatgtgcaaatgtatctacatgctttacatgatgctgtagaaatattttctcttgaccataaacatttcaaatcatgtacttacagtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtgaagcccacttccttctaattcatgtgtgtttagtctgctttatgctgtgaggggagactggttattgcttgattaatataagacagccaggatggagaagggcaggtggattattagcaacagttttagtgatgtaactatttaaaagctctttgaagacagaagcagtgccctagatagtatgtttctaactgtttatattgaagtgaatttcatttattatttattattgaaagtcagtgttaagtttttctgggaaattcatgtggttaagtctgctcagaagatggtgagtgctgaacactatggctggccacaggcaccctgcccttgggagcctgaggcattggtggatcatcccatgctgtgaatggacaggagctggggctgcccctcctctacattgcccacttccctccctcccatgcatacctttcctttgctttcatttgatggccatgtttaccattttactgagtagaatcaggaataagggaccttccacaggttgtcctctgccttccctgccctcccagccacatccagcatcctccctatatccccttcctgacgcctcttgttgctggaaacgaaccatgcagctcgtagtcagtcagcccttccctgggctgggatctcatctcccacctacccaaggacattcattcaatgagtatctctctcgtgctaccacccctccccatattaggtggtgcccatcagcagcacacagacatgaaacatgcctccctgtcttggtcccacttccctctttagccaccacttcatgtttctgccctcttaatggtaaaactcctcaaaaacgcttgtgatactcacttcttcagccttctttcccatggggatgaaggcccagggttgaacatgaccgtgaatcccagtccttggtagcatcccatacttgatcctcccctccttgctcctaggatgtccgtggtccccctcctgccctgctggttcctcctcatcccccagctgccccctggattcattctctcaacctctcctctgcatcgtctgtacctactcctcagaaatttcatccagtttcatggatttttaagtaacatcactattctgacagctccaaatttgtatctcaaacctctgaactccacacttgaacatgctactgcttccttgaaatcttcattagacacctattggatgtctggtagccactgcaaagttaacatatcccaaatccagttcccggctttcttccaaccaaccccttcctttggtggtcatctctgttgatggcggctccatccttccagctgcctagatcaggtgccttggaatcatcccctcacatcagcccattcacatatcctattggctctattgaaaatacattcagaattggaccacttgttatgacttccatggccaccacgtggctcaagccactatcatcttccttctggattattacagtaggctgcagtttagtcttggtagacctggtgggtgcctttcaagtgagttaagatggaggtcgtgtcacttgcttgcttacagcctctcagtggtttccctctttcacctgcaatcaaaggcaaactttgcaggggtggccagggccctgagtgatctgccccccatttcctctctgacctccgctccttccttgagcatggtaggcagttcacagttgggcctctgagtttgctgttccttttgcctaggactgtccagcccctccattctccccagcatccccatggctgatcttgtactcacttcagatctctactcaaatgtctgcttctgttaggccctgcttgcccatctccgaccttcttgtttccatggctctgctttgtctttctcatcttcaaaccatgtttctcttgttatgtgttccttgtctgtctctcctcactaaagtataaattgcttagggcagggcctctgttttgtttcagtgcaatattccttgtacctagaatgatgcctagcatctggaggaggcttaatgaatatgttttggaagggtgaatgaatgtgtccgattactaaaatcagtctctataatttaagtggtttgggatgagatttttttttcctttttattagatagagtctcgctctgttgcccaggctagagtgcagtggcacaatctcgactcactgcaacctccacctcccaggttcaagcagttctcctgccccagcctcccaagtagctgggactacaggtacccatcaccatgcctggctgatttttgtatttttagtagagacgcagtttcaccatgttggccaggctggtcttgaactcctgacctcaggtgatccacctgccttggcctcccaaagtgctgggattacaggcatgagccactgcacctggccaagattgtttttcttgaaaagaccggtatatggaagtagacagctctagagtatgttaggtggcagtgggatattattttgagttaattttaagctataagcagcaatccactcatttggaaaatgtcagaagaattaattatagatgcataaaaccaaagtaaattaaataagataagccaaacaagacaattacaagtaatgttaagtaacacatcgaagcagttgtttttggattaataccacctttttcattaaatataaattggaattggatttataaattaaagggaagtggtttctctaatttttttttttttttttttgagatggagttttgctcttgttgccctggctggagtgcaatggcgtgatctggctcactgcaacctccgcctcccgggttcaggcagttctcctgcctcagcctcccaagtagctgggattacaggcacgtgtcaccatgcctggctaatttttgtatttttagtagagacggggtttcaccatgttgatcaggctgatcttgaactcctgacctcaggtgatctgcccgcctcggcctcccaaagtgttgggattacaggcatgagccaccgagcccagcctagtttttttttttaaattaagctttatcataggaagttgttaaatttttaataagtacatttctgcttctcagttgatgtcataacttagttatattcttagtaaaaagcaaaggcttaaggctgggtgtggtgactcatgcctataatcccagcactttgggaggctgaggtgtgcacatcacttgagttcaggagttgtagactagcctgacaatacagcaaaatcccgtttctacaaaaaaatacaaaaattagctgggtggcatgcgcctctagtcccaggtatttgggaggctgaggtgagatcatttgagcttgggaggtcaaggttgcagtgagccaagattgtaacactgcactccggcctggccaacagagcgagaccttgtcaaaaaaaaataataataaaattggccaagcacagtggctcactcctgtaatcccagcactttgggaggccgaggtgggtggatcacctgaggtcaggagttcaagaccagcttgggcaatatggtgaaaccccatctctactaaaagtacaaaaaattagctgggcacagtggcacttgcctataatcccagctactcaggaggctgacgcaggagaatcacttgaacctgggaggcagaggttgcactgacccgagattatgccactgcactccagcctgggcaacagagtgagactctgtctcaaaaaaaaaaaaaaaaaaattatataaaattttaaaaaagcaaaggcttaaaaagtttttaagtatatatagaagattaatgaacaatagttaacttcctaatgctcaaatatttttgaatttattacatattgtttcaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacaggtgagaagaacgtatacatttggcatttacataagaattaaagattgagagaatggctggggaaaaaagtaatatcacgatttatcctatgatgttttgatgaccgacaaattattagctcaaattagaccttttcttaaactttatccatatcattgttaaagagacccaactgattttgagtttctgcctacgaaataaatgaagaatagaattgaaatattcttaagaactgaataagacctgtaactgtgtgctgatgtgtaattaagggcattaaggtgatgacagcagcttctgttggagcacatattgtctgagctttggcattacccagacctctcttctgggattaatttttcctgaggaaaactaatgaatgaggaaggtaagctcccagaagtcaagagcctcacccaagagtgttcaagtagtgagtggtcaggttgcttttcaaagccagatccaactggctccaaagcctaaggtctttttaccttaccattcttccttcagtggttaaagatgcaaaaacagagtttcaatcacagatatgtgccactgaacaggtaaaaactgtgctcctggactggctttaggaagtccttcaatagaggagaaaagcaaattaaaatgatgtactgtttccattcatcagtttggcaaatactttaaaaatattcataccctttgaattaccaattctaacctaaagaattctgacctaccagatattccccaaaaattaatgtataaaaatgtttactgtagcattattgtatgaaagtcgaaacagaataaatatccgaagatgggagtctgattaaacaattataacacattcatgtgatagaataattcacagcccttgacgatgatattttctaaaaatgactggctgggcgtggtggctcatgcctgtaatcccagcactttgggaggctgatgagggaggatcgcttaagtccaggagcttgagtccagcctgggcaacataaagagatctcatctctacagtacataattagccaggcatggtgctacatgcctgttgtcccagctactcaggaggctgagctggtaggatcacttgagcccaggagtttgaggctgcagtaagctccgatcataccactgcgttccagcctgggtgaaaaatgactgacactggaaattgttcatgatagaatacaaaggcaaacagtctatatacagataccagctgaatgtacgagctaaatgaggctggaaggatatacaaaggataatttttttccctctgtaaaaataaatgactactcagatgaggtttctaacatgatccagatctagtaccttcccagagataggtcgtggtttattgacatcccaaaactgttcagtttcttttttattcaaatagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtcagtctccca

SEQ ID NO: 12036 - DNA, 465 bp, Homo sapiens
ggatggaacagggtctggttgggtagaggagaaacagaattcccggagaggagtgcaggggtgtagctggagacagtgtacttgagaggacatgatgaaagcgtggaggtaccagcttggttgtgtggccaggtgaggggaacaggccagcagggtgaggtcagagattcttgtcaccttcttctgagagctgtgagaacccgttgttgaagattaggcagagaagtgatctggtcacattttcttttaagaatggcatgtagggcaggaatcttgagaggtgggtgctgcagccatccaggtgaaattcaaagggaataagcgtgagtttgttagcaattggtgtgaagagaggggataaaatttgagccatatacagaaagaggtattaatagacttggtgatgttgcgtatgaccaccaatcttaaactggcactcagcatctcctgactgtaatcctacat

SEQ ID NO: 12037 - DNA, 470 bp, Homo sapiens
gaatggaactgtggggcccctgtctccttttttcttgttaattctgatgaagggctgtgaagggctggctgcttgcctgacttgaagaaggtgcattccctctgccatgcaggtgaacacacgagactcagaatggctgggggtgttcccaaggtcacatcctggctgtcagcacattgagggctcagaccaagttctttgtgactccaaaatcagtccttttcatgacttgctgacaaacctaaagataaaagttagggccttctttattctttcccttgactgcctttgccagccaatgacggacaacctctgacggctgggatggaggcacccgcaggccagccggagtcttctccggtacttaccagtcagagtggtgagactcacagacgctctctcagaaactggcagcttacactcaacacccggtgcctagttccccaccctgtctcctctaactcctcacc

SEQ ID NO: 12038 - DNA, 391 bp, Homo sapiens
ttttttttttaattaattgccaacactttaaacactggagagttcatataaaaatctggatgtctagcacctcttgagaactcggcatatgtggccacagtgggtccacaatttctgcacagcagcaaatgaggagacgcagtgcatgtggcactctccaggtggccaccctcagccactcacatgcatattcgtttctgtggcccactgctgaagaaaggccactgcggggcatggtgccatgtacctgtaatcccagctacttgggaggctgaagtgggaggatcacttgaacctgggaggccaaagttaaagtgagccatgatcgtatcaccacactgcagcctgggtgacagagaccctgtttccagaaaaaaagaaaaaagaaaaa

SEQ ID NO: 12039 - DNA, 1585 bp, Homo sapiens
cccgcttcaggagaaactgtatgtgccatcccttttctcagagcattatgcacagataattgtgtaactgcatgaaacatatattaaaattaggtcagaagtaaagtatggttggaatttgggtatgcgtctgccacttgtctgtgtctcaagcacttaaaaacatatcctattcctggcacagttcagtgcatttcgggaagtgaccaatagtcagggaaataatcaaggtttctggaacaaaatgcaagagttggcctgagatcactgctctacctagagaggagtagggcaaggccagtctgggccatgattcagagtaaggatgactgacccagccacaggggaggacagtgcccaggacctgtgtactcctatgttcccaatgcctaagagtgcccagcccatggaaagtgttcagtgaatttaatgaataaatgattctacagaaatgggcacggggaaggagaaagggcctgcagtcttttatttttattttattatttttaaaattgagatggagtctcgcactgtcgcccgggctggagtgcagtggccacaatcttggctcactgcaacctccaccttccaggttaaagcgattctcctgcctcagcctcccaagtagctgggattacaggcgcccgccaaccacgcccggctaattttttgtatttttagtagagatggggtttcactatgttggccaggctggtctcgaatgcctgacctcatgatccgcctgtcttggcctcccaaagtgctgggattacaggcgtgacgactcgcccggccggtcttttattcttcatacaagtgtccttcctgcacatcccagagctatctaagacccattctgatcatcactaatgccagttccctcttctgtaaggggcagtaacacccctggtgctgcctacctcacaggattgtcctgagagaccagcgagattctgcatgtgaagggtctttctctgaatagtgaagttctacaatgtgactcatctttgcggaccctgtcctccacgtgagggtgggagacctctgctcattgccatttcttttcagattctgcagtgttaagttggaaggtttccacggaagccacattattattacataggaagtgacatcactttccagcttgttttggggggccaaaatcttgctatgttcttggccagcacctcagtttccatcctccttccaacccattgtctttctttgtaactctgcctaacaggtctgggaggtccaactttgactgaggatgttaccttcccctccccagtgctgacctcctccctcctagttacttggcataccgggaaccacatcatcaactcctgtgggtaaaaggtgacacatgagccataacactgcttgctttcccagagatgcctgggtttccaggagctgccacatcactcttcctcttttgcatcttaatgttggcagtgggaaagagttagaggtggattcctggacccagtctggcctgcattatttcagcatgtggaatagaggtcactaaccggtgtgccacaggctagtctcagcttgcaaatgtattttgtccacataa

SEQ ID NO: 12040 - DNA, 2872 bp, Homo sapiens
agtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcaggtctgtgcttttgcagccagagcttgtctgaggcctctgctgcttacttgaatcctggttgctcttcacatcttgatgagcttctcttttttagtctaataggtataaaaagcatgttgttgttgtttatttaagacagagtcccactctgtctcccaggctggaggctggagtacagtggcttgatcttggctcactgcagcctctgcctcccgggttcaagtgattctccttcctcaacctcctgagtagctgggactataggcacccatcaccatgcccagctaatttttgtatttttagtagagacggggtttcaccatgttggccaggctggtctcaaactcccaacctcaggtgatccgcctgccttggaaacagtatctttttaattgaatagttttcttatgaccaaaggaatgtattatgttaagtgaaagaagggaagaaaaggaggaggaaaagataaaattgaaaaaacaaccctttctttctacccagaaataatcccttgtaaacatcctggtggtgtgttgccaaactattgttttgcatttctttctttttttttttttttagtggcatctgtttaaatatcccatttttttttttcactgaataaaatatcaaacctttttaattttgtagctccctttttaactcagtttttcatttagtaaatatctacagagtgcctactccaggccaggcacatgctagggcctgagtggtcaagtgacaggcgcagagcatgtggccctgtcactgtgaaacatatcctcgttcctggtcattccttgtgactgatgcagccatttccatctgtcaccctggagagcctctgtgtctgtgttcctgagggtagggaaggagacagaggagagttgagcggtgaatcccagttgcgttgctcttcatgcattcttcgtgtgtgcacatgtggggacagagtctcgcgacattgcccaggctggacttgaactgctgggctccaagtgatcctccacctctgcctcccagagtgctgaggttacaagtgtgaaccactgccctgacctttgtatgtgttgaggagcctttaaactagagcccacgcttacctgtgaagctgtgacgtctcctaatgtggttgctttgcgtattcaacttaggacatttggttttactgttaaaccacggttttgtttgttgcttacagtttgacaacttaaatgctgcgcatgaaacctctaagttggaaattgaagctagccactcagagaaacttgaattgctaaagaaggcctatgaagcctccctttcaggcaaggatgctttttttcctctttaaacagaataaaatctgaaggaaccacatgatgttttaagatggaaatgattcataacttcctgcttcagcgaatgccctgtggccttcaggctggggtgttcttggttcctttttgcgttgtttattgttaacagatgccttttcccactaaggatgcaaataatagttacaaatgccagccttgtgttaaataggatgggctttggaagactgtaaaggccattttggcggtggtggttgccagcttaggtccctgggaagtggcaagtacaagtttctatcttgtaatccacagtaaaggatccaccccaagtgctcctgcacagcagtgttgctgtgaaatgtcgatgccacttattgaatagaaaaatagtcttttctatttttcatctgtcatcagtgggagggtgtaagccattgctttcagaacagaatcggcagtgtcgctcacagtctttctactaaaccagttgcatcttacagagcagcgtggatgagtgctaagaaccggctgtgtgaccttcagcaaggactttctcaccacaaaaatagagttgcccaaagtcaggcagaggtgataatgtgtaaaagtgactggctccaggcagacttgtagtgaacattgtttttcttccttcctgctagaaatgagtataattttagacttatgtttaggttatgaagagcaaattgaaaagagcacagggtttccagaccaggagtctggagtggcatttatgggagcctgccctgaaatggcactcagtgttgtcctaaggtcgcatggcctctgtgggccatggtgggcttcagtgggcctcagggctctcagtcataaaatgggaatgtctaccctaaccacctctcaaggccattttgagaacagatggccaatttacataaaagcatactatagatgtaaagtaacgtcatacggcttcatcatcaacccctacatctatatgctttaactgttttagagtacattgatctcatagaatgttattgcctcaaaaatatccgtttattttcccagaaattaagaaaggccatgaaatagaaaagaaatcgcttgaagatttactttctgagaagcaggaatcgctagaggtgggtgaatgtcaatatcccagtatcccccacaaaaaaaaatatcatttttgattttgtttggttttaatgtttctgtgtacgtatgctgagtttctggggttttcttgttaacttaagttccacatttcattgtgttttagaagcaaatcaatgatctgaagagtgaaaatgatgctttaaatgaaaaattgaaatcagaagaacaaaaaagaagagcaagagaa

SEQ ID NO: 12041 - DNA, 12284 bp, Homo sapiens
agtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcaggtctgtgcttttgcagccagagcttgtctgaggcctctgctgcttacttgaatcctggttgctcttcacatcttgatgagcttctcttttttagtctaataggtataaaaagcatgttgttgttgtttatttaagacagagtcccactctgtctcccaggctggaggctggagtacagtggcttgatcttggctcactgcagcctctgcctcccgggttcaagtgattctccttcctcaacctcctgagtagctgggactataggcacccatcaccatgcccagctaatttttgtatttttagtagagacggggtttcaccatgttggccaggctggtctcaaactcccaacctcaggtgatccgcctgccttggaaacagtatctttttaattgaatagttttcttatgaccaaaggaatgtattatgttaagtgaaagaagggaagaaaaggaggaggaaaagataaaattgaaaaaacaaccctttctttctacccagaaataatcccttgtaaacatcctggtggtgtgttgccaaactattgttttgcatttctttctttttttttttttttagtggcatctgtttaaatatcccatttttttttttcactgaataaaatatcaaacctttttaattttgtagctccctttttaactcagtttttcatttagtaaatatctacagagtgcctactccaggccaggcacatgctagggcctgagtggtcaagtgacaggcgcagagcatgtggccctgtcactgtgaaacatatcctcgttcctggtcattccttgtgactgatgcagccatttccatctgtcaccctggagagcctctgtgtctgtgttcctgagggtagggaaggagacagaggagagttgagcggtgaatcccagttgcgttgctcttcatgcattcttcgtgtgtgcacatgtggggacagagtctcgcgacattgcccaggctggacttgaactgctgggctccaagtgatcctccacctctgcctcccagagtgctgaggttacaagtgtgaaccactgccctgacctttgtatgtgttgaggagcctttaaactagagcccacgcttacctgtgaagctgtgacgtctcctaatgtggttgctttgcgtattcaacttaggacatttggttttactgttaaaccacggttttgtttgttgcttacagtttgacaacttaaatgctgcgcatgaaacctctaagttggaaattgaagctagccactcagagaaacttgaattgctaaagaaggcctatgaagcctccctttcaggcaaggatgctttttttcctctttaaacagaataaaatctgaaggaaccacatgatgttttaagatggaaatgattcataacttcctgcttcagcgaatgccctgtggccttcaggctggggtgttcttggttcctttttgcgttgtttattgttaacagatgccttttcccactaaggatgcaaataatagttacaaatgccagccttgtgttaaataggatgggctttggaagactgtaaaggccattttggcggtggtggttgccagcttaggtccctgggaagtggcaagtacaagtttctatcttgtaatccacagtaaaggatccaccccaagtgctcctgcacagcagtgttgctgtgaaatgtcgatgccacttattgaatagaaaaatagtcttttctatttttcatctgtcatcagtgggagggtgtaagccattgctttcagaacagaatcggcagtgtcgctcacagtctttctactaaaccagttgcatcttacagagcagcgtggatgagtgctaagaaccggctgtgtgaccttcagcaaggactttctcaccacaaaaatagagttgcccaaagtcaggcagaggtgataatgtgtaaaagtgactggctccaggcagacttgtagtgaacattgtttttcttccttcctgctagaaatgagtataattttagacttatgtttaggttatgaagagcaaattgaaaagagcacagggtttccagaccaggagtctggagtggcatttatgggagcctgccctgaaatggcactcagtgttgtcctaaggtcgcatggcctctgtgggccatggtgggcttcagtgggcctcagggctctcagtcataaaatgggaatgtctaccctaaccacctctcaaggccattttgagaacagatggccaatttacataaaagcatactatagatgtaaagtaacgtcatacggcttcatcatcaacccctacatctatatgctttaactgttttagagtacattgatctcatagaatgttattgcctcaaaaatatccgtttattttcccagaaattaagaaaggccatgaaatagaaaagaaatcgcttgaagatttactttctgagaagcaggaatcgctagaggtgggtgaatgtcaatatcccagtatcccccacaaaaaaaaatatcatttttgattttgtttggttttaatgtttctgtgtacgtatgctgagtttctggggttttcttgttaacttaagttccacatttcattgtgttttagaagcaaatcaatgatctgaagagtgaaaatgatgctttaaatgaaaaattgaaatcagaagaacaaaaaagaagagcaagagaaaaagcaaatttggtaagttgtgtgtgctcctttatcagtatggaatttttcttctcagttgccttttagagtcattcaagtactcagcagccagagaaataacacaggttgggaatccttctcatgtctggcaatgtgctttctaaggtgtgtaaaacaactgctttgcttactggcgtcttgttttaccatcctaaaatctgacatacggatgaagtccaggatgtttctggtggtctaagctaaaaagaaggaaactaccaattaggattagagttttatgtgaagactttatttaaaaaaaaaatcactgtattgagataaaacaaactacaaagttcactctttctttttttttttttgagagggagtctcactctgtcactcaggctggagtgtagtggcgtgatctcggctcactgcaacgtccacctcctgggttcaagcgagtctcctgcctcaccctcccgagtagctgggattacaggcacgcatcaccatggccagctaatttttgtatttttagtagagatgggattttaccatgttgcccaggaaaagttcactcttttaacatgtaaaattcagtggcttttagtatattcataaagttgtccattggtcaccagtacctctttctagaacatttttatcacccccaaaaggaaccctggacccattagcagtcactccccattcccccaaattccccagcaccaggctctcccccgtctactttctatctctatggatttacttattctgaggaatgaatagaaaaggttgattgtagaacatgtggtccttttaagactggcgtcgtttacttagtataaagtttccaaggttcatccgtggtgtagcctatgttagtatttcatttctttttatggatgaataatatttcgccgtatggataaatgtcaattctgaaaagtacaaatctcttggaagctgaaatttcttgtggcacatttgtcctttctccccagccttaccccaacctttgtctttttgaaaaaaatttgtttccttgctgcttctgcctttagtaccactgttttcatttcatgtttatactctgagactgcagaagcaaagcttttctccacttcaaatctctggccagctctagaaagtacatgtgtggatctctcagtgagaccttctgcaaataatgtcattgggagaccctctagctatttgataacattagatgagcttatattcaaagaaacttcaaagctatttattctagaagattcttaggaagagtcagtgatttcaaaagaaatctagacttacatgcagggatatgcagggtataaactttattgatggctcaggaaacaggtttgaaagagcttccggtacacaaaggggattcttctactgcagccgcttttgaaaagctaaggcagagtcagagtgaggaacacagaagcatccaaccgcttctgtcacgtaagcatgctgaggctgcggaaaaagagtgcgtctgactgtagtccgggagaaagggatgggctggcagaggaggaggagaaaatgcagagggtacaagtcttgtaaatgctctaattttaaaactgacggtaagttatgccatttccctctaacaaaaatgaggtaggattcgctattttcaaggtaaaaaaaaaaaaaaaaatcctgcgtacaagggtaacactgtataaaatgtatgaaatttaaaaattgatacttagtatttgcatgtacttatggggtacgtgtgatgtgttgagacaatcatagactgtgtaatgcccaagtcagggtatttagggtatccgtcatcattatcatttctttgtgtttggaacattttatatcttctcttgtagctattttgaagtacgcaatatattattattaactatagtcaccctactatgttcttgaacactagaacctattccttctgtctaactgtatgtttgtatgcattaaccaacctctcctcatcccaccccaccccacctcccaccatacacacgcatacctctcctagcctcagggaactatctaaagaacctagaattaaagatgtattagtccctgccctgaccctttccagctctggaagctttcctgatctttcctgagtaggtcgcttaacccgtggaacacgtttcctctttctgtgtgaagtaaggggtttggattaagtaatccccgaggccccttcctggattctccctaaggattggtccagagcagaaaccaatgccccggaagataagcttgatgaccacaccaccgactcttacctaagacgttgcttcattaaacatatctgatcagtggaccatatgctgttcttctgtagcataaattttgaatggtttagttgaatttccgaataaagcaaggagtgggtgggcggtggtgggaaatccacactgatggtgtgctctcagaggacgcctcccctgatgtagcatttattttggagagttttgtgtttttgagacaggatcttgttctgccaccaggttagaatgcagtggtgcattcacagttcactgcagccttgacctcctggctcagttgatcctcccgcctcagcctcctgagtagctgggactgtaggcatatgccactatgcctggcaaacttgtaatttttggagagaaatttaaataggctgtgtactccatgccgtgtaggtactggggtgtcacaatagaaaatgatagtattatgtctgccctagaagtacggcccagtcaacgtagccccatcataacaaaaatccaaacactcaggacattgttatccctgttgttttccagagagccgtataatgcactgctttttctttcctgatcagtttgtttggtaggagagaactgttgttccctgttctcccagaaaatgccaataactgactcacagattgcctcatctccagccaagattctgttttgtatgtaagcaaagtttttctcttgatacaataacatgtttgatgcaactcacatttttgcatattaagttactgataaataagtgaaatgtttgctttcagtattaggaccagtcttcgacattaaggtgctcttgtttttcacctctttctttgaaattgctctaagatgatgaacatctgtcgcttgctacttgtctaatgtctcaatctaatcaaagattctttctgttaagaatttgaactatgtggaataagagcagtatcttgctgtgtcctttccagaaaaatcctcagatcatgtatctagaacaggagttagaaagcctgaaagctgtgttagagatcaagaatgagaaactgcatcaacaggacatcaagttaatgaaaatggagaaactggtatgtttccttcagaatgaaagaggatcttacaaatggggtaatatgtgtgaaattgagccctgcattttagaactgtggagttgggttaactgctcctaaagatatttagaaattatacaaaagataaagttcacattttctttccaagtttgttccatatttattcattgctgcctcctagaatgttttctttttcaaggaacatgtaaaacagcacccagtccttggaaaaactacaaacaaatcaggcttatatttcagtggtattttggatcttcacctgcataagaaaaatgtttaaatatctatgtaaaatcagtactttaatataccagccaccctggacaggtttcttagatccaaaacagttggatacgtttaatagaaatgaatagaaatgaatttaatagaaatgaatagcaatactatttatcaaaattcttcatcttgcttcttgtgaattagcatgtgataaaagaatcgtgggctgggcgcagtggctcattcctctaatgccagcagtttagggaggttgagatgggtgggtcacttgaggtcaggagttcgagaccagcctggccaacatggtgaaaccctgtctctactaaaaatataaaacttagccgggtgtggtggtgggtgcctgtaatcccaagtactgggaaggtggaggttccattgaggtgagatggcaccagtgcattccagcctgggcgacatagcaagactccatctcaaaaaaaaaaattgtgctataataagattaatccatttggacaagtagcaggtgttaccaaaaatatgaattaacattcactttgcagtgtctagaacagagaacgatgttagtgtgagtggcatgttcagtgttcagcgtcagtcttggcccggccctgaaatacagctgctgccagccaggactctaaccaagttggcagagtttggcaaggcagcttaagtgatccccgccctcgcggtgccttgctgttgactgtccagctgccgcatgctactggcctcttctccccacagtgatgagtgactcaggcttctacaagtgcctcattcaaacccaaaccagccctggacagtaggggacatgggggacctctctgctgcttggtttgtgttggtttggcgtttggttttcttctggagactatgactcctgttgagggagataacggccaagcccctgtgtggatataccagcattttgaattatcaggaaatttttgtaaaggaaggaaaggaactcatggttgttaatgggccaacctagtatacataccagttcctgccaaaggtcgtcctgttcgactgagtctggtatcttctaatctggtagtcagggatgactcagatgatcctgttaataggactgctccatatgccattcatgcatcaaaactttcaaaaaatcatgtgcaataaatcagactttgctgtaaacttaccaacacatttaatttctgatgatctactatttgtttcttgccatgccccagaggtatcctgataatatccttcagccttgcattgtgtatgtgtgcaagaatgagttgatacaatgagagggagacccactgttcccttcatatttgtaaattacaggcctcggatgaaattaagagacttagaagcacaggaagttttctaagaaagacagctttcccatgaaaccggcactgcccataatcagctctgtgacattattaggactagtttccctaggatgagatatttaaaggacaatacctcccaatctcaaattccaggtttttttccacgttgttttatctgggaatccttcataattactgaacgtagactccttttctggaaagtgatttaacctgaacaggttgtcctgagctgcttctggataacaggatgtcttaagaacaatcaggttccaaactaagcaacatactcaaagcgcgttagtcctgctacaaggacaaggacttagacttaatcctgacggagctataatattgcctcttcataaagccttacctttagaaagtgagtgggggatggaatcaggtcttcatcatgttaagtgattaaatgtcctcaggcatcttatcctttcatctctccgctgatcagtttgtttgccttgaaagttcagcctgcacagggcagcaagagaacagacctatctatcttcagctgacctgaggagactcgtggcatgttacttctttgatgggatgctctaagagctctatcgaattgaagctttgtatggccactcagacgcaaatgctgaaaacttaccatgaaactgagttcaagtccatagtaaacgttgccagggactgtgaattgctggcctgtgagttttcatcagatgtgggaatctttttttttttttttccagcaaaattcaccgtaagaagatagataagctttgataagtgtgggcagtgtgtctgcagggtttatttcacattgaaacagaaagaggcaccaattcttagagaattccaaaacaacatgacctggaacaaatctgttacccactcgtatcaatatttaagtgtcctggcatacatgttttaaaaatacccagccgctctgttttgctgttttaaaatctttttcagtatgtttgttagtgtataaatattttaatatggaattgcattttccttaattaaatctccaaagtgtgcttgtgtcgtgaggtgccttaagaaatgaggggttttttttttaatattgtataaatgttggaattcttgtttatgccaaggtggacaacaacacagcattggttgacaaattgaagcgtttccagcaggagaatgaagaattgaaagctcggatggacaagcacatggcaatctcaaggtaaaaataaaacagtgctgtttctcccgagctccccgctcccttggacatccagtgtactttctggacacgctctacccctgcacctcctggaaatatgatggaagcagatggttaaaagggcattgatttctctgtggaaaatatgattgtagtagttcatgcttttaccaaagcggcctgaaaactgtacactgagacccaggccagcaagcctgctcccacggcctctggctgcctctgagaatgctttcagacaaagagcaacacaaaaccaaatagaaaacagcctgcaacataagatagtcataaaacatgtcgaatatttgcaaaagtggctctcagcctactatgaaattgcccaaaaagtacagttattattatatatttttttgagatgaggtctcactcttctgcccaggctggagtacagtggtgtgatcttagcttactgcagcctccacctcctaggctcgagcagtcctcccacctcagcctcctgagtagctgggactacaggcacatgtcaccatgcgtggctaatttttgtatttttaatagagacagagtttcgccatgttgcccaagttgatcttgaactcctggcctcaagttatccacccaccttggcctcccaaggtgccaggattatgagcttgagccaccacgcccggcctgtgtttgggttttcttagccagccaaatacctgtgaccttgtgcaggattctgttttatcccaaaggaataattttggactttaaagtttcaaacgctaagaaaaatttttcaagttttttttttttttacataaatctcatggtttctggcctttttcttcaaggcagctttccacggagcaggctgttctgcaagagtcgctggagaaggagtcgaaagtcaacaagcgactctctatggaaaacgaggagcttctgtggaaactgcacaatggggacctgtgtagccccaaaagatcccccacatcctccgccatccctttgcagtcaccaaggaattcgggctccttccctagccccagcatttcacccagatgacacgtccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaagtctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcataaggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctgcattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaagaattgcatcctctgacct

SEQ ID NO: 12042 - DNA, 301 bp, Homo sapiens
ccacttgtttctttttttttttttttttttttttgagacagaatctcactctgtcgcccaggctggagtgcagtggcgcaatctcggctcactggaagctccgcctcctgggttcacgccattctcctgcctcaacttcccgagtagctgggactacaggcgcccaccaccacacccggctaattttttgtatttttagtagagacagggtttcaccgtggtctcgatctcctgacctcatgatccacctgcctcggcctcccaaagtgctgggattacaggcgtgagccaccgcgcccgg

SEQ ID NO: 12043 - DNA, 1034 bp, Homo sapiens
caccagtacctctttctagaacatttttatcacccccaaaaggaaccctggacccattagcagtcactccccattcccccaaattccccagcaccaggctctcccccgtctactttctatctctatggatttacttattctgaggaatgaatagaaaaggttgattgtagaacatgtggtccttttaagactggcgtcgtttacttagtataaagtttccaaggttcatccgtggtgtagcctatgttagtatttcatttctttttatggatgaataatatttcgccgtatggataaatgtcaattctgaaaagtacaaatctcttggaagctgaaatttcttgtggcacatttgtcctttctccccagccttaccccaacctttgtctttttgaaaaaaatttgtttccttgctgcttctgcctttagtaccactgttttcatttcatgtttatactctgagactgcagaagcaaagcttttctccacttcaaatctctggccagctctagaaagtacatgtgtggatctctcagtgagaccttctgcaaataatgtcattgggagaccctctagctatttgataacattagatgagcttatattcaaagaaacttcaaagctatttattctagaagattcttaggaagagtcagtgatttcaaaagaaatctagacttacatgcagggatatgcagggtataaactttattgatggctcaggaaacaggtttgaaagagcttccggtacacaaaggggattcttctactgcagccgcttttgaaaagctaaggcagagtcagagtgaggaacacagaagcatccaaccgcttctgtcacgtaagcatgctgaggctgcggaaaaagagtgcgtctgactgtagtccgggagaaagggatgggctggcagaggaggaggagaaaatgcagagggtacaagtcttgtaaatgctctaattttaaaactgacggtaagttatgccatttccctctaacaaaaatgaggtaggattcgctattttcaaggtaaaaa

SEQ ID NO: 12044 - DNA, 278 bp, Homo sapiens
tttttttttttttttttttttttgagacagaatctcactctgtcgcccaggctggagtgcagtggcgcaatctcggctcactggaagctccgcctcctgggttcacgccattctcctgcctcaacttcccgagtagctgggactacaggcgcccaccaccacacccggctaattttttgtatttttagtagagacagggtttcaccgtggtctcgatctcctgacctcatgatccacctgcctcggcctcccaaagtgctgggattacaggcgtgagc

SEQ ID NO: 12045 - DNA, 1268 bp, Homo sapiens
cagtaaaggtcgtatctcctcttagtttatatttcccaggaatttccactgcaacagcagagttggtcatgggctcacagagctagagtgagaggtaagctcttcttctctaaattcaaagctatctatgtttgacaaataaattttggctggctgtaacaatttctgctgtataagaaaattggacaaacttggtaaatatttttgaatatcgtaaaaaatgtctaaacaaagttgaatgttcttaatctatgcatctatttcatattgaaagctaaacttctaaaaacttgttctagttattgaatagactaatctacaattacacctttgagtgcagcagtttaaaaaaatgaagtgtccttgaattttttcagtaccttcataaattaactcacatttgttaaagttgctactaagacaaaatgacatttctaagcatttgagtctggagttgttgcttgtgggtaagtagttgaactgtatctagtacattttaaaattctaatatattgtggtgatataaaagagaatacttggtattgacccacgtatcaccaccaccaagtctttctggatgtattttaagtcaacttaacttaaaaaacacttatcccactttttattttttacaaaaacgtgctcatttaatagaaatgattgattatataaaattgtttacacatgtataaaaactaggaacacgtatgtaggtaagcaatcaaaatcatgctttctgttagaaaagttaacacttctgtgaatagactggatgacttccttttagtttggatgtctgggtcggactcacgagacgctggggttggggtgtggtgcttgacatcagcctctggcaaagcactaataaaaggaaccccaaagctgactgtgtacacaaatgggctttccataagttcattacatttccttttccaagtcaggaaaactcaacagtggtagctactgtggtctgtccttgaagattctgagcagtgcaaatgtaatatcctgcatcaatcgtctcgaagtcttccactgtaatgacactctgggagattctcgtggtgtgtcccagtcctctgtggatcaacctccaagtgtcttggatcgtcacaggcctttcatcctgtttaacgacacccacaaagactgaagcaagagggacaagctgctataaagagctcccactcacccaacactgttgagcgttcctttcagagagcaaagcacatgcttataaaagactgtttagtatgcgtagctcataa

SEQ ID NO: 12046 - DNA, 21632 bp, Homo sapiens
ggacgatggcctggagcacagggagctgggccatgggcagcctgaggccagaggccccgctcctctccagcagcaccctcaggtatggcagtccccacctgcccctcagaaagtgtcctcagaagactctggggcctggcataagatggggaagggagggagatacgacatcagtgcaacaggcagctctaggacccatggttgccctataagatcctgggtgctggatccacactaaggtgtaggcacacacacacatgcacactcacacacccatacacacacatacacacaacagcttgccagtctcaggtgaagcatgtcccttttccaggaaggagtctgtcctttcctggagccacacatagtcctgccctggtatgtctcccctctatccagaaaggtggctagggccagaggtgggatggagccaggctccagcgtgtccagcagaatgctctcactgtgggaatcaagacccagtgcattagcttgccggagctgttgggatacaggctgggcgccttaaacagcaggcatttaccatctcacagttctggaggctggaagtcaaaatcgaggtgttggtggagttggttccttctgggggctgtgagtgtgagggcaggggctgttcccggtctctctccttggcttgtggatggtcatcttcttcctgtggcttcatgtggtttccctctgtgaatgcctgttcagatttcctcttcctataaggacaatagtcatactgggttaaggcccaccctaacgacctcattttaatttgattacttctgtttgtaaagaccctatctctgaataaggtcatgtttagaggtactgggggttgggacttcaacatataaatttgagggtggggaacataatttactccataacacatgatgacaggccacacacatgttcttgaacagttacatagtccaggacaggaggacatcctggtcagcacaagatccagcgcccctcccctggttcctggctttggagccccaagggcccggggagctggtggaatgggtggtcagtctggggtgcaaacctgtcagggggctgcaggggacagggggcttagagagtcaaaggccagagccccactggacagcaggtctaggtttatcctggaatctctctaggaaaggggcctgcttggcagttcccaagacctcaggcagaagtagagggagcaggaccctgaaacactggagaccaaggccccatctttcccctaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacaggtgagaccgggaggagggtggcgggtggagggaggggctcggctgcacgagtccatgtgggtgtcttggtgtcacttgggacatttttagaggccacagagtgcttagccttgttaggcccacgtagtacccatggagcacatggaacagctggttattgcatttggccgatgaggaccaaggctcacgaaatctaaggtgacaagcctgtggtcaaatagcaagtggtagtcaagccaggataagaattccagtctcctgccaatgcactcagcccttttaaaaaatgatatttattactgttgctctgcttgtaaaaagagctcagaagtattttagacattttgaagagtacagaaaaacctaagaagaaaagaaaaatcaccaaccagtatcccaccacccagaagtaaaccctctgaaattctgctgtatttcagtccaggctttgttctggccatatgtacatgtacagatgccatgaacacatgaactacgttttgtatcctgctttacttagttaacatattatgaatccttcttggcataattagtctttaaaactgagagtctcatagtatttcattaatgtatttcatttttactgagggatcccttatcagttagacatttagattatagcttatttgaatttccttatgcataaatctttcctcatgcttgggattatttcccaaggttcactctaaagaagtagcattcctgggtcacatggtgtgagcattttgagagtcgttggtgtcctagacgcacagaaattgaccctcccacccgcaatgagcaggaccctcctctgaagacttcccacgggtcagactgaaatagtcacttctccaaagctggatttgtctatcacatggtccagtgtcatcgtgggcttcttagctcccggtttgggggtttcctaggaattcttttccctcctgctgccccttggtagcctctctgggttcatgacacgtgtgtgagatgctgtacgttaggcctcatgctttgctctgagcacttgagggcctggtgctgggccctcgagtcctgggccacccagcagtcgtgtccgcatgtgggaaggccgtggctctgtggcagccatgttggctggagctgtgttgatgtgttggctgctgccacctggggaagtgtctgggcgtgtgtggacaggtgtgaggggctggggctggggtaggggcaggatgaaatgcaggcctgtgtgggtgtgaggggtgtgtacccgcccggctccatgtgggtgcctgctgtggcggtgctggcgtgttctctgcagccaaggccatggggcgtgaggactccctgggtccccgctctgacccttgctcctgcagggctgatctatgactcggtcatgctgaagcaccagtgctcctgcggtgacaacagcaggcacccggagcacgccggccgcatccagagcatctggtcccggctgcaggagcgggggctccggagccagtgtgaggtgaggaggcgcgggtggggcccgaggaatgggtggagggaggagtcatgggaggggaggggtggggggccctggggcccatgagagatgaggggcacatggggtggtggtgatgggagggaaggggcgagcatgagctcagagctctgtggtccccttttcagtgtctccgaggccggaaggcctccctggaagagctgcagtcggtccactctgagcggcacgtgctcctctacggcaccaacccgctcagccgcctcaaactggacaacgggaagctggcaggtaatggcctagtggccctgtctccccatgccagcttacctcacccagctcccatgcactcctgtctcggctctgcccgcccagccagcctcctcctgcaccctggacgtccctactccagcttgctgccaagcccctcctcagcccacctccacctctcccttccatatttctctcccccaatactcacccggccctgctctctgggctccctgctccctgttgggccaaaggctgagagtattcacgctgacgtgggctgggcctctccccgcagggctcctggcacagcggatgtttgtgatgctgccctgtggtggggttggggtaagtgtgcccaggggtctcaggggggcgttgccagggctctcagctctcctccctgtggttctcccaggcccagcccctgcagaacctctgcttgttgtggttctgccagacagggtgagccagggacttcctgaggtgccccctgcagcaggaagctccttttggacaggcgtgtctcggacccacagtctcccccgaatgcggagtccagcctaagccttcccctagaaggtgtctggtagatgttgagtgaggtttcaggagcagggccaaggctggggcttaggatcatctctcccttcaaagacccccatgactgggcattggccgccaggctgctctgtctgctcttaagtggcaagttggggtacctcagcctggtccccagaccttgggctgcctggtgtgacatcacggtggtgcttccggtgtccttggcgatcccagcactccccactccgggacatagccccaaactccgctcgcgagctttgcttcctaagtcctcacccctttgtgaagggagcttcccgctccctccggctcagctctcctcgcctaacactatccctgcagtagtttctcaagcaaggtgtgtagaggcaggggatggaggcctcattccggagggaaagtgggagctgtagctggtgggggactttgggagccagtcagtgccctattcacaacttcccatttcttgccactttctggtttttccaactgttgttgcttctgttttctcctccctcctctccctctctgtctttctctctctctctctttctccagcctcttgcgactctctctgccttcctcgcctctcttggtctgcctcgccctccccatctccccatcatgccccccggcccctccctagccttgaggcccagggactgggtttggggggcctcccagcctgggctaggggccctgagtggaagacagtggtgcagacggcccctccagctccgaccgtcccgcagggcctgagcagagtcagctggggcttaaaaccccctcccggcccaaaccccaagtcccgcccaggtaacgccatgccccctcccctgaccggggaggcaggcgtgatgctgccagcagagtgctggccagataatgggctggtgctgggacttaagctgggaaaaagtcatgctgggattgggggacacaggaggccttgcctttgggcggtggggcactggggaggcagcactgtctgcccagctccctgcccctggggtcctggccgtggggtggggaccacccccttgggccctggctcctgtgtgaagccttggatgatgcgggccctgactctggctcccgcaggtggacactgacaccatctggaatgagcttcattcctccaatgcagcccgctgggccgctggcagtgtcactgacctcgccttcaaagtggcttctcgtgagctaaaggtaggaggtttgggttgaaggtggacacaccacaaaggaggaagcagagtggggtagtggggaatccaggcccagaaccccaggcatcgcattcctcttagagattgctacagggttttggaggggaaattgagggctctgggaaccaggttgagattggaactcttggggtacgttcatgcagctgtgggtcagagctgtctgttgattgacaagcattctttctttttccagaatggtttcgctgtggtgcggcccccaggacaccatgcagatcattcaacagccatgtaaggctaagggaagacctgggtgggatgaggtggggggcaagcccccaggaacttccttcagggacattctctcttcttccctgagctttctcaggctgggccaacccaggggcctggggaggtgagggcatgtggagagaatgggctggcaggacctgtctctccttccaggggcttctgcttcttcaactcagtggccatcgcctgccggcagctgcaacagcagagcaaggccagcaagatcctcattgtagactgggtaggtgcctgtccgtagcaccctccaattcgagagccctgggggaaaagccctgagcctgatgttagagatgcggcttcatgtcttagttctgcagtagcctctctgagcctcagtttccccttgtgtaaaatttgggtgaagataacacccacatcacagttgggaggcctagaggggatggcgtgtgggaacgcattcagccatcgcaaacccctgcaacgagtaggagctgtcatttgagtgttgtcttttgacctctattggcttcttttggcagatctagtaatttctgcatttcctgtacaggtagtgatgataagaataatagcagataacatcagtacaccactaatcacatccagacactgatggttttacacatgatggatttaatcctgactataacccactttacagatgaaagtgagcacagagagattaagtaactcacacacagtcattcgtaagtcatgagatggatttgaacccaggcgggttagctctagagtgcttgcgtttaactgctaagctatgtcccttctgcactgacagctgtgtaagagacatttctaagcagaagttgagagcggtggaggacctttgcacacttgagttcccgcatggtcctgtgagtcgagtgtagggcccagctctccctacgagggatggggctgggcctcgtgtacctgcccctctgtaaccgagcttggtttctgatctcctcataacttcatgactttatgcaagacagagtggttcctgatatgtgtaaccctgaacccttccctctccttgccactaaccccatgtccacacagttactctctcaggtgggctggcctgagattgggacacctcctctccttcaggatctcatattacagccagccctgtccagcacagagaggccgaggttcagagccgggcagtggattacgtggggccactcgaccgtgtggctttaggaaccccaggttcctgatcccagtctagggtcctgacctcagaatggccactgaccttgaaacccttctaacctgtcctggcccccatctctctgccttccctaatcgctgcccgtctccctacacaggacgtgcaccatggcaacggcacccagcaaaccttctaccaagaccccagtgtgctctacatctccctgcatcgccatgacgacggcaacttcttcccggggagtggggctgtggatgaggtaaccgcatgtcagggccacatcttccagcctcattgacctcctcctgacacttactctgcctctgtcatgacgagctgtgtgatcctgggcagactgctgagcctctctgatcctaaacttccccacctggaaatggggaggctggatgagctgggctggcagctctaacaaactggtgttccccttctgggactctgctgtcctcatgtctctcttgcctcctgttttccaggtaggggctggcagcggtgagggcttcaatgtcaatgtggcctgggctggaggtctggacccccccatgggggatcctgagtacctggctgctttcaggtacgtgctctgggggcccagaggggcaagtccaccctctcctgtcccttctcccaagagcaccaggggggaggtgatcagttggattgtcagcctgtccccaccagttcctagacattgtaggtgaacgccagtgagaataggacaaacagagagaagaatgcaaaagtcaaagggtgctttgcaaaggcatacattaccgagagccaatgtcaaactgattgctggcaggtgggtggtggagtgagcagagctggcacatttagtcagagaaggctgccactctatttgggaaaagagaattctggaaatggatcttcaaacacttttctggagttatctccatgacagctaattctacgagagccctgggctggagttcctggagtcttctcagagcccagggctatgaagaacacccaagcaggccccagagttggatcaggggtagaggaaggcagctgggggggggcctggaagagggagaggatgagagaatgtagccaggtggcgcagaacctcagaggacctagttgtcccctactcagctctcaagtagtgagtagctgggtgtggtcaactcagtccaaaggactgagcacttgtagtccctgaagctttgtgaccagagtccatctccgcaaggctgtgagattaccctttccctgtggctccggccactgcaccccacagatgcttgcatgcacacacacacatgcacacacacatggtcacacacactcctctttcattccctctggtgctccatccttggctcctttctgcctcttgctagttaagtcccctagggggctgagtccttaggctgtgtgtgccagggacatgggtggccagccaaggtcaaggaggtcagagaaatctgccagttgtgctggggcactgggagccttggagtcctaagaacagggtgccccaccgcaaagttggcaggaccgcccctggcaaccctgcacagtacgatgatcgccacttcttgtgacctcacaggatagtcgtgatgcccatcgcccgagagttctctccagacctagtcctggtgtctgctggatttgatgctgctgagggtcacccggccccactgggtggctaccatgtttctgccaaatgtaagggagcctcagctgagggggacgttagggacagagagccaggcggtgcggggagttgggaggcactcccaagtcagaaagggaaggtggcagtggccagcccagggctttcagcctgaggactggagtatggcagctggtcctgaaattccccgggatctcctagccgagcacagcccaagccctttctcaggaccaggccggttcaccacggagggcttgaccaggtcatacccatggggacttaagtccagtaggcaggaagctcagccgtgggactccccaccacagctgggttgattccaggtgggctggcagctcctccagaggaaggggagagagaagcagcactctcagaatagagggtggccacagggcccagagtacagaaagaagagagggtgtagctcagtgaaaaagacacaggctagagtcaatgacccaagttcaggtcctaccttgctgccacttactagctgtggggcctttcccaaggcccttaacctccctgagccttgagtgaagcatactagtaggttttgtacgacattcaatgtgaaagcactttggaaatagtgattgatacatgtgagtcattctttattagggaggaagcaagcagggaagccacaggggtagagaacagggtcacctctccactcccgcccctcccatttctcccctcccaacctctaggttttggatacatgacgcagcaactgatgaacctggcaggaggcgcagtggtgctggccttggagggtggccatgacctcacagccatctgtgacgcctctgaggcctgtgtggctgctcttctgggtaacagggtgagccgtctccctcccccatccatgcttctgtcaggcaggtaagcccggctctcaggactacccaaggagcaggcagatgggatgggacagggtgggagtggccaagcctgaaacaaggtaggcgaagcggaagcctctgttccaagttaggtccaggcagcatctcctggcctaggtagagtgtgcttgtggctagaaggctggggcccctggggtgggagtgagctgggcctgtgggtccctgagagactggtggctgatgtactgttttctataggtggatcccctttcagaagaaggctggaaacagaaacccaacctcaatgccatccgctctctggaggccgtgatccgggtgcacagtaagtgtggagatgggacactcgctgagctcagactgaaggatcttggtggtaccctgccccaccgtggccagatcctagggcttccggtgccagccaggtgacctgctgttggtctggagtaagattcctgtgagtgacccaggcagcaatggtgagcaccccccagtgaggggttatcctctgagcccccccgatggagccagcagggcctaccagacagtggcccctcaaggtagggactggcctccatctctagcgacagccctagaccagggccaggtcaagagcaacactcaggccttgtttgccaaaaggcctggttcccatccctcccctcagtcctggccacaggcgtctcaggagctctgctggcttgggggctgcgtcttgggataacccccacatttgtaaagtactttaaattttcaacttcaactcaacatctattgagcatcttatgtcaagacccataatctatactagggataaaaatgagtaaaatagattcccatatcaagggctgggtaggggagccgtgatgtctttacataatggtaaagacatggctgattcctcttacggtgggtgccctcacactgagccagattccaggacatggttcctcacagcagcaggcaggaggagcattctcctggcctgggcacccatgcagagcggccgtggtgatggtcagttctcccatgttgtgttcgtcccacctcccaggccctcctttcctgagtgctgggctgagcactggtgggggctgtgtttaagtgggaggcccgagcttggggctctgggaggtcactgtgacacagaccctgtctgcaggcaagcaggctctcctgatgctctcaggagccccgcacctgtggggaatgagtcaaaggtggccttgcagccacaggggatgagagaaaggctgggcacctgctaggactccctcacagccatgttgaacccactctgtgtaccctgtcaggctgtgcgggagtgggagcgaagtgaggagaggggcaggtgggagagccgaccctaagtggaggacaggcccgctcctccggggccctgggcctgagacaccaacctcaatatccggtctaggacgcagtgtggaggggcttgctttctccaaccctttctgacctggcatcttaccccaggtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggtaatgccagacccctggccctgggcccacagcctctccaccgcttcattcctccctgcttgaagaccccgggtccgctatgcagccaccccaaccctcccaggcttcctgaccagggttgagaggaagcttagctaaggcccttgctgcagccctggtgctccagcatcccacccttgtccctccccacaggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagcctcaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccactgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctccccaagaagcgcagcatacccctgggacccctcggccactgcccactcggggagccttctctgtttctggggcctcccccaccatagctctgattcccaccccacataggagtagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgctttaaaagtgcctctgaaagggccccccagaagtgagcagtgcgccgtcaagcgggtgtgcagggcacacagctgcacggcacagtgtgggtctgagtcactgccggaggagggaccagggtggtctgggccgcagcccctttaacaatctgcccttcctgccctgcaggaagaacccattctgaacacaccctggctgtccctggctgccccactttggggtgacaaagaggaggcagccctgggctgagtccacagagaccagccctgatatggcaggagtgggggtggggtgggggagtgggaatacaggagctcagccccagctcaccacggcatccccgaagagttgtgactcagacacacctgggtttaagtcccagctgggagctcaggtaagtcaaatcgtcttctggggcctctgtttatcagtagaaggctccagaagtatacactgttgatggctccttcccgctctgatgcaccatgcctgattaagcatacactgagcctagaagagagaaggggtgaggcacaggcctggacaagctcacccagcctaagcagagaggaaggcgccaggctggcagcacctgcctttgtggttctgagtctgtccggtttttccagcaggaagaggagcacctcattaccttagacctggcccaagctcctggcagcctggcagagtgtgagggaagaggcgctaatccctttcccatctggcctggcctctcgggtgtggacaccaaatcccgcaggggttgctgtagctatgcccgtgggcatccttgccctggctggggtgtgctagagagaggaaagctggaggaggagagctgagctggtggttaccccatgccaggagggccaaggcaagagggcctgcagccccagagatactgactctgtcccctgccctccagggcacaactgaactagcggaatggcttaatcagatagctcgagaactgccactaccactccctccctgcccactcctcccaaagtccacctgttcccgcaagagtcccacctcacaagcaaccaccagaggctgatacaaatggccgctgtatttttgctaaagtgacagtgacacagataaggcaaagagctgaggggcaggacacatcagatgggaagggggagaccgtgcaaaatggcagtctaacagaaaatcatccttgtaccaacagccccttccctcccaagttaggtgagcccttgggccagtgtatgggcagaaaagcagatttgtgtccttcagaagggaaatgtaaaaaggtgaaagctctagttgaagggcagtgagaggggctggagtgggagagaaggtctctcctggccggtggtctgggtgcagcaagggcactctgagaaggcagaatggaaacgcagggctggaggggcatgggtacaggtttgggggctctttccagcctctactatgttgcccccttccccaaagcccttacaggggcagaagcacattccccgtgaccctgagtctggcctcatttgggaagtcttctggggtgtatggatgcctgtgtgtgtgagtgagatgggtggggggccacggctatctggctctagcacactcatgggagaccagctctgggaacaacaggatggggtgctgggatgggggtttaagaggtctctgctagatatttctgaactgacctccccaggtgcccaacctggccttgggaagagagtgcctagggcagcggggatggaaacccttgcctgcagcataggtccaggcctcatggccctacaccttgacctcttgactttgttgccctggccttaagtacaaagattcctcactgcgtgctaagaaaacagatccaggccgggcacggtggctcacacctataatcccagcactttggaaggctgaggcgggtgaatcacctgagatcaggagttcgagaccagcctggccaacatggcaaaaccctgtctctactaaaaacacaaaaatttgccgggcatggtggcagatgcctgtaatcccagctacttgagaggccaaggcaggagaattgcttgaacctgggaggcggaggttgcagtgagctgagatcgcactactgcactccagcctgggtgacagagtaagactccatctcaaaaaaaaaaaaaaaagaaaaaaaaaagaaagaaaagaaaacagattcatttgaaaaggtctaaagctgccctctggccaggctgatgaggagcaacatggcaggatcccctctctaccacactcaggtttcctcgaaaggggacgggcaggacagcttcctgggagaccacactcgtcctgctgtgtattttctgccacagttctggggtcaccagggggtgggagtagcctctcccaacatctcagaggctgagtccaggtcctaaggcccccccagggtgcagagacctcaccccctgggtcagaaatcgctgaggatgctgatgtcagcaaagtcagcccggtagcggtgggcatagaggctgagcaggaaggcccacttgaaggaaatgaagctccagacgctggagaggtagtagctggtggggtctgtgaggcctgcagggagagaagtaccgacagtgactttggcaggccctgccctcggcctctgcaccggccacaaggccagggccaccctccccactcaacatccctgcaacgtcctggcagctgaaccaacccttcagaaagacactgtgatggaggttttagagccatggtccccaacctttttggcaccagggactggttttgtggaagacaatttttccacaaaaaccttgggatggtttggggatgaaactgttccacctcagatcgtcaaacattagatcatcaggggcacgcaaccctcgcatgcgcctcacaacagggtttgcgcttctaatgcccgccgctgacctgacaggaggcagagctcaggcggtaaggctcgcttgcccctcacctgctgtgtggcctggttcctaacaggccacggaccactactgttccacagcctggaacagtagaacggagctggggaccgttttagagtattccagggttttcaggcaggaggccgtggggattagggaagggcagggctggccaatcacaggtctgtatcatccactccgcttttgtgacaaataccctaggccacctccaacctgctttagttagcatcagactcccggaagaaggacctctggttatttccagccacagccaccagagggcgctcccatcccagagctgagcacagactaatgggtcccaatatcaggagtgcttgtatgggctatgcactgctcaagacttcacatcagtttcatagaatccacccaacttgcgaggtggggacttgttttctccacatgaaccataacaaaacccgtgtccggggaggttaagtaattcacccagtctctttggaggtaacctgtggaaccaggatgggaatgctgctaaaatccccgctgctgtccctcccatgccctctttccctgggacccgccctcactctgatgccgggtgatggccagcacgaggaaggtgcagaaggcagcgatggagacggccgagaagaggacgcccacgaagaagaagccgcgcagccccttgagccaggtcctccaataatcttgcatgtacatcacgtgcgtcaccaggacccacagtgccagcacccctgcaggagagacacatcagggcccatccccagggtgctccagagccctgcagatccactagaccaggcctatttgcataagaataccaagaatatggtcttgtctctcattccctcatagaatggagttttccttttcggaggctgtgatatcagaagcaggtaagagactgagctgcctgctagtaagcccaacattagagaaacctgcagaaatacaaaaccctaccattctctctgattttattttgttttggaaaacatgaatatctctcacaaaaatgttatgttaattcatgttatttttagtattactttaaaatgctaaaaaatgttctaacttctaatatagtatatatcaatagctaaaactcacatacataaaatttgcatggagtttcactacttttcaagaggataaaaggatcctgaaaaccagaaagtctgtgcctcagcagcccagcctgctttctggggacttgccactgtctaccctgagggccacagagcagggaagccatgctcctgccccatgctcctcctccacccagccctcagaggccacagtctcaaagtcacaaggcctgcagggctcttcccaaactgcctgagttggttttgcaggatgaggaggtccagccatgaagactccagggccacccaacccctgagtggccttattgttcttggccagacctcatgccactccctccattttgcggcaaagggcaggccatcaccacctgcaccgctccccacccccactgcccccagcttttcctgggcctggcctctgcgcctgggtggacacttcctctaggatgccagctgccacccagccaatacaatacaaaacaaccctctgtgccaggcagtgcctgctggtgcagcccaaagagtggaacaaatatcaactccattggcaagggtccgggcagggcggtggatcccggcaagggacaaatgaggaaggaggcagagccagctgcaggctctcagctggttgggttgcaaggtgtgggccactcaggccgctgcatcctaggagtcaggaggcctttccaaaaggcagctgcacacatgccactcagagtagttaccaaatgtgcacaggaaggataagcatctggttggggaaagtggttatctctggcaatggagacaaggaagggaagttgatggggcggtgggggtggggaagtgctttgaatctatgggaatctatgctattttgtttcttaggctgggtgggaaatctatgctattttatctacgctgttttctcaggctgggttataagggtgtttgttaaatcatctatccttttttgtgtgcctaaaatatttcataatttgtttaagggggaaaaaggcaggaggaagcttgtcactgtggagctatgctctggttaccagctcagaggctgtcccagtttggctgtccccagacagtccagtgaggaacaaaaacccatgagactccaagccaagaaaccaggagcctggcactgctgtgtcccaaagccttggtgtttccacatctaaaaatgggtgggcccaggggtcctgccagtttaggtaactgggcccagggttctaccctagtgagggtgaaggcctaccaagcctacagcttccctcagcccctgccaccgtttgaccccctgaacactctcccagctttgcccctgcccacctccactcttcctcagggggtgggggcctggaatgtgggtccccctcctactgagatcagggtgggccaggacaagcatctgttcctccccacctagtctggatgctggagtgggccagaggtggacaggacaatcatcctgcagcttcctcttacctcctacaagatctggatttttataccagccacctttcacagaagtccctcccactcctcacatgtgtcccatgttttcatttgagggagctgtttggtttataaagggccctgggaacaaggggtgttgtcactgagcacactcaaggagcagtctgatgggcacctgtctggaacaggtcccctcgccctctgtctcctcgtgccacagaggggttggggaagttgagctctaagatcctttcccactcaaagattctagaagccagcttgggagaaaaataaggtcagaacaattcctctgtgactcagcagtttctgggttaggaaatgctgaaataggggcctgtgaagatgccatctcttagtccactggccacgatccagtggttccccaaaactcccacccccatgtacatgcacataccaaagagggctgagggcaggagggagaggaagacagccatttgggggcgttttgggccctgttctttgttaacaacaggcatggtttacccacctctcaccttccctcaaccttgctccaggccctgcacagaggcctcccctccagataaacacacatcaagtgtggaggcaggcctgctgcccacgccctggctcccaccaccctcctgggaagggagctctccaccagccctacccaagggggtcactgaaggagatggagcccctcactggtcccctcccacacatcaggcaggaggcaatgtatctccctaatacccttccctggcacacttggggactctaggaagcctggtttataaaactcggggtggaatggacaggtccccaatcccacctggctgcaagcccacaccagaccacaccgttgctccatcctacctgtttcaaggagcagagcccctgcttagccatgtgagcttattggctcacagccgataagctaagggtaaggaaggcatagggtagggcggtgaaagcatccccagtggctgggctggaggtgaggagacaggagacacccgggggatcccacagggtaaatgcagacaagaaggacactgggcctaggtcaggcccctctattccttcctaggaggaagacagtcctggagccccagggctcttgctcacagctcacctgggaaaaacatagagctgtttagacttcaggagcaacttttctttttctctttccttggtctactaaacccagagcaagagtttgtgttttcccccaggactcccacagcaaagccagaccaggtagatccaacccacacctgcccgcctccccaggaaagccagtcttgcttctgccactgcctttctccaaagccacttcttcgaaggtacccatcaggatgggagagggtatccccacccgtgaacactctgcccaccagacccaggggctccatgactctgctccagaaactggcacatccaatcagtccttgcctggtccaacacaggagaaggagcatgctggggctacccttgggtgactcagcagattctgagctataaaacgctgagtcagaagtagggtgctcacacgttagttaatctgctgacactttacccccaaaagaggaagaaggttgactggccacagaccctctgagaactcactcatggtggggaaggtcggaggcccaggcttggcaacccctctccctgccaccatccaccaccaccactaccaagcagttttggctcttccacagccactgtcaaagatcagaccatcagggagataccaggaccctactccagctggctgctgccctagcgagctgctgccctagcgagctgctgccctagcgcctctctctgaaggcagctccacagctggcctgcctcataggccaagggaagcctgtggggagggagagagggcagagttgggtcggaagaaaaccccaggcaactccctagagtataagaaagaaggccttttccacagccctctaggaggcagctggagactcagggagtgggcagcactgcaagatttcagatctggagggaagtcagatgtcttttggggacatctcctcccactcctaatagatgaggaaactgtggcccaggatagggtcaaacggccaggtagggttcacctccacttgtaccaggccagactcaacacaaccagctgagatcccaggctggccctccctgctcatccttctcttgccttcggtcttcgcaatgcaatcatagggctctgacgccgccttccagaggggaaagcaacagggccaataggaaacaaaaaagtggcagggagaagtgaaccttgacaaacatggagggtggcggggtgcagtggggaaaggaactagggctctgtagataacgcgcagagatgggccagttgtcctcaggatcccacaggtggtgaggcagctgggcaggcagagaacaccctagccagggtgcccatccccccttcttggtgacccagtgctttgttggcattgtgtagggtggggccctgtatgcccctcttctaaggcattaaccccacctcatgctgcgactctacccagggatggcactcagcactccctgtggcagtgagtaaattagttatttttagttattccatttagggttcttttggccgaggattttagtaatggaatataatcatcatatgtaaaagtattatacgtattttcttcccaaagtcctttcccacacatattatttcatgtagctgtgtaatcccgggtaagcaatttatttaacttcaggcctcagtttccttatctgtaaaatggacataatcgtaaggcctacttcatgagactaatgtaaggattaaatgaaataagggaagcaggttgcttaacatagtgcctgacacatagaaagcattttttaaaatgttagaaagtagagataatatttttcatcttcataccaattctatggcgcagagaggttaaactgcgagcccaaatgtgcacaacaaggagcactggtcagcccagagcccccatcagcgcaccgatgcttccccttccctcccagaagcacagaaagggcggctggcctgcaggatttggcagagcttggctgaggagccacagcagacgggtagcaaaaaggcaccaacatgggtggaaagagaatgtccagtttctatgagatccctaacgccgtcctccctgtgggtctcagcagagggctctgcgggggagccctctggaaggagggagatgggcttccccagccacccctagccctcttcctttcccacttcttccctctctgccctcacccagcacccagggaaggggcgcctggggggcaggggatccctcagaacaaccgtgtgtgtgtgcgtgtgtgtgtgtgtgtgtgtttggggataggaggcgaccagcgccgcgggcgcgcggaggggacactgtcgtggggcaactgggcggagggcgacaggcagtgtgccgtgacagataacccgggcggcgcggcaggtctgtgcagccggcagtggcgggccgtcggcacccccaggtggcgcccgggcgggcatcgggtctcagaggcacccaggaatgcccaggagcccgggcccgcgtggggcctgccgccgccaaccgctgttttcgagtaaacactccacccgctccgcggggaagcgccgctcgcggggagcgtcctggagcagctgacggcgcccgccccgcagccgcgcacccgccccgcgccgcccagcgtcccggggtacctgcgagccctcccatggccgcggtccccggctgtcggtagaccaccgtccagacgaggaagatggagaagccggccacggagctgatgccggagtaggcggcgcggaggccgagctgcagcctggacggggccatggggctgcggcgccgggcgggccgagggcgagcgcggccgagagtcacaggtgcagggcccgaagccgccagccggagccgcgggagccgccaga

SEQ ID NO: 12047 - DNA, 375 bp, Homo sapiens
aggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactggtgagtctgctgcttcttcagggaaggggctgggtccctgcaccctgctaagagccaagcttgggatggacccatccttcctccccatctctgtccccctgtcctgcgcattgccctgctgcaccctggccccccaccctataccctcgcttccttccattgctccctgtggttccctccttattccacccc

SEQ ID NO: 12048 - DNA, 924 bp, Homo sapiens
cttaaaagccatgtagttaagtcatataaattccaaaatgtatcagtttcttctgtgtaggtaagtgactagtaatagaaactaaattattaatatgtactagtgggacatagggaagatgtaagtaattaccatggtgcctgtgtacaggtctccattgttttggggcaatgaatatcgaatgctttctcattcttttcctcttttcccaccaaattgtgatttgtcactcctctccacttctttttgttctgcattttttgttgattgtttagagctggtgaacagcaactatatttaaaaaaaattgaggccaatttggtaaagaaatgagaatctgaattccagtttgctataattttaagctatttattaaatataaagaagtggtatttaaaattctcaggtattggaaatcttactgtatgttttaaggaacagtttcttaaagtcctaatcattgaattagggagacatagagtctcaaatataatgtgtcatttgtatgtattttctttcaacgataatgtttggcatttggatttgattttattaacttaaaagtttttaggcagtatgttaaactggctcaatgcttcgtactagttcttttacacaacttgccattattgagttattttctgttgcagaaaaggcaatctctttcacctctggatgactcaaatcaggaaatataagcaaaagaagataaacaattctttctgtgtctttacttctcagtctttcccaatctggctgaggcacataaagcagacttgaggaaattctttacttaggacactatcttaacctgctcagggtatttagaattttttgaaataagcagtcatgtacttctataagtgctaaggaaagtaaattagtgtattattaaatattagatcttaaaaaaagaattaaaaa

SEQ ID NO: 12049 - DNA, 2884 bp, Homo sapiens
cagaaaatatgcctcatacaacatgagagatgtcatacaggaaagactccctttgtatgtaccgagtgcggaaaatcctattcacacaaatatggcctcattacccatcagagaattcacacaggagagaaaccttatgagtgcaatgaatgtggaaaagccttcaccacaaagtcagtactcaatgtacatcaaagaacgcatacaggagagaggccgtatggatgcagtgattgtgagaaagccttctcccacttatcaaaccttgtcaaacataagaaaatgcacacaagagaaatgggtagaatcagtcaagttgaaaactcctgtaatggagagtcacagctccttccttataagtgaactcatgcagaagaaaaccctactagtgccgtgactatggaaatgccttttgtggcaactcagacttcattaaacatcagtgtgtttctagccaattggaacataaacatggtgctgcctgttgacagatgtgtgtctgtcctcaggaggtgaaataatttgccctagagatcaatttgatgaatacagtaaataaggtagtgcctttagtggtcttttacctcatattttctgtcaatgaaaatacgttgaataaactatattaatgtggagatgttttgagcaataatttctgctcatatgtctgaaaagtatacagagataaattctgtgaatacaaagactaagaaaagtcttctgtggaaagatagactttattatcaggtttcatcatagatttcaacgtaagtgagcttattgttgatagaaacatgatgaccatgacaaagtctttactcagaaatatgacctcagtgagtgtcaaagtttacactggaaaataactttaaggtgacagtattgatggcaggatttcagcgacgcactctgcttcatcatttgtcaggagatcacatagaaagtaaaattgttccgaacatgctatcaaataaatgtggaacacctttagcaaactatcaacagctcatgaaggcatgaaatgtggtgaaaatgatgaatatttgagtgctttttcttaataagtataaccttaaacatcagctaatacacctggtgtgcattttcagtcaggataccttaatcctcatttctagttgccttgccaatgattccataatatactgtctcattactgtttatttttactgttgtgtaaaattgtggtataatgagaaatacatttggtctttgttcctggttcctggcatagagctcctaaaacgcttagaatttcatgagtgataagagttttttggttttgttttgtttttgctgttgttgttattcatagcactgcccttttaattacacctgattatactactgaagtgacttatggttgctcccctagacagcctcagaatggggctgttctctaggaagatcaagtaactagaggatggagactttgtgccccatttctcccacctcctggaaggggaggggtgctggagattagattagacaatgagattaagagaactccaaatagcccaagagggtggtgcacccccaacttcataggggtagaggctcctgagattaggagaaccctttttaggctttactctatgtacctcttcatttgagtgttcatttgcgtcctttataaccagtaaaacaaagtacgctgttttcttgagttttgtgagccctgtagcaaattatcaaacctgagtagggcagtgggaactcggaatttatcaccattcagaactgcaggttgtccttgtgagtggcatctgatgtgggggaagtcttggactgagccccttaacttgtggagtctgcactaatttagactgcactaactaacttgcactgcactaacttggactgcactaacttgtggagtctgcactaacttggagaagttagtgtcagaattgaattatagaacacccagttgttcagaattgaattgtagaacacccaattggtgtgggagaattagagaatttatttgtgtcagaaaatactccagaacaaccaccccatattatgattagctcttttcctttctttggctctgagcttaattgtacattaagcaaacttaagtagaaaagaaactgaatatgttaaatatattaacaacatatttggacttgcttaactaagattatagagatgatcagtttataaaaccaccttcaacttaaataaatttgaactcgaaattgcaaaagcagtctagaggctttgctagtatccttcaaccaatttctagtaaaaatatcctatataaccataattatcaaaaccagaaaaacaacattggtaggatactataaagtactaatcttattttggatttgacgaatttttacatgtttttttcttttttagtttgtactctaagaagttgtattacatgtacagattcgtgtaaccactgcaaccacataaaactaatgaacacaaagtccctcatgctacctttttatgcttacactccatccaaacctaactctgccaaccacttttctcctatcagtataatttcatcatttcatgaatatgataaaaataaaattgtttttgtaaatggtttttataaattttatataaataagttatatgaatttttattgatagagagtatgtaagcttttggcatttttgtcactcagcaaattactcctaaggtttatatgagttgatgaatagttgttttattatttttttttaccaccatgtatctaaccagatgaaagttgtttatatttgagagtagtatacatatttgatgtagtagtttatccattcacctatgagatatatttgcactgttttcctggttttaagtgctataaataaagatgctgtgaaatctacatac

SEQ ID NO: 12050 - DNA, 96 bp, Homo sapiens
ctatctcttttgcctaataaatatggagggctgtgtaaagctcagggcccttgtccactagaggcaaggtgtcccctgatcccttcttccaaatat

SEQ ID NO: 12051 - DNA, 912 bp, Homo sapiens
gtaactatttgtggcaagccaggtcgaggtcactctctttgagggcatttactcactgcctagtgccccctttccactgggacagacccagagacaaaccctagcagcttacttagctctcatgaactaagggctgtcccttagttctcccaaagtaacccacaatgcaaccctgatgggctgcatcttccaaaattgaaaggcctttgtctatcattccatgaaacaaaaaaagattatcttactttttaacatggcttaaccttaatacccactggatttcggagaacagtggccactgcatggttctcatgcttacagtacgatcctgtagctagatttgttttgtaagaaggaagaggaatgagatgaaataccctatgtataatgttttatgttgctttggaaaagtacaacaatgtagaaaaaggtaaaatcatgataaagtaagaaattaaagactgtttggactgatttacaagaaaaagatgatgctatgatggttcagttaaaggaacctatgactcacccccctccactttatgggggagctgcagcagcactactggcgcctctccagagtccccaccaccaaaaagtcacaaatccggggcaacaggtatgatctctacttcttataacccaacaggggactccatttaggcagggtgtcacttcttatacccaacagggaactccatttagccggggagtcactctggttctgagaggcagtttccccataacaactgcttacaggaggtgttgctgccacaggccagcctataggatttatcttggtttattctctgttctccacttccaacctacttaattagaaaaataatatgcctatttattgagaagatctaaagtttatggaaggaacaggattgaaaaaaaaaaaaaaaa

SEQ ID NO: 12052 - DNA, 911 bp, Homo sapiens
gtaactatttgtggcaagccaggtcgaggtcactctctttgagggcatttactcactgcctagtgccccctttccactgggacagacccagagacaaaccctagcagcttacttagctctcatgaactaagggctgtcccttagttctcccaaagtaacccacaatgcaaccctgatgggctgcatcttccaaaattgaaaggcctttgtctatcattccatgaaacaaaaaaagattatcttactttttaacatggcttaaccttaatacccactggatttcggagaacagtggccactgcatggttctcatgcttacagtacgatcctgtagctagatttgttttgtaagaaggaagaggaatgagatgaaataccctatgtataatgttttatgttgctttggaaaagtacaacaatgtagaaaaaggtaaaatcatgataaagtaagaaattaaagactgtttggactgatttacaagaaaaagatgatgctatgatggttcagttaaaggaacctatgactcacccccctccactttatgggggagctgcagcagcactactggcgcctctccagagtccccaccaccaaaaagtcacaaatccggggcaacaggtatgatctctacttcttataacccaacaggggactccatttaggcagggtgtcacttcttatacccaacagggaactccatttagccggggagtcactctggttctgagaggcagtttccccataacaactgcttacaggaggtgttgctgccacaggccagcctataggatttatcttggtttattctctgttctccacttccaacctacttaattagaaaaataatatgcctatttattgagaagatctaaagtttatggaaggaacaggattgaaaaaaaaaaaaaaa

SEQ ID NO: 12053 - DNA, 911 bp, Homo sapiens; identical to SEQ ID NO: 12052

SEQ ID NO: 12054 - DNA, 318 bp, Homo sapiens
aaagcctgatgttaaacagtcagccttctgcccaccaaatgcctgggatagctggggagcttgagagagatactaaagaaaaagaccagaaatggtagcacccaggggcttctcctgacccagacaacaccctccatatttcccacatggggcttgagatcctgatgatggtgagaaatcagcttctggactttctagtagacatggtgccatctatttggtgttaaatatctggtggtctaaactttcctcagaaataatgaaggtgactgaaatctcagaaaaaatgctgatgagatcattcctccaaattttgga

SEQ ID NO: 12055 - DNA, 195 bp, Homo sapiens
gatcaaagatgacaagggccaatggaaccaagtttgagtcttgccaggtcaatacttgggtcctgagtatggtgactagtatctgttttgttatgtgtgtattattccagccagaatgggaaatgctaattcagctcctccaggcagcccaatggggctggtggctttgagattattaaactctttctctgctgc

SEQ ID NO: 12056 - DNA, 318 bp, Homo sapiens; identical to SEQ ID NO: 12054

SEQ ID NO: 12057 - DNA, 195 bp, Homo sapiens; identical to SEQ ID NO: 12055

SEQ ID NO: 12058 - DNA, 318 bp, Homo sapiens; identical to SEQ ID NO: 12054

SEQ ID NO: 12059 - DNA, 195 bp, Homo sapiens; identical to SEQ ID NO: 12055

SEQ ID NO: 12060 - DNA, 2849 bp, Homo sapiens
caagtaacaaaaaaagcagtgtcatgttttattgtgtttttcttaatggaacataaaataatggtgattcttataactgatggcacttcagatttggtaaaactacaattttgaacatttaatgaatgacaaagacataacatcctctgaaaaatctgcaagtaaatcaatcatttttaaacaatagctaccatatatttgtatcttctccttgggaaaaactttggaaaaaaaaacacgcacataagtatcataactgagggttgtggacaagttacttcttgtttaccaatttttatattgacataaagtagcacagactagttatttcatttaaaaaaacacactgacaaatcttttctctattacacttataagacttttcacttatatgcttataccaatatagaaacacataacttgagattctagccaatttttattttcttgaaactgtttatcacctgtgtattatctcagtttttccattttcctgcctgcttcttgatgtctgcatttgggccaattattgtttctcagcatcaccagcatgtggacaaaaaataagatgaaaactaaagtcagttcatctggtaatttaagttttgttagaaggactgataggagataatgcaagtaatgtctatagtgaaattatatgattattgatgaatctcaattattactaccactttccccacagataactgagttttgtgtgcatatgtgtgttttcctatggaatggaacataaaggaaaattttaaagatatacaaacacatgttcaagtgtataatacatatgtacttttagtttcattttgataaaattaatgagatacaaattttatcatcaatttcagaggtctttgtatctagttctttatcaacgaaaataatcacaatatattgggcactgagtgaatttgtcagctatggattcgtttctgaaaaagtatttctacagtattcctacactactctgaagaccctacagtatgccatttttattattaaaaatagaattacagttgaggagagaagtgccagtgaatacttagaacttcactggaccaaaagcctcaaaaaagatggaaaaattccaaaggtatgcttagaaaattacctttaaaactaattatgtgaaaaaacaatgctccacaaatcaatcattattaaaaacaaaaatactgatacacatccaaaatagtatctcttttctcaacttagtcttggaatatttttcatcaaaatgacttatatgtacttttgcactattaatattatgctacaacaattatgttaatacagttttcattaactgagttcagtgaaacagcctacaaaaaatacctatctctggaatgttactcaaaaaggcaaagtgtacaatatttaaaatacctctacatcaaactgctttttaaactgatttctagaaaaatttgttccctgtaagttatcatatcttctacatctttgtagataagcatttcttcaatggacagcaacttatagctattcaggctgaatgctgacttgttcttaacagcatttaacatctttagggatgttataactgagtcactcaaagaagaacaaactgggaaaatgcgtgcagtccacaaactcagacatgtcttgttaccagagaacagttcctctgtaactttaagattccaaacatctaagcatgacaggaaacagactccaaagaattgaagtaactttatatctgacaatgttttcacactctttttcaagttgtcttgcactccaaatgccatagttgcatactttaagcatctattcatctttaagcttaaggaacatacaaaagaatgtgcggggagggcagcttttgttaggatgtaagaaccactaataatgcagttttccccaactgaaacatcaggccccaatctggaatactccacaactgagccaggtgccacagaacatcttgaatccagtatgctttgaatgatacaggatgttttgccagagcattctggtatatctggaaagatactaaaagttatggactgtaagccgagctctgactttaaactgttatctgaggtaaagtaaaacaaatattcttcggttgttccaatgtgataaaatttggagttattaagaacaacaacatttagtgatgttcctttaagaagatgaaatattctctgcctcatttctaccaactctgactcttctttaatgacatttgatgtgtttctggtgtactccacagttgctccaggtcccaaagcctgcagaaagtcaccataggcatctatttcacagctcagtgtgcctattttttcataaaaagcaagtaacatttttgctgatttatgatccatataaaataggctatctgtgtagacatagtcagagtctaatttaagatcggcaatgtcacccccagcaaagtcctgttgacaaaaatttccaggtctacacacagcattaaactgatacatcttttctatgctgggcttatgaaggaaacgatggcaagacctgtattcaaggtctctatgttttaaatcatcaaaaggatctaagacaaatactccatgtgtggtacctatcgtcaaactagaaggatgagctaaagcagtaaagccaggtttgtcaaacctaataaactcaaattctccaatactataaagttcaatatcatctgcacaggtaaccagaattccaggattcatatttaaggggaaatcaatgtacatggctagttttaattctagcatctgataaatggggttaccaagaggtaaagcagtgaaaatttttcccagagcacttgcatttggaagtcgttgactgtagccacc

SEQ ID NO: 12061 - DNA, 2113 bp, Homo sapiens
caagtaacaaaaaaagcagtgtcatgttttattgtgtttttcttaatggaacataaaataatggtgattcttataactgatggcacttcagatttggtaaaactacaattttgaacatttaatgaatgacaaagacataacatcctctgaaaaatctgcaagtaaatcaatcatttttaaacaatagctaccatatatttgtatcttctccttgggaaaaactttggaaaaaaaaacacgcacataagtatcataactgagggttgtggacaagttacttctagtttaccaatttttatattgacataaagtagcacagactagttatttcatttaaaaaaacacactgacaaatcttttctctattacacttataagacttttcacttatatgcttataccaatatagaaacacataacttgagattctagccaatttttattttctcgaaactgtttatcacctgtgtattatctcagtttttccattttcctgcctgcttcttgatgtctgcatttgggccaattattgtttctcagcatcaccagcatgtggacaaaaaataagatgaaaactaaagtcagttcatctggtaattgaagttttgttagaaggactgataggagataatgcaagtaatgtctatagtgaaattatatgattattgatgaatctcaattattactaccactttccccacagataactgagttttgtgtgcatatgtgtgttttcctatggaatggaacataaaggaaaattttaaagatatacaaacacatgttcaagtgtataatacatatgtacttttagtttcattttgataaaattaatgagatacaaattttatcatcaatttcagaggtctttgtatctagttctttatcaacgaaaataatcacaatatattgggcactgagtgaatttgtcagctatggattcgtttctgaaaaagtatttctacagtattcctacactactctgaagaccctacagtatgccatttttattattaaaaatagaattacagttgaggagagaagtgccagtgaatacttagaacttcactggaccaaaagcctcaaaaaagatggaaaaattccaaaggtatgcttagaaaattacctttaaaactaattatgtgaaaaaacaatgctccacaaatcaatcattattaaaaacaaaaatactgatacacatccaaaatagtatctcttttctcaacttagtcttggaatatttttcatcaaaatgacttatatgtacttttgcactattaatattatgctacaacaattatgttaatacagttttcattaactgagttcagtgaaacagcctacaaaaaatacctatctctggaatgttactcaaaaaggcaaagtgtacaatatttaaaatatctctacatcaaactgctttttaaactgatttctagaaaaatttgttccctgtaagttatcatatcttctacatctttgtagataagcatttcttcaatggacagcaacttatagctattcaggctgaatgctgacttgttcttaacagcatttaacatctttagggatgttataactgagtcactcaaagaagaacaaactgggaaaatgcgtgcagtccacaaactcagacatgtcttgttaccagagaacagttcctctgtaactttaagattccaaacatctaagcatgacaggaaacagactccaaagaattgaagtaactttatatctgacaatgttttcacactctttttcaagttgtcttgcactccaaatgccatagttgcatactttaagcatctattcatctttaagcttaaggaacatacaaaagaatgtgcggggagggcagcttttgttaggatgtaagaaccactaataatgcagttttccccaactgaaacatcaggccccaatctggaatactccacaactgagccaggtgccacagaacatcttgaatccagtatgctttgaatgatacaggatgttttgccagagcattctggtatatctggaaagatactaaaagttatggactgtaagccgagctctgactttaaactgttatctgaggtaaagtaaaacaaatattcttcggttgttc

SEQ ID NO: 12062 - DNA, 1562 bp, Homo sapiens
gcagttttgattttggctttattgctgaatttggtaatcttaacattaggagtactatgtagctacagaagatgactagatcatcacaggttatgggaattaatcctggattcatgccattaaacttttgacaatttcagagtatcacttggatttttaaagctttatttcaatcagtatacactgatacatatcctttatttctgctttgcttagagaataaatgcctaaggtaaaagattattatcaaatgttgaatttttcccatgcccttgttgatagttattaaatcatcaataagtttatggattatagttacaaatagcaggcttttacacacctgagtatatgatgtaagcgccatgatttcataaaaataaaaattataaaatgagacaaaatgtttaatttcaaacttatccatgtaggtcttatttttctactgctgataaaactcagaaaaaaattatctttattggaagactaaatgaaaagcctaaaaaattaagattgtcacaaaatttagtcacttcttatcaaaaacacacttctcctctatcatcatgtacactgcattattcagggattaaatttaggagtgacttactttttttttttttgcctagatccttttattaaaacacatacttaggttagaatcattcctaattcatctttttttatccacatttcgacaccccagaaaacagaatgtgccttacaaatgatagtatagtagctattagccaggcagcaacagtcatggagttgttacttgctcacatgtgaacttggtcatatctgcgtatatgactgtcacttcagttgaattaggtacattattggtggtacgtttgtgctactacacaccaagcaatacatctcaaagcaagagacattgataagtcctttgaacagaaccatttcaaagcaaccagaatccatgcattgtgcaggattatgattaaaattcagattaggttaaaatacagtattgagcacttaataaacatataacatcctctgaacgctctgtaagtagataaatgttaaacaacagctaccatatattttctttaaaaagaatcttgaaaaagaaaaaacaaacacacaaataccacaattgagggcttcagacaggtcacttctggtttaccaaacaataattttcatattgacatgttaatatgacatcaatttgtgagaaatctctttctgactttgaatagaatcacaggtccgatcttctaaggacctgtgattaaactgaaagaaaagtgaaactgagttttgccaaatagaagggtatcaaatcttgcaggagtgtgggtctgtagctgggtaaaaaaaatccagacataagtgtggtagagcactcaggaaatgcagccttaccaataattctgaaagcacacaagatggtactaggtggacatatgcatatcaatagctctgaaagtgctgaagagtttgaatgtgaagctgtagaaatttcttgatgatatctcaatattttatttttttgttattttatatgtatatgcaagagggttaaataaaaa

SEQ ID NO: 12063 - DNA, 1563 bp, Homo sapiens
gcagttttgattttggctttattgctgaatttggtaatcttaacattaggagtactatgtagctacagaagatgactagatcatcacaggttatgggaattaatcctggattcatgccattaaacttttgacaatttcagagtatcacttggatttttaaagctttatttcaatcagtatacactgatacatatcctttatttctgctttgcttagagaataaatgcctaaggtaaaagattattatcaaatgttgaatttttcccatgcccttgttgatagttattaaatcatcaataagtttatggattatagttacaaatagcaggcttttacacacctgagtatatgatgtaagtgccatgatttcataaaaataaaaattataaaatgagacaaaatgtttaatttcaaacttatccatgtaggtcttatttttctactgctgataaaactcagaaaaaaattatctttattggaagactaaatgaaaagcctaaaaaattaagattgtcacaaaatttagtcacttcttatcaaaaacacacttctcctctatcatcatgtacactgcattattcagggattaaatttaggagtgacttactttttttttttttgcctagatccttttattaaaacacatacttaggttagaatcattcctaattcatctttttttatccacatttcgacaccccagaaaacagaatgtgccttacaaatgatagtataatagctattagccaggcagcaatagtcatggagttgttacttgctcacatgtgaacttggtcatatctgcgtatatgactgtcacttcagttgaattaggtacattattggtggtacgtttgtgctactacacaccaagcaatacatctcaaagcaagagacattgataagtcctttgaacagaaccatttcaaagcaaccagaatccatgcattgtacaggattatgattaaaattcagattaggttaaaatacagtattgagcacttaataaacatataacatcctctgaacgctctgtaagtagataaatgttaaacaacagctaccatatattttctttaaaaagaatcttgaaaaagaaaaaacaaacacacaaataccacaattgagggcttcagacaggtcacttctggtttaccaaacaattaattttcatattgacatgttaatatgacgtcaatttgtgagaaatctctttctgactttgaatagaatcacaggtccgatcttctaaggacctgtgattaaactgaaagaaaagtgaaactgagttttgccaaatagaagggtatcaaatcttgcaggagtgtgggtctgtagctgggtaaaaaaaatccagacataagtgtggtagagcactcaggaaatgcagccttaccaataattctgaaagcagagaagatggtactaggtggacatatgcatatcaatagctctgaaagtgctgaagagtttgaatgtgaagctgtagaaatttcttgatgatatctcaatattttatttttttgttattttatatgtatatgcaagagggttaaataaaaa

SEQ ID NO: 12064 - DNA, 807 bp, Homo sapiens
gataaatgagcatttaggaggccagccccataaacatctagccatatagaccccttaacattaaatgagttgctctcaaaactgaatgtctagactttaacagaaaagagatacttaacctcagggaaaccatctatctgtccaaattatccaataattgagtttcctaagcagaaaattcaatgcctaacttcaagtttttctttcacctttgcattcactgggaattttgaatggaagccatcttcacctttacggtattaaatggtaaaatatagattttcctacaatgcatattaagtactgtaaaaatttctcttgtatgggtattagcctttaatttgtgcaaacagtagatactaaaaaagaatactaaatgaggaaactccaaagaagcattttctaaaacatgttcaatggaacaccagctccttgagatgttcaaaggatattcctcagatagggtatacattgatcaataagtttatgaaatttgggccaaacaaaattaaacaggtttactgacagaaccagcctgtcagagcctttaaaatgcaaacccaccttgtgaatctctatggtaagacataatattcggtgtttaccatgcatacttaatcataaagctgtcttttcttggaacatcttacagggcttgtgtccccagtacaaactttagaaaatgtagccttaatacccttcacgttactccaatctaccactctaatggcttgtctactcttcttcatacatgactagcaaatggtggtgtttatgctttaaaagaacacagatctaaaaaataaa

SEQ ID NO: 12065 - DNA, 370 bp, Homo sapiens
accaaagccacagttgggcacgctaatctttagcaatattactccaaaaagcttcaacatgtcatggaccactcaagctgggctttttgcaaagattgttatcaatgtgagtgacgctcactcactgcatgagtcccagcaattcacagtctcaggagatgcaaagcaagctcacatcacaggcttggtggagaacactggctatgacgtcagtgtggcaggaaccaccttggctggggatcccaccagacccctcactgcctttgtcattacaggtactcaatcagaggttctcacttgtctaacacagagagaaaaggagataagtcatcttaaaggaaaattcaacaaaaatacaatcttcactgca

SEQ ID NO: 12066 - DNA, 1416 bp, Homo sapiens
atggtaggagttttctaccatatcatattgaagatatgaagaggtattttccagcttcccaagtttgagagttgggcatttacctcttacacttcagtcaacaaacaaactagtaattcctaatgcataattaatttggatgcaagataagattaagtttctggagttttgttttgacttctgaggtgctaaaaaataccatgtaaattctccctaccagctagaagggtagcaagacgttgtagagtgcttatcagagagtaccatttacttcaattgatcaatataaatatatctttttttttcatcttaatgagtttctcataaagacacatcttggggcataccaaccttcatattcattcagtgtatccattggtgttaatattaacaatttcaactaaaaacaacaaacataatttttctaagtgtttcgagctgtgagatgtcaatttctacaatttagtttctagacatgctgtatatttaataaactttatgtaaactttaaaatattgcactgcatttatgaaaaaagctttctttgcctactgcagctatctaacattttatgaaactgacgcatgtccttcattattgaggctaaaagctcttgttcagattgcttgaggtttgaaaaagaggtgtgctagctttgcttagtttatttcttatttttggtatacatatacatatatataacattagaatgtgtgtactggaaatgctatgataggtattttgtgttaatccaaatgcaatgatagtttcttgtatgaatgtgcaagaggcctgtgaccgaatgctacgtttttatggtagtttaagattataaaagtagaaatgcaacaattcccagtttttggataggttctaaatttctgagatttgattcatggcagatattctctgttgttgttgttttagatgggctcattacataacgagttaattgtcactagtaggagactgtgaaggaattttgttatactttcaaaaatgttactgtgatgaaaaatcatctattttcagaaaatatttatgaattaatttactatagaattatctctctaattatcataattgggttacaatttaagctccccttttaaatgttatattttaaaatgttattactctataaaagaaaattgcttgctatatttacaccttctttcctaggaaagctttcatccttaaattgttgtattcctaccctctgaagacatttaaaataagcttttgtgcctgcagcagagcctgcagaagctaatacaagggacactggtcttttgacaaaataaacttgtgtaaattttgatactgtattaaaactatttttttaaagttctgcataaaattgagtattaagtatatgtgttcatcttagcaatggtaataaattatttaatctca

SEQ ID NO: 12067 - DNA, 559 bp, Homo sapiens
tgaactcattcatgtggatattttgtctcttgtctttacttcatcttcgctcctctcttaatttacccttaagaaatgcaaatctccttgtgaaagaggaaaagtaagatactcactccttctttttttttttaaggttgtgtggaggaaacttggagatgctgcaggttcgtgtcctggaattaggcaacatttgtcaggaaaccagtacaaaggaccaatgtgagatgcactctttttcaaacaggagatcaccactgccagaaagtgatagaagacaagaagaaaaaggaaagagtgggtttccacaaacctggactcatggaataacatggagtgattgtacattgcacatatctcccctctaaaacctgtagtacaacttctcccctcaagctgatattctgtgtctctcacctcaatgtccacaacagtcaatctcaaacaaggtagctttgaacatctcaaacagagtagctttgaaaatcaacattttggtaccagtgttttcattagaaataagtgtttttaactccccagatataatattgtaattggg

SEQ ID NO: 12068 - DNA, 6586 bp, Homo sapiens
ttttttttttttatttttttttatttaatgttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcagtgtttggttttttgttcttgcgatagtttactgagaatgatggtttccaatttcatccatgtccctacaaaggacatgaactcatcattttttatggctgcatagtattccatggtgtatatgtgccacattttcttaactttataacctgtgtggggcaggagaattaacctgcttttggattagaggctgcaaaaaagccagttctggtgaccacactaaaaagattaatgagcacttagcaccaaattaaatacccccctgcccccgcctttatgaaagtggagttcatagtacaaatgtgacagcgttaaacattgaagccattcgaaggaacctgggaagtactcaggcaccgatgagttaaaaacacagagacatccagtaagtgagttcccgctgggcacgggtctgtttatcttgcctttctgaagtcagagccaacattcttaatggttttgaatgattcagaatgtttcttttttggcagggccagtttccacgcatgggcttatgactaaaaccccttaggtgaggtccaaagcagaaaccagcctcacacttaatgttgtatttcagaatcatcttattttagagcaaaaggaaaactattaaatatagcttgcttatttcagacatgaagggacggaaccaaggaggctttggtcagccagaggtcacaggactggagagagaggccagcccgaggcagacctctgggttctgggcccagccctccctcctctgcaccacacagctcttgtccagacctcggaaggaggttccagcgtggcctcagcctcccgctggaagaggcagcttgccctttgagatcgtttagaaaacgacttgggtcagaaaggagaacttcatttttacaaaatgaaacaaatcagttatttgccatagacagctttttcaaaatatcctttgcccgtgtgtcgtgaatgtattagctctgggacagaaacaagaataataacaattctatctactatatgccaaaagaagagacttgatatacttctttttttttttttttttggatgagaatgaacttatgccacactagttcttaataaaacaaactgaatccttaccgcaggagaaagaattgagcaatgttctaagaacaggctgtcctctttggggcactgagtgaatgtaatatttagaagatgcccttgaagctcacaagtgcctcttgggatggagtaaagggggagaaacggcgagagaactcggacagagaagccgtccatgggaggagaaggccttgggaagagccatcgactcacccccttcctgcttgattgaggactttgggaatcacagatgccataggagagaacccatttcttcaaagccaggaggtgaaccggcccacccctgctgtgcccaccacactacagccagtaagggttctcctctggacctgagccactgtccccaagggccagaaaccagccatgtgtggcgtccccagaaaaggacatgagcaggtactcagccccgccacacacatttgtttaaggagagaaagcaagtcagcgaaatgggatctgcaccaagatctctgcacccagggagctgctgtggagtaaatcctatttttccaggtggtgtttaaacagctgtcattgatcactttgctttttttaattgattatttcgaaacgtgttttcccccaaaggatgttagtatgtcataaatattcagttaagcaactccaggatgatcttttagtaggaggagctgtcttttggtcctagtaacactaagtgccattttttccctcttctaagcccatggaaacaacgtggaggaaaaatgattatatatttagcttctagcatgattttagagataaatgacagccacctcccagacctcattcccaacacctgtattaatttttattttatttttatttttttgagacagagtctcgctccatcacccaggctggagtgcagtgctgtgatctcttagctcgcctaatttttgtatttttagtagagacggggttccgccatgttggccaggctgctctcgaactcctgacctcaagtgatccacctgtctcgtcttcccaaagtgctaggattacatgcatgagccactgcgccccaccttgtctttatttttaaagtaggcaatttattttaattttttgtgtgtgtatgacagggtctcgttctgtcactggagtgcagtggcaccatcaaggctcactgcagcctcaacctcctgggctcaaacgatcctcctgcctcagcctcccaagtagctgggactacactcaccaccacacccagctacttttaaacttttttgtagagacatgcagtcttgctgtgttgcccaggctggtctcgaactcatggcctcaagcgatcctccagccttggcctcccaaagtgctgcgattacaggtgtgagccaccatgcccagcccagtttatttttaaaagagctactggctgggcgtggtggctcacgcctgtaatcctaacactctgggaggcccaggcgagtggatcacctgagatcaggagtttaagaccagcctggccaacatagtgaaatcccatctctactcaaaatacaaaaattagctgggtgtagtggggcatacccatagtctagctacttgggaggctgaggcaggagaatcacttgaacctgggaggcggaggttgcagtgagcctagatcgcaccactgcctccggcctgggcaacagagcaagactctgtctcaaaaaaaaaaaaaaaaaaaaaaaaaaaaaggctaactgaagagaggagtttcgctgtgttaagaccactgtgcgtccataatggccttccctcagatctctcttccagggagctagggctgtctacacatgctccgtagaaacaaatgcacatttttctacacgggagtgaattggagagtcgtggtggtgatagtttaactgaaatctacctgggattttttttcttctctgctttatatttgtttaaaaaagcatgatccagcaaatgcatcaaattaaagctgtgggtacagttctcctaacagaaaatcacacagtaagctgggacaatggaacagaaagcagtgggtattgttttcttcttaagatttttatattcacattggatgagaatgtctcctaaccctccccttgctgttgttcttggaatgggtaccttattcatggcctccttacatagagggagcagattcaggacagaggctctgcacgctcctgggtccctcctaagcgagcactcccctccactgctcctcctgttcggcatgctagattttctgtgcacttgcagtcatacggaaactggcttccttcttagctgtgcgtgtgaaagtcaccccagtgtttcacctgcagtgtgagtgtaatttggggtcccatgacatgatcatcttccttttgatttctaaagctagggtcagggaaggggactcgttttgagccaaagggcattttaagggcatcatttcatatgttcactgtctgcagccaacactgcactctagacaaatgggtacctttatgtcccatttattaagacatcctgcaaaaggggctcctggcccctgtgggaagcttgaaaggaacagaccatatcctgtttctttttgctcatacctctgtggtgagatcttattctgaccccatagtctggtgccatacctgtgggtccctgtatctcctagaattccccctatgctagtgtttagcccgtgtaatgacagttatctgtccacagggctgtatcccccgccagcttgtaaactccatgaagaccggccctgcgtctcactcactcctgtccacagcagtgcctcccacatgttaggtcttaacaaacatctgtttcttctactcttcataaaatccacgcttcttctcacccccccgtcatccctgatcccagctaactttgaccctgtgtgcgggggcgggggatctacatgtgggctccacccccgcacgcctgctgccctgtcatctctgatccctggcggtgggatgtctaccatggctctgcccaatcccccactgtcttcacccctgccacatctggcatgattttaccgtccccttcctagagttctccctttctcccctgcccaggctgcacccctggagagcccagctcaggcccctggcccctatgaagcctctcctgaataatccatcagcctgccctgagctcatccagtctccagtgacgattgtgctctccaccagcaggacacaccggagcactttctctgtccctgagaattggactccattccacagttaggtcctgggtcacatacagacatttcacatcccctcctcagtattccccagcagcgtgcagcacagtgcgggcttctaggaggcagtcggtggatatttacccatgattttaagaggtctgtcttgaccaggaatgttgagaagtgacctgtgtctctgcagcattgctgctagttagtccctcgtggaagaagtggcatgtccctcctgtgtctggctcacggggaccggcgcctcctgtgtttgcccccgccatgccctgtggtttcctttgacaccctctgtcattgtctatttttatgttttaaacttcagtgggatttacctctcgtttgctcccatatcctcctggtaaattgtaaacttggtgaatcaatgatgagtaatcagtaggcagaaatggttggaatttcctggtcccagtttcagatcatatctgtctttccccagactcctaacttcctgttgggacatcccttggtctggcctttccctccagagaagcccccagacccacccgcagccttgatttactgatgcctaatcttattttagtctttcacaccagtttttaacaactcgactgtatagatcttctggaaattttacccaaaaatgttagatgtgccatcccctcacaggggaaagtggtggggtggtgggggttaatgtgttgaaaatctatgtatcttgtattttatttgagtcagctgtgttttcacaacaactctgagagttaacatcatttctactttataaattaaaaaaacaaaacaaaaacaaaaaactaaagccccaaaaggattgaatagcttgccaaggctgtgtaacaagtgaaatttgaatccgggtctgtatgatcccaaagcttaagctgcccgtctttctattcccagttcaaacgtgccttgaaatgggagctcacttgatagtacttggcttttaaaaggctacgtacatgtaagtaccttcactcaaatatgctggggctcagtaggagaagcaaagagaaggaaaaggtattgattgatcgatttgattctaagcagagattgacagagataagcttctaagacctttcaggccccagagtgtgactgttgagcacctaagaagacctcacttgacccgtgacttcccgccagagccttgggaagcccatgagtgcagcgtgctcgccggctgggctggaacttgctgctcttctctgcagtggcaggctggcttctgcccctagactggaactgccaagggctgctatagaagggacaaacttccagtgctcactgaggagccaggggtatcctgggaagctgaaaatgcatttgtcaagctcaggtcttcacaattgagaaaccccatcactaacccgtacggttttcttgaccaaaactttcagtgctctgtttttcccatctgtaaataatgttcatacatctaaatcctaggaggttgcagggacagtggcttagaaagtcaccacattctctaaaggagtgacagagaggatgaaagaagcatgctctataattaggttttattacatgctttttaaggttaattgaaggacttcccagcagcttccctagccactttttcaaatactgaaagcttccagaaagcagcagacaggtgttcctcacaatctgacacagacttcagttactgttgaaaagtgaaagagggctgggcgcggtggctcacacctataatcccaacactttgggaggccgaggtgggcggatcacctgaggtcaggaggtcaagaccagcgtggccaacatggcaaaaccccatctctactaaaaatacaaaaattagctgggtgtagtggcacacgcctaaaactccagctacttgggaggctgaggcatgagaaaaaatcgctcgaacccaggaggcggaggttacaatgagtcaagatcatgccactgcactccagcctgggtgacagagtgagactatctcacaaaaaaaaaaaaaaaa

SEQ ID NO: 12069 - DNA, 6573 bp, Homo sapiens
ttttttttttttatttttttttatttaatgttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcagtgtttggttttttgttcttgcgatagtttactgagaatgatggtttccaatttcatccatgtccctacaaaggacatgaactcatcattttttatggctgcatagtattccatggtgtatatgtgccacattttcttaactttataacctgtgtggggcaggagaattaacctgcttttggattagaggctgcaaaaaagccagttctggtgaccacactaaaaagattaatgagcacttagcaccaaattaaatacccccctgcccccgcctttatgaaagtggagttcatagtacaaatgtgacagcgttaaacattgaagccattcgaaggaacctgggaagtactcaggcaccgatgagttaaaaacacagagacatccagtaagtgagttcccgctgggcacgggtctgtttatcttgcctttctgaagtcagagccaacattcttaatggttttgaatgattcagaatgtttcttttttggcagggccagtttccacgcatgggcttatgactaaaaccccttaggtgaggtccaaagcagaaaccagcctcacacttaatgttgtatttcagaatcatcttattttagagcaaaaggaaaactattaaatatagcttgcttatttcagacatgaagggacggaaccaaggaggctttggtcagccagaggtcacaggactggagagagaggccagcccgaggcagacctctgggttctgggcccagccctccctcctctgcaccacacagctcttgtccagacctcggaaggaggttccagcgtggcctcagcctcccgctggaagaggcagcttgccctttgagatcgtttagaaaacgacttgggtcagaaaggagaacttcatttttacaaaatgaaacaaatcagttatttgccatagacagctttttcaaaatatcctttgcccgtgtgtcgtgaatgtattagctctgggacagaaacaagaataataacaattctatctactatatgccaaaagaagagacttgatatacttctttttttttttttttttggatgagaatgaacttatgccacactagttcttaataaaacaaactgaatccttaccgcaggagaaagaattgagcaatgttctaagaacaggctgtcctctttggggcactgagtgaatgtaatatttagaagatgcccttgaagctcacaagtgcctcttgggatggagtaaagggggagaaacggcgagagaactcggacagagaagccgtccatgggaggagaaggccttgggaagagccatcgactcacccccttcctgcttgattgaggactttgggaatcacagatgccataggagagaacccatttcttcaaagccaggaggtgaaccggcccacccctgctgtgcccaccacactacagccagtaagggttctcctctggacctgagccactgtccccaagggccagaaaccagccatgtgtggcgtccccagaaaaggacatgagcaggtactcagccccgccacacacatttgtctaaggagagaaagcaagtcagcgaaatgggatctgcaccaagatctctgcacccagggagctgctgtggagtaaatcctatttttccaggtggtgtttaaacagctgtcattgatcactttgctttttttaattgattatttcgaaacgtgttttcccccaaaggatgttagtatgtcataaatattcagttaagcaactccaggatgatcttttagtaggaggagctgtcttttggtcctagtaacactaagtgccattttttccctcttctaagcccatggaaacaacgtggaggaaaaatgattatatatttagcttctagcatgattttagagataaatgacagccacctcccagacctcattcccaacacctgtattaatttttattttatttttatttttttgagacagagtctcgctccatcacccaggctggagtgcagtgctgtgatctcttagctcgcctaatttttgtatttttagtagagacggggttccgccatgttggccaggctgctctcgaactcctgacctcaagtgatccacctgtctcgtcttcccaaagtgctaggattacatgcatgagccactgcgccccaccttgtctttatttttaaagtaggcaatttaattttttgtgtgtgtatgacagggtctcgttctgtcactggagtgcagtggcaccatcaaggctcactgcagcctcaacctcctgggctcaaacgatcctcctgcctcagcctcccaagtagctgggactacactcaccaccacacccagctacttttaaacttttttgtagagacatgcagtcttgctgtgttgcccaggctggtctcgaactcatggcctcaagcgatcctccagccttggcctcccaaagtgctgcgattacaggtgtgagccaccatgcccagcccagtttatttttaaaagagctactggctgggcgtggtggctcacgcctgtaatcctaacactctgggaggcccaggcgagtggatcacctgagatcaggagtttaagaccagcctggccaacatagtgaaatcccatctctactcaaaatacaaaaattagctgggtgtagtggggcatacccatagtctagctacttgggaggctgaggcaggagaatcacttgaacctgggaggcggaggttgcagtgagcctagatcgcaccactgcctccggcctgggcaacagagcaagactctgtctcaaaaaaaaaaaaaaaaaaaaaaagctactgaagagaggagtttcgctgtgttaagaccactgtgcgtccataatggccttccctcagatctctcttccagggagctagggctgtctacacatgctccgtagaaacaaatgcacattttctacacgggagtgaattggagagtcgtggtggtgatagtttaactgaaatctaccttggattttttttcttctctgctttatatttgtttaaaaaagcatgatccagcaaatgcatcaaattaaagctgtgggtacagttctcctaacagaaaatcacacagtaagctgggacaatggaacagaaagcagtgggtattgttttcttcttaagatttttatattcacattggatgagaatgtctcctaaccctccccttgctgttgttcttggaatgggtaccttattcatggcctccttacatagagggagcagattcaggacagaggctctgcacgctcctgggtccctcctaagcgagcactcccctccactgctcctcctgttcggcatgctagattttctgtgcacttgcagtcatacggaaactggcttccttcttagctgtgcgtgtgaaagtcaccccagtgtttcacctgcagtgtgagtgtaatttggggtcccatgacatgatcatcttccttttgatttctaaagctagggtcagggaaggggactcgttttgagccaaagggcattttaagggcatcatttcatatgttcactgtctgcagccaacactgcactctagacaaatgggtacctttatgtcccatttattaagacatcctgcaaaaggggctcctggcccctgtgggaagcttgaaaggaacagaccatatcctgtttctttttgctcatacctctgtggtgagatcttattctgaccccatagtctggtgccatacctgtgggtccctgtatctcctagaattccccctatgctagtgtttagcccgtgtaatgacagttatctgtccacagggctgtatcccccgccagcttgtaaactccatgaagaccggccctgcgtctcactcactcctgtccacagcagtgcctcccacatgttaggtcttaacaaacatctgtttcttctactcttcataaaatccacgcttcttctcacccccccgtcatccctgatcccagctaactttgaccctgtgtgcgggggcgggggatctacatgtgggctccacccccgcacgcctgctgccctgtcatctctgatccctggcggtgggatgtctaccatggctctgcccaatcccccactgtcttcacccctgccacatctggcatgattttaccgtccccttcctagagttctccctttctcccctgcccaggctgcacccctggagagcccagctcaggcccctggcccctatgaagcctctcctgaataatccatcagcctgccctgagctcatccagtctccagtgacgattgtgctctccaccagcaggacacaccggagcactttctctgtccctgagaattggactccattccacagttaggtcctgggtcacatacagacatttcacatcccctcctcagtattccccagcagcgtgcagcacagtgcgggcttctaggaggcagtcggtggatatttacccatgattttaagaggtctgtcttgaccaggaatgttgagaagtgacctgtgtctctgcagcattgctgctagttagtccctcgtggaagaagtggcatgtccctcctgtgtctggctcacggggaccggcgcctcctgtgtttgcccccgccatgccctgtggtttcctttgacaccctctgtcattgtctatttttatgttttaaacttcagtgggatttacctctcgtttgctcccatatcctcctggtaaattgtaaacttggtgaatcaatgatgagtaatcagtaggcagaaatggttggaatttcctggtcccagtttcagatcatatctgtctttccccagactcctaacttcctgttgggacatcccttggtctggcctttccctccagagaagcccccagacccacccgcagccttgatttactgatgcctaatcttattttagtctttcacaccagtttttaacaactcgactgtatagatcttctggaaattttacccaaaaatgttagatgtgccatcccctcacaggggaaagtggtggggtggtgggggttaatgtgttgaaaatctatgtatcttgtattttatttgagtcagctgtgttttcacaacaactctgagagttaacatcatttctactttataaattaaaaaaacaaaacaaaaacaaaaaactaaagccccaaaaggattgaatagcttgccaaggctgtgtaacaagtgaaatttgaatccgggtctgtatgatcccaaagcttaagctgcccgtctttctattcccagttcaaacgtgccttgaaatgggagctcacttgatagtacttggcttttaaaaggctacgtacatgtaagtaccttcactcaaatatgctggggctcagtaggagaagcaaagagaaggaaaaggtattgattgatcgatttgattctaagcagagattgacagagataagcttctaagacctttcaggccccagagtgtgactgttgagcacctaagaagacctcacttgacccgtgacttcccgccagagccttgggaagcccatgagtgcagcgtgctcgccggctgggctggaacttgctgctcttctctgcagtggcaggctggcttctgcccctagactggaactgccaagggctgctatagaagggacaaacttccagtgctcactgaggagccaggggtatcctgggaagctgaaaatgcatttgtcaagctcaggtcttcacaattgagaaaccccatcactaacccgtacggttttcttgaccaaaactttcagtgctctgtttttcccatctgtaaataatgttcatacatctaaatcctaggaggttgcagggacagtggcttagaaagtcaccacattctctaaaggagtgacagagaggatgaaagaagcatgctctataattaggttttattacatgctttttaaggttaattgaaggacttcccagcagcttccctagccactttttcaaatactgaaagcttccagaaagcagcagacaggtgttcctcacaatctgacacagacttcagttactgttgaaaagtgaaagagggctgggcgcggtggctcacacctataatcccaacactttgggaggccgaggtgggcggatcacctgaggtcaggaggtcaagaccagcgtggccaacatggcaaaaccccatctctactaaaaatacaaaaattagctgggtgtagtggcacacgcctaaaactccagctacttgggaggctgaggcatgagaaaaaatcgctcgaacccaggaggcggaggttacaatgagtcaagatcatgccactgcactccagcctgggtgacagagtgagactatctcacaaaaaaaaaaaaaaaaa

SEQ ID NO: 12070 - DNA, 6590 bp, Homo sapiens
ccaactttttcactctttttttttttatttttttttatttaatgttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttgctgagaatgatggtttccaatttcatccatgtccctacaaaggacatgaactcatcattttttatggctgcatagtattccatggtgtatatgtgccacattttcttaactttataacctgtgtggggcaggagaattaacctgcttttggattagaggctgcaaaaaagccagttctggtgaccacactaaaaagattaatgagcacttagcaccaaattaaatacccccctgcccccgcctttatgaaagtggagttcatagtacaaatgtgacagcgttaaacattgaagccattcgaaggaacctgggaagtactcaggcaccgatgagttaaaaacacagagacatccagtaagtgagttcccgctgggcacgggtctgtttatcttgcctttctgaagtcagagccaacattcttaatggttttgaatgattcagaatgtttcttttttggcagggccagtttccacgcatgggcttatgactaaaaccccttaggtgaggtccaaagcagaaaccagcctcacacttaatgtcgtatttcagaatcatcttattttagagcaaaaggaaaactattaaatatagcttgcttatttcagacatgaagggacggaaccagggaggctttggtcagccagaggtcacaggactggagagagaggccagcccgaggcagacctctgggttctgggcccagccctccctcctctgcaccacacagctcttgtccagacctcggaaggaggttccagcgtggcctcagcctcccgctggaagaggcagcttgccctttgagatcgtttagaaaacgacttgggtcagaaaggagaacttcatttttacaaaatgaaacaaatcagttatttgccatagacagctttttcaaaatatcctttgccagtgtgtcgtgaatgtattagctctgggacagaaacaagaataataacaattctatctactatatgccaaaagaagagacttgatatacttcttttttttttttttggatgagaatgaacttatgccacactagttcttaataaaacaaactgaatccttaccacaggagaaagaattgagcaatgttctaagaacaggctgtcctctttggggcactgagtgaatgtaatatttagaagatgcccttgaagctcacaagtgcctcttgggatggagtaaagggggagaaacggcgagagaactcggacagagaagctgtccatgggaggagaaggccttgggaagagccatcgactcacccccttcctgcttgattgaggactttgggaatcacagatgccataggagagaacccatttcttcaaagccaggaggtgaaccggcccacccctgctgtgcccaccacactacagccagtaagggttctcctctggacctgagccactgtccccaagggccagaaaccagccatgtgtggcgtccccagaaaaggacatgagcaggtactcagccccgccacacacatttgtctaaggagagaaagcaagtcagcgaaatgggatctgcaccaagatctctgcacccagggagctgctgtggagtaaatcctatttttccaggtggtgtttaaacagctgtcattgatcactttgctttttttaattgattatttcgaaacgtgttttcccccaaaggatgttagtatgtcataaatattcagttaagcaactccaggatgatcttttagtaggaggagctgtcttttggtcctagtaacactaagtgccattttttccctcttctaagcccatggaaacaacgtggaggaaaaatgattatatatttagcttctagcatgattttagagataaatgacagccacctcccagacctcattcccaacacctgtattaatttttattttatttttatttttttgagacagagtctcgctccatcacccaggctggagtgcagtgctgtgatctcttagctcgcctaatttttgtatttttagtagagacggggttccgccatgttggccaggctgctctcgaactcctgacctcaagtgatccacctgtctcgtcttcccaaagtgctaggattacatgcatgagccactgcgccccaccttgtctttatttttaaagtaggcaatttattttaattttttgtgtgtgtatgacagggtctcgttctgtcactggagtgcagtggcaccatcaaggctcactgcagcctcaacctcctgggctcaaacgatcctcctgcctcagcctcccaagtagctgggactacactcaccaccacacccagctacttttaaacttttttgtagagacatgcagtcttgctgtgttgcccaggctggtctcgaactcatggcctcaagcgatcctccagccttggcctcccaaagtgctgcgattacaggtgtgagccaccatgcccagcccagtttatttttaaaagagctactggctgggcgtggtggctcacgcctgtaatcctaacactctgggaggcccaggcgagtggatcacctgagatcaggagtttaagaccagcctggccaacatagtgaaatcccatctctactcaaaatacaaaaattagctgggtgtagtggggcatacccatagtctagctacttgggaggctgaggcaggagaatcacttgaacctgggaggcggaggttgcagtgagcctagatcgcaccactgcctccggcctgggcaacagagcaagactctgtctcaaaaaaaaaaaaaaaaaaaaaaagctactgaagagaggagtttcgctgtgttaagaccactgtgcgtccataatggccttccctcagatctctcttccagggagctagggctgtctacacatgctccgtagaaacaaatgcacattttctacacgggagtgaattggagagtcgtggtggtgatagtttaactgaaatctaccttggattttttttcttctctgctttatatttgtttaaaaaagcatgatccagcaaatgcatcaaattaaagctgtgggtacagttctcctaacagaaaatcacacagtaagctgggacaatggaacagaaagcagtgggtattgttttcttcttaagatttttatattcacattggatgagaatgtctcctaaccctccccttgctgttgttcttggaatgggtaccttattcatggcctccttacatagagggagcagattcaggacagaggctctgcatgctcctgggtccctcctaagcgagcactcccctccactgctcctcctgttcggcatgctagattttctgtgcacttgcagtcatacggaaactggcttccttcttagctgtgcgtgtgaaagtcaccccagtgtttcacctgcagtgtgagtgtaatttggggtcccatgacatgatcatcttccttttgatttctaaagctagggtcagggaaggggactcgttttgagccaaagggcattttaagggcatcatttcatatgttcactgtctgcagccaacactgcactctagacaaatgggtacctttatgtcccatttattaagacatcctgcaaaaggggctcctggcccctgtgggaagcttgaaaggaacagaccatatcctgtttctttttgctcatacctctgtggtgagatcttattctgaccccatagtctggtgccatacctgtgggtccctgtatctcctagaattccccctatgctagtgtttagcccgtgtaatgacagttatctgtccacagggctgtatcccccgccagcttgtaaactccatgaagaccggccctgcgtctcactcactcctgtccacagcagtgcctcccacatgttaggtcttaacaaacatctgtttcttctactcttcataaaatccacgcttcttctcacccccccgtcatccctgatcccagctaactttgaccctgtgtgcgggggcgggggatctacatgtgggctccacccccgcacgcctgctgccctgtcatctctgatccctggcggtgggatgtctaccatggctctgcccaatcccccactgtcttcacccctgccacatctggcatgattttaccgtccccttcctagagttctccctttctcccctgcccaggctgcacccctggagagcccagctcaggcccctggcccctatgaagcctctcctgaataatccatcagcctgccctgagctcatccagtctccaatgacgattgtgctctccaccagcaggacacaccggagcactttctctgtccctgagaattggactccattccacagttaggtcctgggtcacatacagacatttcacatcccctcctcagtattccccagcagcgtgcagcacagtgcgggcttctaggaggcagtcggtggatatttacccatgattttaagaggtctgtcttgaccaggaatgttgagaagtgacctgtgtctctgcagcattgctgctagttagtccctcgtggaagaagtggcatgtccctcctgtgtctggctcacggggaccggcgcctcctgtgtttgcccccgccatgccctgtggtttcctttgacaccctctgtcattgtctatttttatgttttaaacttcagtgggatttacctctcgtttgctcccatatcctcctggtaaattgtaaacttggtgaatcaatgatgagtaatcagtaggcagaaatggttggaatttcctggtcccagtttcagatcatatctgtctttccccagactcctaacttcctgttgggacatcccttggtctggcctttccctccagagaagcccccagacccacccgcagccttgatttactgatgcctaatcttattttagtctttcacaccagtttttaacaactcgactgtatagatcttctggaaattttacccaaaaatgttagatgtgccatcccctcacaggggaaagtggtggggtggtgggggttaatgtgttgaaaatctatgtatcttgtattttatttgagtcagctgtgttttcacaacaactctgagagttaacatcatttctactttataaattaaaaaaacaaaacaaaaacaaaaaactaaagccccaaaaggattgaatagcttgccaaggctgtgtaacaagtgaaatttgaatccgggtctgtatgatcccaaagcttaagctgcccgtctttctattcccagttcaaacgtgccttgaaatgggagctcacttgatagtacttggcttttaaaaggctacgtacatgtaagtaccttcactcaaatatgctggggctcagtaggagaagcaaagagaaggaaaaggtattgattgatcgatttgattctaagcagagattgacagagataagcttctaagacctttcaggccccagagtgtgactgttgagcacctaagaagacctcacttgacccgtgacttcccgccagagccttgggaagcccatgagtgcagcgtgctcgccggctgggctggaacttgctgctcttctctgcagtggcaggctggcttctgcccctagactggaactgccaagggctgctatagaagggacaaacttccagtgctcactgaggagccaggggtatcctgggaagctgaaaatgcatttgtcaagctcaggtcttcacaattgagaaaccccatcactaacccgtacggttttcttgaccaaaactttcagtgctctgtttttcccatctgtaaataatgttcatacatctaaatcctaggaggttgcagggacagtggcttagaaagtcaccacattctctaaaggagtgacagagaggatgaaagaagcatgctctataattaggttttattacatgctttttaaggttaattgaaggacttcccagcagcttccctagccactttttcaaatactgaaagcttccagaaagcagcagacaggtgttcctcacaatctgacacagacttcagttactgttgaaaagtgaaagagggctgggcgcggtggctcacacctataatcccaacactttgggaggccgaggtgggcggatcacctgaggtcaggaggtcaagaccagcgtggccaacatggcaaaaccccatctctactaaaaatacaaaaattagctgggtgtagtggcacacgcctaaaactccagctacttgggaggctgaggcatgagaaaaaatcgctcgaacccaggaggcggaggttacaatgagtcaagatcatgccactgcactccagcctgggtgacagagtgagactatctcacaaaaaaaaaaaaaaaaag

SEQ ID NO: 12071 - DNA, 324 bp, Homo sapiens
ggtaacttaacagagctttcttcatcagactgctgagtcatgcagcctcttgctgggtaaaatgtgtcttgagatgtaatcccctataaggacacccccttggagccactgtgaaggcactcccagcttccctagcaggtcgcatcagggggacgactgaaggatttacttgaacaatcagttttcagaaatgaagaccctacgaccttggcttcctctcttgtgatgcagctgaaagatgcatttcgtctgtaaagttagaccaggtaggagagaatgtgaggtggtttccattcttctcagttgccctccacctgattctga

SEQ ID NO: 12072 - DNA, 511 bp, Homo sapiens
cagtgaaagttccccccaaaagaaaaagaaaaagaaaaaaaagactgtcattttcttgagcagctttcttgagctctgtgtgtgtatgcctatgtctggggcatacacaaggactctggcaggcccactaaactctaccacgtagttgccagatatgctgtaaactgtcacctggaagttgggatttactcttttatttttctgtttattttgcatgagtactgtatgtataaaaaagtagccacatatggatggtcaaagggtttcctagaaatatggatagtcagagggcttcctagaaatatggatggtcaaaggtatcctagtttttcaggtaaactccactagaaaccagaaccatatcccaattccatagcctttattatttcagatcaatagaagcagaatcaaaatgcatttggagcttagaggtcaattgatttggaaaccactccggtgcaaagaatctctagattcattgattttggagtattgtttaggggaaaaggac

SEQ ID NO: 12073 - DNA, 511 bp, Homo sapiens
cagtgaaagttccccccaaaagaaaaagaaaaagaaaaaaaagactgtcattttcttgagcagctttcttgagctctgtgtgtgtatgcctatgtctggggcatacacaaggactctggcaggcccactaaactctaccacgtagttgccagatatgctgtaaactgtcacctggaagttgggatttactcttttatttttctgtttattttgcatgagtactgtatgtataaaaaagtagccacatatggatggtcaaagggtttcctagaaatatggatagtcagagggcttcctagaaatatggatggtcaaaggtatcctagtttttcaggtaaactgcactagaaaccagaaccatatcccaattccatagcctttattatttcagatcaatagaagcagaatcaaaatgcatttggagcttagaggtcaattgatttggaaaccactccggtgcaaagaatctctagattcattgattttggagtattgtttaggggaaaaggac

SEQ ID NO: 12074 - DNA, 324 bp, Homo sapiens; identical to SEQ ID NO: 12071

SEQ ID NO: 12075 - DNA, 324 bp, Homo sapiens; identical to SEQ ID NO: 12071

SEQ ID NO: 12076 - DNA, 511 bp, Homo sapiens; identical to SEQ ID NO: 12072

SEQ ID NO: 12077 - DNA, 2209 bp, Homo sapiens
agagttccaagcccacggccccggtcgcggcctcgccgccctcccgcgccccgcaccgggagcgggcctagagcactcgcctcgcccctccgcgagcagggctctggcgcccgcccctgtccgcaccgctggcagcctgaagagagtcgctggccatggtcgctgctaggtaggatatatctgcatcttgaaaggaagataaaacaaaagccttctttggaatagatggatttttgtcactttctgtgtgaactaaagtgattcaatgtctcttttggattgcttctgcacttcaagaacacaagatgaatcactcagacctgaaaaacagtctgaaaccagtatccatcaatacttggttgatgagccaaccctttcctggtcacctccatccactagagccagtgaagtactatgttccaccaacgtttctcactacgagctccaagtagaaacaggaagaggatttgacaacttgacttctgtccatcttgcatggcatactcccacgggaacactggtaactataaaaattacaaatctggaaaactgcaatgaagaacgcctgaaagctttacagaaagccgtgattctatcccactttttccggcatcccaatattacaacttactggacagttttcactgttggcagctggctttgggttatttctccatttatggcctatggttcagcaagtcaactcttgaggacctgttttcctgaaggaatgagtgaaactttaataagaaacattatctttggagctgtgagagggttgaactatctgtaccaaaatggctgtattcacaggagtattaaagccagccatatcctcatttctggtgatggcctagtgaccctctctggcctgtcccatctgcatagtttggttaagcatggacagaggcatagggctgtgtatgatttcccacagttcagcacatcagtgcagccgtggctgagtccagaactactgagacaggatttacatgggtataatgtgaagtcagatatttacagtgttgggattacagcatgtgaattagccagtgggcaggtgcctttccaggacatgcatagaactcagatgctgttacagaaactgaaaggtcctccttatagcccattggatatcagtattttccctcaatcagaatccagaatgaaaaattcccggtcaggtgtagactctggaattggagaaagtgtgcttgtctccagtggaactcacacagtaaatagtgaccgattacacacaccatcctcaaaaactttctctcctgccttctttagcttggtacagctctgtttgcaacaagatcctgagaaaaggccatcagcaagcagtttattgtcccatgttttcttcaaacagatgaaagaagaaagccaggattcaatactttcacggttgcctcctgcttataacaagccatcaataccattgcctccagtgttaccttggactgagccagaatgtgattttcctgatgaaaaagactcatacttggaattctagggctgccaaatcatttcatgtcctatatacttgacactttctccttgctgctttttcttctgtatttctaggtacaaatacgagaattatacttgaaaatacagttggtgcactggagaatctattatttaaaaccactctgttcaaaggggcaccagtttgtagtccctctgttttgcacagagtactatgacaaggaaacatcagaattaccaatctagctagtgtcatttattctggaatttttttctaagctgtgactaactctttttatctctcaatataatttttgagccagttaatttttttcagtattttgctgttccttgggaatgagccctcagaggacagtgcttccaagtacatcttcttctcccagattctctggcctttttaatgagctattgttaaaccaacaggctagtttatcttacatcagacccttttctggtagagggaaaatgtttgtgctttccttttttcttctgttaatacttatggtaacacctaactgagcctcactcacattaaatgattcacttgaaatatatacagaaattgtaatttgcttttttttaaaaaagggggctaaagtaacactttcctactttgtaaattatagatcttaaattcatgcaccccgtgggagctcaataaagatatactgaattgagaaaaaaaaaaaaa

SEQ ID NO: 12078 - DNA, 518 bp, Homo sapiens
taatgggtgcacaacattataaatgtatttaataccactaaactgtatacttaaaatgattaagatagtaaatttcattatgtatgttttactgtaataaaaattacttcaaggagaaagactataaattatttaaagaaaagctttatggagaactaatgctgctggaacacaaatattaagttaatgtaaactacatctactggaacatacaatataatcttattttgtaactgtctactatcttatagctaaaaataattttccttcttcttctgtaaaacttctcattttcacatgtacttttactgtgagttacaaattaaatgtactatgatactccagaaatattatagcaaaatagtaaatcaaaaggctataggaaataacttacgtgccagactactattaaacctctgtaccagcacaaacagctgctataataattttttctgaatacctatttacctccccaaactataaagataaattggtttgaatatatttgttatataaat

SEQ ID NO: 12079 - DNA, 1106 bp, Homo sapiens
ggtgtgtggctcagacacttgtgtcctcacctgccacagtgggaatgctttgtgcgggaaatccagaagttgcaacaggaagacaagtgccagaagaacaagctggacagctacttttgggaaaatggattcaggagggaggagacatgatagcaaacccacgtatgtgtttgacactttgagctatgtgcatgcttcatcttgataaagataaaacctttaaaaaaatcacttaagtagtatagaaagtataaaataaagtttatcagctattatactaaataatgaatgcaagctctatattttactaagtgtaaatgggctgaatttgactgttaaagaacagtttatcagattggattattcaacctgtatttatcatttttgctacaagcatctattgccctttcttctagtaaagtacctgatttggatttgcggatttccccggttagatgagattggcagaactgctcatcaaagttcacggctctccaagaaactgacatgtgactctaagctatgccattaggacgtctgcttcctagacttttattcttcctcatagtgacatacagactgggagtactcgggactgagtcatcccagctattacaatatgaggaaactgtccatctgttctgccacctggacctcttcgctacccatttgctctactttctttactggaaaattttcctactggttctatcttacgaattccttttctgttttaactagtgagtctatttcagttgcctatagccaatgaactctaactgatacagttgaaacctccaataagattcagctggataagagaaaaagaaagattaaaatgaaaggtgtgtgtataaatgtatgtaagtaagcaagcaagataggtaaaaacaaaaagaaagcagaacttaaaatccacaaaacagaatttaagttgaaaggcattagaaacaaacagggtcattatgaaatgataaaatatatgattcataaggaagatgtaacagtctaggatgaaaaacaaaaacaaaaacaaaaaaaccctagcaaacagaacctcccagtctcagcagtcaaatacaattgcataatgaaaaaaaaaaaaa

SEQ ID NO: 12080 - DNA, 9730 bp, Homo sapiens
gccaagatggccgaataggaacagctccggtctacagctcccagcgtgagtaacgcagaagatgggtgatttctgcatttccatctgaggtaccgggttcatctcactagggactgccagacagtgggtgcaggtcagtgggtgggtgcaggtcagtgggtgcacgcactgtgcgtgagccgaggcagggcgaggcattgcctcactcgggaagcacaaggggtcagggagttccctttcctagtcaaaggggtgacagagggcacctggaaaatcgggtcactcccacccgaatactgcgcttttccgacgggcttaaaaaaaccgcgcaccaggagattacatcctgcacctggctcggagggtcctacgcccacggagtctcgctgattgctagcacagcagtctgagatcaaactgcaaggcggcagcgaggctgggggaggggcgcccgccattgcccaggcttgcttaggtaaacaaagcagccgggaagctcgaactgggtggagcccaccacagctccaggaggcctgcctgcctctgtaggctccacctctgggggcagggcacagacatacaaaaagacagcagtaacttctgcagacttaaatgtccctgtctgacagctttgaagagagcagtggttctcccagcacacagctggagatctgagaacgggcagactgcctcctcaagtgggtccctgacccctgacccccgagcagcctaactgggaggcaccccccagcaggggcacactgacacctcacacggcccagtactccaacagacctgcagctaagggtcctgtctgttagaaggaaaactaacgaacagaaaggacatgcacaccaaaaacccatctgtacatcaccatcatcaaagaccaaaagtagacaaaaccacaaagatggggaaaaaacagagcagaaaaactggaaactctaaaaagcagagcgcctctcctcctccaaaggaacgcagttcctcaccagcaacggaacaaagctgaacggagagtgactttgacgagctgagagaagaaggcttcagacgatcaaactactccgagctatgggaggacattcaaaccaaaggcaaagaagttgaaaactttgaaaaaaatttagaagaatgtataactagaataaccaatacagagaagtgcttaaaggagctgatggagctgaaaagcaaggctcgagaactacatgaagaaggcagaagcctcaggagccgatgcgatcaactggaagaaagggtatcagtgatggaagatgaaacgaatgaaatgaagtgagaagggaagtttagagaaaaaagaataaaaagaaatgagcaaagcctccaagaaatatgggactatgtgaaaagaccaaatctacatctgattggtgtacctgcaagtgacagggagaatggaaccaagttggaaagcactctgcaggatataatccaggagaacttccccaatctagcaaggcaggccaacattcagattcaggaaatacagagaacgccacaaagatactccttgagaagagcaactccaagacacataattgtcagattcaccaaagttgaaatgaaggaaaaaatgttaagggcagccagagagaaaggtcgggttaccctcaaagggaagcccatcagactaacagcagatcttttggcagaaactctacaagccagaagagagtgggggccaatattcaacattcttaaagaaaagaattttcaacccagaatttcatatccagccaaactaagcttcataagtgaaggagaaataaaatactttacagagaagcaaatgctgagagattttgtcaccaccaggcctgccttaaaagagctcctgaaggaagcgctaaacatggaaaggaacaaccggtaccagctgctgcaaaatcatgccaaattgtaaagaccatcgagactaggaagaaactgcatcaactaatgagtaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctgccaagcaaatggaaaacaagaaaaggcaggggttgcaatcctagtctctgataaaacagactttaaaccaacaaagatcaaaagagacaaagaaggccattaaatagtggtaaagggatcaattcaacaagaagagctaactatcctaaatatatatgcacccaatacaggagcacccagattcataaggcaagtcctgagtgacctacaaagagacttagactcccacacattaataatgggagactttaacaccccactgtcaacattagacagatcaatgagacagaaagtcaacaaggatacccaggaattgaactcagctctgcaccaagtggacctgatagacatctacagaactctccacaccaaatcaacagaatatacatttttttcagcaccataccacacctaatccaaaattgaccacatagttggaagtaaagctctcctcagcaaatgtaagagaacagaaattataacaaactatctctcagaccacagtgcaatcaaactagaactcaggattaagaatctcactcaaaaccgctcaactacatggaaactgaacaacctgctcctgaatgaccactgggtacataacgaaatgaagacagaaataaagatgttctttgaaaccaacgagaacaaagacacaacataccagaatctctgggacacattcaaagcagtgtgtagagggaaatttattgcactaaatacccacaagagaaagcaggaaagatctaaaattgacaccctaacatcacagttaaaagaactagaaaagcaagagcaaacacattcaaaagctagcagaaggcaacaaataactaaaatcagagcagaactgaaggaaacagagacacaaaaaacccttcaaaaaattaatgaatccaggagttggttttttgaaaggatcaacaaaattgatagaccgctagcaagactaataaagaaaaaaagagagaagaatcaaatagacacaataaaaaatgaaaatgggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggctctgaaattgtggcaataatcaatagcttaccaaccaaaaagagtccaggaccagagggattcacagccgaattctaccagaggtacaaggaggaacttgtaccattccttctgaaactattccaatcaatagaaaaagaaggaatcctccctaactcattttatgaggccagcgtcatcctgataccaaagccgggcagagacacaaccaaaaaagagaattttagaccaatatccttgatgaacattgatgcaaaaatcctcaataaaatactggcaaacggaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacgcttcatgctaaaaactctcaataaattaggtattaatgggacatatttcaaaataataagagcaatctatgacaaacccacagccaatatcatactgaatgtgcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagccgataagcaacttcagcaaagtctcaggatagaaaatcaatgtacaaaaatcacaagcattcttatacaccaacaacagacaaacagagagccaaatcatgagtgaactcccattcaaagagaatatttgcttcaaagagaatgaaatacctaggaatccaacttacaagggatgtgaaggacctcttcaaggagaactacaaaccactgctcaaggaaataaaagaggatacaaacaaatggaagaatattccatgctcatgggtaggaagaatcaatatcgtgaaaatggccatactgcccaaagtaatttacagattcaatgccatccccatcaagctaccaatgactttcttcacagaattggaaaaaactactttaatgttcatatggaaccaaaaaagagctcgcatcgccaagtcaatcctaagccaaaagaacaaagctggaggcatcacactacctgacttcaaactatactacaaggctacagtaaccaaaacagcatggtactggtaccaaaacagagatatagatcaatgaaacagaacagagccctcagaaataacgccgcatatctacaactatctgatctttgacaaacctgagaaaaaaaagcaatggagaaagaattccctatttaataaatggtgctgggaaaactggctaggcatatgtagaaagctgaaactggatcccttccttacaccttatacaaaaatcaattcaagatggattaaagacttaaatgttagacctaaaacgataaaaaccctagaagaaaacctaggcattaccattcaggacataggcatgggcaaggacttcatgtctaaaacaccaaaagcaatggcaacaaaagccaaaattgactaatgggatctaattaaactaaagagcttctgcacagcaaaagaaactaccatcagagtgaacaggcaacctacaaaatgggagaaaattttcacaacctactcatctgacaaagggctaacatccagaatctacaatgaactcaaataaatttacaagaaaaaaacaaacaaccccatcaaaaagtgggcaaaggacatgaacagacacttctcaaaagaagacatttatgcagccaaaaaacacatgaaaaaatgctcaccatcactggccgtcagagaaatgcaaatcaaaaccacaatgagataccatctcacaccagttagaatggcaatcattaaaaagtcaggaaacaacaggtgctggagaggatgtggagaaataggaacacttttacactgttggtgggactgtcaactagttcaaccattgtggaagtcagtgtggcgattcctcagggatctagaacaagaaataccatttgacctagccatcccattactgggtatatacccaaaggactataaatcatgctgctataaagacacatgcacacgtatgtttattgcggcactattcacaatagcaaagacttggaaccaatccaaatgtccaacaatgatagactggattaagaaaatgtggaacatatacaccatggaatactatgcagccataaaaaaggatgagttcatgtcctttgtagggacatggatgaaattggaaatcatcattctcagaaaactatcacaagagcaaaaaaccaaacaccgcatattctcactcatagatgggaattgaacaatgagaacacatggacacaggaaggggaacatcacactgtggggactgctgtggggtgggggagtggggagggataccattgggagatatacgtaatgctagatgacaagttagtgggtgcagcacaccagcatggcacatgtatacatatgtaactaacctgcacattgtgcacatgtaccctaaaacttaaagtaaaataataataaattaaaaaaatatatatctgaaggtagtttgttgtggcaactcaacaatgtcggcattgttctaggctttgcccatttttgctgtgccatcaagagtggcttcaggggcgtgtgacctgtaaagtcatatagggttcaaactcagaagggtctcttgcttggtttaaagcttgctgttgctgtttgaatgccttgaaaattttatctttgcacttgtgttgagtaaatgaactctgatgggacagtggaacatgtgtgtaatgagaggaaatacatacaatatgagtgtctgtcattccttgcccctccatttgcatatagtctttgtgatgtcccataaggattgaattccagtggacccaggaatcatgggagttcattgagactcaaagtgagcacaagttaaacatgttacatctatgactaagtaggggagatgatattccagagcggctacacttttcatttaaacgaaaacttgcttcaaatataaaaagaaggcagtgccattctaaggactataaataagcaaggagtcttatatcctttcactttcatgtcacgtccctatattagccatttcatttataccaaaaatgatggcatcaaaggaaagggaaaaatagggcaatgcattgtaccttttcctttcagtcccttccttactcatcagtaagtggaaagtagagaattttgggactatgtgtgtgaatcaaaacatgaaataaagacaattgagtttgtcttgtgcagtgtcctcagtgtttggtaagaaagaaatacacatgcatgcgtatacaaggtaagaaatgcaagtagcataatgttggtgattctgtatataaatcaaatgctcttgcatttaacactggcattaaacaatataaactgcaatgataaaattcatgctaataaattaaattttattctttactgataacatcatcaagtagtaaataaaaaacactatggagccagacacagtggctcatgcctataatcttagcactttggaaggccgaggggggcggatcacttgagctcacgagttcgagaccagcctgggcaacatggcaaaaccagatctctataaaaaatacaaaaattcacccatcgtggtggcatgcatctgtagtcccagctacttgggaggctgaagttggagaatggtttgagcctgggaggcaaatgttgcagtgaggcgaaacactgccactgcactccagcttgggctatagagccagaccttgtcttgaaaagattaaaaaaatgctatggcaagttgagaaagagtccatggaagaaaggaaaatgctttatattttagtacctttaatgacacttttttctgctttttgggtgaggccctgcattttaattttttattgggatttgcaaattatatagccagctctgcctgccaccttaagcttattgcttgccctctagctcttccccccataagagttaccccataattgcaaagtagctctcaaagttccaggcatcaaatctgtgtttgaggcaggaaatagatggaagagttggtgatagcaagcttttcttttatggtcattacgtttatcaggagtttaaaagtctttccagaaacattcagccaacattgggccccatggacacttttagttgcaacaaagtatggaacaataagcatctggcatagaggaatagaaccttccaaaccaatatctcgcaaagaataccgtctaaggcagggattggccaactttgtctgtgaaagggccagataggctctggtggctatatatagtctctgttgcaatcattcaactttgctgctctagtgcgaatgcagacatagacaacatgtaaacaaatgggcctggctgtgttccagaaaaacttcttcataaaaattgtaagtgggtcagactaactgtgggctgtagtttgctgacccctgcttagaactttatttcgctttggttaccaaatggtagaccagggggatgatgataattaagtaggtgctatttattgaatgcctactgtgtattcgtcacctgaagctgaacacattgccatctctaaaacatatttgtattttcttatcaaggaagaaagcagtttgttgagaaggcaagtagcggaatctgccacaacacaaattaagacttgattaaaagagatacaaatgcatagatggaaagccttgctattgtaaagataccacttttctccaaattaatccacaaattccatgcaattccaatcaacatttctgtagtttttttatagaacttgagcagtggatctgctcagtggattttttatggaacacatacatgtaaaaagtaaaacatcaatacttttggtagaaatttaaacttgaagcaggacagagcttaaaaaataagacacaaaaaacgtaagcaaaaaaggaacattttgatgaatcggttttcattaaaatgaaaaactttcatagaataaaaggcatcagaatcaaagtgaacagacattccagggagtggtggacattagtaaagcatataacaaaaaatggttaggtctggaatatataaaaacaactagagaaaagtgggtgaataatgtgaagcagaaattcacagaagaaccctgagaggcccacaaacatatgaaatttattttcaatcctgctagtatcagggaaatggaaacaacaatcaagttttatgccatacgtattagataggcagtactcccccaaagtgaaaatccagtagttggcaagcacgtggaacaattaaaattctcaaccactgttggtgagatatgtaatagcaaataattggaaacaacctaaatatccattaacggaggaatagttatctacatatttatgtatgtatgtatgtatgtatgtatgtatctatctatctatctatcatctatctatctatctatcttctctctattcacctatctttttttctgtctatattacctatttatctgtgtgtgtattatatatagtgatatgttcaatataatgacattaaaactgttgagataataaactggctacatgcatcaaaatagatatatctgaaaaataaatctataaatctaatgtggtaagaaaaatggtagagtactgtaagtattatgacactatttaaactgagttttagaacacaatatatacacacatatttagcaaaaacaaaaagtgtgcatgttaatgagaaatgttgaattcaggatagtggttacatcttgggcgggaggaagataaatgagacgggttggaggaggaaatttagctgcattctataatattttacttcttaaaaacaatatttgaaacaaatattgcaaaatatttgggtttggcaaagctgattggcaagtacactggtgtttattttctctcttttatatgtgtttgaaaatatttcataatacaaattttaactgccttgtgatggtaacctttgaaatatttaaaaatttgacccagccatcccattactgggtatatacccaaaggattataaatcatgctgctataaagacacatgcacacgtatgtttattgcggcattattcacaatagcaaagacttggaaccaacccaaatgtccaacaacgatagactggattaagaaaatgtggcacatatacaccatggaatactatgcagccataaaaaatgatgagttca

SEQ ID NO: 12081 - DNA, 1091 bp, Homo sapiens
tgcaaattatatagccagctctgcctgccaccttaagcttattgcttgccctctagctcttccccccataagagttaccccataattgcaaagtagctctcaaagttccaggcatcaaatctgtgtttgaggcaggaaatagatggaagagttggtgatagcaagcttttcttttatggtcattacgtttatcaggagtttaaaagtctttccagaaacattcagccaacattgggccccatggacacttttagttgcaacaaagtatggaacaataagcatctggcatagaggaatagaaccttccaaaccaatatctcgcaaagaataccgtctaaggcagggattggccaactttgtctgtgaaagggccagataggctctggtggctatatatagtctctgttgcaatcattcaactttgctgctctagtgcgaatgcagacatagacaacatgtaaacaaatgggcctggctgtgttccagaaaaacttcttcataaaaattgtaagtgggtcagactaactgtgggctgtagtttgctgacccctgcttagaactttatttcgctttggttaccaaatggtagaccagggggatgatgataattaagtaggtgctatttattgaatgcctactgtgtattcgtcacctgaagctgaacacattgccatctctaaaacatatttgtattttcttatcaaggaagaaagcagtttgttgagaaggcaagtagcggaatctgccacaacacaaattaagacttgattaaaagagatacaaatgcatagatggaaagccttgctattgtaaagataccacttttctccaaattaatccacaaattccatgcaattccaatcaacatttctgtagtttttttatagaacttgagcagtggatctgctcagtggattttttatggaacacatacatgtaaaaagtaaaacatcaatacttttggtagaaatttaaacttgaagcaggacagagcttaaaaaataagacacaaaaaacgtaagcaaaaaaggaacattttgatgaatcggttttcattaaaatgaaaaactttcatagaataaaaggcatca

SEQ ID NO: 12082 - DNA, 617 bp, Homo sapiens
aataaaatgattttctaaaatgagtttgaattatcctttaaatgcagcaaagttctcctaaattacatgctttaacttctgcattgtaataagaagtagtaaataagagaaggacaaaagtgtaccaaaacaacttatgagctgaagattaaaaaaagagcttcatattgttttctttaagtggacattcattcattcattcatacatttgcacactcaataatttgtacatgagtgactaccatgtgctaagttctaaggcatatacagaatttatctagtgcctggcctaaagaagtttataatcccgtaggaatatgaatttaaacattataattgtaagaaatacaaacattgttatgatggagttatgaagaaccttattcacacatttaaaaactaaagtgtatatatatatatatcaaaaacatcatgttgtacgacataaatataaataatttttgtcaataaaaaataaataacattaatgactttgctgcaatgaagttaaaaaataaattgtataaaatatgtattaattttaaaaacaagtgaaatggaaaattgctaggaaaatgtaacttactaacatttaccggcacatgcctggagtcctt

SEQ ID NO: 12083 - DNA, 6056 bp, Homo sapiens
gccaagatggccgaataggaacagctccggtctacagctcccagcgtgagtaacgcagaagatgggtgatttctgcatttccatctgaggtaccgggttcatctcactagggactgccagacagtgggtgcaggtcagtgggtgggtgcaggtcagtgggtgcacgcactgtgcgtgagccgaggcagggcgaggcattgcctcactcgggaagcacaaggggtcagggagttccctttcctagtcaaaggggtgacagagggcacctggaaaatcgggtcactcccacccgaatactgcgcttttccgacgggcttaaaaaaaccgcgcaccaggagattacatcctgcacctggctcggagggtcctacgcccacggagtctcgctgattgctagcacagcagtctgagatcaaactgcaaggcggcagcgaggctgggggaggggcgcccgccattgcccaggcttgcttaggtaaacaaagcagccgggaagctcgaactgggtggagcccaccacagctccaggaggcctgcctgcctctgtaggctccacctctgggggcagggcacagacatacaaaaagacagcagtaacttctgcagacttaaatgtccctgtctgacagctttgaagagagcagtggttctcccagcacacagctggagatctgagaacgggcagactgcctcctcaagtgggtccctgacccctgacccccgagcagcctaactgggaggcaccccccagcaggggcacactgacacctcacacggcccagtactccaacagacctgcagctaagggtcctgtctgttagaaggaaaactaacgaacagaaaggacatgcacaccaaaaacccatctgtacatcaccatcatcaaagaccaaaagtagacaaaaccacaaagatggggaaaaaacagagcagaaaaactggaaactctaaaaagcagagcgcctctcctcctccaaaggaacgcagttcctcaccagcaacggaacaaagctgaacggagagtgactttgacgagctgagagaagaaggcttcagacgatcaaactactccgagctatgggaggacattcaaaccaaaggcaaagaagttgaaaactttgaaaaaaatttagaagaatgtataactagaataaccaatacagagaagtgcttaaaggagctgatggagctgaaaagcaaggctcgagaactacatgaagaaggcagaagcctcaggagccgatgcgatcaactggaagaaagggtatcagtgatggaagatgaaacgaatgaaatgaagtgagaagggaagtttagagaaaaaagaataaaaagaaatgagcaaagcctccaagaaatatgggactatgtgaaaagaccaaatctacatctgattggtgtacctgcaagtgacagggagaatggaaccaagttggaaagcactctgcaggatataatccaggagaacttccccaatctagcaaggcaggccaacattcagattcaggaaatacagagaacgccacaaagatactccttgagaagagcaactccaagacacataattgtcagattcaccaaagttgaaatgaaggaaaaaatgttaagggcagccagagagaaaggtcgggttaccctcaaagggaagcccatcagactaacagcagatcttttggcagaaactctacaagccagaagagagtgggggccaatattcaacattcttaaagaaaagaattttcaacccagaatttcatatccagccaaactaagcttcataagtgaaggagaaataaaatactttacagagaagcaaatgctgagagattttgtcaccaccaggcctgccttaaaagagctcctgaaggaagcgctaaacatggaaaggaacaaccggtaccagctgctgcaaaatcatgccaaattgtaaagaccatcgagactaggaagaaactgcatcaactaatgagtaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctgccaagcaaatggaaaacaagaaaaggcaggggttgcaatcctagtctctgataaaacagactttaaaccaacaaagatcaaaagagacaaagaaggccattaaatagtggtaaagggatcaattcaacaagaagagctaactatcctaaatatatatgcacccaatacaggagcacccagattcataaggcaagtcctgagtgacctacaaagagacttagactcccacacattaataatgggagactttaacaccccactgtcaacattagacagatcaatgagacagaaagtcaacaaggatacccaggaattgaactcagctctgcaccaagtggacctgatagacatctacagaactctccacaccaaatcaacagaatatacatttttttcagcaccataccacacctaatccaaaattgaccacatagttggaagtaaagctctcctcagcaaatgtaagagaacagaaattataacaaactatctctcagaccacagtgcaatcaaactagaactcaggattaagaatctcactcaaaaccgctcaactacatggaaactgaacaacctgctcctgaatgaccactgggtacataacgaaatgaagacagaaataaagatgttctttgaaaccaacgagaacaaagacacaacataccagaatctctgggacacattcaaagcagtgtgtagagggaaatttattgcactaaatacccacaagagaaagcaggaaagatctaaaattgacaccctaacatcacagttaaaagaactagaaaagcaagagcaaacacattcaaaagctagcagaaggcaacaaataactaaaatcagagcagaactgaaggaaacagagacacaaaaaacccttcaaaaaattaatgaatccaggagttggttttttgaaaggatcaacaaaattgatagaccgctagcaagactaataaagaaaaaaagagagaagaatcaaatagacacaataaaaaatgaaaatgggatatcaccaccgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggctctgaaattgtggcaataatcaatagcttaccaaccaaaaagagtccaggaccagagggattcacagccgaattctaccagaggtacaaggaggaacttgtaccattccttctgaaactattccaatcaatagaaaaagaaggaatcctccctaactcattttatgaggccagcgtcatcctgataccaaagccgggcagagacacaaccaaaaaagagaattttagaccaatatccttgatgaacattgatgcaaaaatcctcaataaaatactggcaaacggaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacgcttcatgctaaaaactctcaataaattaggtattaatgggacatatttcaaaataataagagcaatctatgacaaacccacagccaatatcatactgaatgtgcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagccgataagcaacttcagcaaagtctcaggatagaaaatcaatgtacaaaaatcacaagcattcttatacaccaacaacagacaaacagagagccaaatcatgagtgaactcccattcaaagagaatatttgcttcaaagagaatgaaatacctaggaatccaacttacaagggatgtgaaggacctcttcaaggagaactacaaaccactgctcaaggaaataaaagaggatacaaacaaatggaagaatattccatgctcatgggtaggaagaatcaatatcgtgaaaatggccatactgcccaaagtaatttacagattcaatgccatccccatcaagctaccaatgactttcttcacagaattggaaaaaactactttaatgttcatatggaaccaaaaaagagctcgcatcgccaagtcaatcctaagccaaaagaacaaagctggaggcatcacactacctgacttcaaactatactacaaggctacagtaaccaaaacagcatggtactggtaccaaaacagagatatagatcaatgaaacagaacagagccctcagaaataacgccgcatatctacaactatctgatctttgacaaacctgagaaaaaaaagcaatggagaaagaattccctatttaataaatggtgctgggaaaactggctaggcatatgtagaaagctgaaactggatcccttccttacaccttatacaaaaatcaattcaagatggattaaagacttaaatgttagacctaaaacgataaaaaccctagaagaaaacctaggcattaccattcaggacataggcatgggcaaggacttcatgtctaaaacaccaaaagcaatggcaacaaaagccaaaattgactaatgggatctaattaaactaaagagcttctgcacagcaaaagaaactaccatcagagtgaacaggcaacctacaaaatgggagaaaattttcacaacctactcatctgacaaagggctaacatccagaatctacaatgaactcaaataaatttacaagaaaaaaacaaacaaccccatcaaaaagtgggcaaaggacatgaacagacacttctcaaaagaagacatttatgcagccaaaaaacacatgaaaaaatgctcaccatcactggccgtcagagaaatgcaaatcaaaaccacaatgagataccatctcacaccagttagaatggcaatcattaaaaagtcaggaaacaacaggtgctggagaggatgtggagaaataggaacacttttacactgttggtgggactgtcaactagttcaaccattgtggaagtcagtgtggcgattcctcagggatctagaacaagaaataccatttgacctagccatcccattactgggtatatacccaaaggactataaatcatgctgctataaagacacatgcacacgtatgtttattgcggcactattcacaatagcaaagacttggaaccaatccaaatgtccaacaatgatagactggattaagaaaatgtggaacatatacaccatggaatactatgcagccataaaaaaggatgagttcatgtcctttgtagggacatggatgaaattggaaatcatcattctcagaaaactatcacaagagcaaaaaaccaaacaccgcatattctcactcatagatgggaattgaacaatgagaacacatggacacaggaaggggaacatcacactgtggggactgctgtggggtgggggagtggggagggataccattgggagatatacgtaatgctagatgacaagttagtgggtgcagcacaccagcatggcacatgtatacatatgtaactaacctgcacattgtgcacatgtaccctaaaacttaaagtaaaataataataaattaaaaaaatatatat

SEQ ID NO: 12084 - DNA, 11129 bp, Homo sapiens
gtgctgcgcagctccctaagcggttgtcaccgctggagacggttgggagaaccgttgtggcgagcgctacacgaggcaaacgacttctcccttctttgaactggaccccgcgagcaccagagtcggcgtaactatcgcctgacagggtatctgaagtaaaagggggtaggttgggctggtggtttcgagagcggagtcgggagaaggacgaaaggccgggaggggctgggttggggggtagtggggtggtcgccgctcggaggccgccgcttggaagcggcggggctgcgcctccccgaccatctcccacttcagggagggcggcttgccgatgggaggacttgctcaggtggaattcagtggacgacgccgaggcccgaagtaggggacatccagcattttcccctttccctgctggcttggcctccgccattttgggtacagtggcgcggccacctcggcttcccgcccttccccgctctttttacttttttgttccccagcttccgaaaactgatctagaaggccaggggagggggtggtcaaagctccctggaagggatgagggtgggtagtgaagcgagcagggaaaggccgggcagttgggtggagggaggatcgggtttgccgggcgcgctcccgatggaaatggcgccggatgggcctggcctcccaccgcggcctcccttcctccgcagtctcggcagggctacctgggctgacgggactgcgagtgacttctgacgcagattcccaagatgagagaggctggagctgggggaggaaagccaatggcgacgaaggtgctcaactcccaaatccaggacaaaggaggcagacggcctcctttgtaattctgccgcccggtggcgaagggttttaagccaggcttggctgctgacgggagggggaaggggcgtactctccctagctttctggtctctagggcagctagataaacggaaagtctcctgggaggaataaaggacgcttagccggcccttatattccagatttggaacttcgaaaagagtacgtactgattttccaaagggttttttttttttcatgtttaaacgttaataaggacttcggggatgattttgtgagcagaaaagtgggtgatttatcaaataggaatgtgaaatgggcatgtttcaagtaggtcgtctgggcccagtgaactataattgttgctttttgaactttgggggtgggggtgggtgatgtagcaattgttttgcgtagtttggcgtatatatgttagaatttgtttttaagttttacttttgggaaacagttaaaacaacccagtgatggtagatgtgtgtgtattgaaattgagctttcgatgttaaatcttccaagagttgtattttgtgcagttttttttccgatggcattaaggctctagaagtaaaatacttcaaaatacggttatggtttattttcttttggtagctaggcatgttttttctttagtgtaggagtatagtacactgtaatcgtattttaaacaagggaataagcctactaaacataaaaacaaattgtaaacccagtcacgtggtggtggtgtgattcggatgagggtcctgagaactggatccgtaattttcattgaagacagtacaaaagggaggagaaaggcctgagagtaagaatttctgataattcatgtaaaactttataagaatattgttacctacttttccagctctaaaaacaaaaacttattattattgaagatgttcagtgatgctttctcaagattgccaaggaaaagtttacgaaaatcttaccttgaaacagtaggtttgagtgaccctttgaagagatagtccagactgtcctgtaaagttatatatgatataacaaatagctttactaattggattggactacacatcttttttctgtcctcttttcatttgtgccgttatctggaaatccatctaattgcctttttaaaataatgttatctttgatttccttgttttggtaaactgactgaactgcagtagataaaaacctggttctagtgaactaacattttagagaccttacctccttaagctattaggggtgtgtctagttttttgtttttgtaaagagcaagcccattgggaaggaatgatgtaaattttctgttaaacttaaatcatcagcactttttccaaaaaataaaattcattctcatttcttgaccactgggctaccatttagaaagttatttattgatgtaaaatcctttatgtattacttcagaagataggctatgcctccgtgttaagaggattctctatttcatttgttctttagtggattttttttctttaacgactttggtatataattcacataccgtaaacttcaccaattttaaatgtacagtttagtggattttagtacattcacagcgttgtgtgaccgtcactacaatttaattttagaacatttttgtcactccaaaaagatatccataccctttactggtcattcccattgctggcatcctccctcccctcaagcctcagacaatcatgaatagaaatggaatcatgcaatatgtagtcttttgtgactggcttgtttcacttggtgtaatgtttagaaaattatacttaaagtctcataaaacttgaccaaagctatcctcatattttaactgtggtatcttttattggtactagcacctagaattcttaaagcagagtagtgattagccatgacattgttgcaaagaaaggttgaggtggattatcctgaataattagtaaactgttttaagtagtttctgacagctttattagagcagattgcttcttcctgtgcccttagagtttttcttgtttttgttttgtaggtaggatttttagttttgaaggggttggtagagtgaggctgtttttattgtatgtgctttgcatacacagtcaccctataaaatagattaagtgttccgagttcggttgggttttccgcaattaaaaattgtgttaacagtttagtgtttcttacagataacactgataacactttttttgttttcattgggtcttatcattggtacagactgatccaaaaatccaattggcttgctagtaattttttcctgtgaattgctaagatttatgggtaaattaatttttctttttcttttctttttttttttttttaagcatttgctccttaaatgcaaatcgtaccactaagatcctctcacaacagattaaggtcgaatttgcagagttcttcaatttttcatgaagcagtgagggtagatctgtaccactttttccgttctgtgtaaatcaccgtttatgggaaacacttgttttttaggttggtgctatttaaaaaaaataaataaaacggtaggcattttcaaaacatctctgaactttttttttttcccaaactggattggggccgcctcctctcagagctactctttagaatagtattaaacttataaaagcctttgctggctttgggaaataaaatttttaataattctcagttcttttcaaggcttgaattgttttctgtccttcagggttcacatattttgtgtatggtatagctcactggcttttgcagggccccttaaaatccagtaacaattgccatcagtaaatgcttaccatgaggcagaccaagcacttgaatagtccagtgaggtacaggtacaactgctatagtttacaattgaagaggctcagaggtaaagtggttcaggtagccagtgagtggcagagtagggattcagacccagaacattcataatatttatttgtgtgcataacaagtagttgtaatgtcagttaaaagtttgtattcccattttggttttctatgtctagagtggcacctagggctgaaggtgattgacactagaggtacttaactacttccagagaatttctacattagcttattttaagtgcatgaattctagggaaaaatattttaccctttgcagatgccacccctaagagatgcaccaacaaatagatgacatgaaattaagcattagtgaatgctgttgatacgaaatatgatcttcaaacataaaggaatcaaatgaacaaactttgtttacaggggaggaggtggtgagggaaaggtttgaaatactcaggtgagtaggattcctacagctgcatagtgagatttgtaaggttctggtaagtttctgcagctgaaggacttctgcattcacctcttttgtaaatattatggaattttaaaaggaaggatggttgcctctggggaagggaactgggaactgaggttattttggaggggaaggggggcttctagatgtaccttttatgctttattaaaaagtatattacctattaaagtttgtttaaatctatttgattaaaaatttgagtaaactggtttctaaacactgtctccagtggcttcaaaaacacaggtactgttggaaggcattcacttttgagtggcctttgacctcagttttaatctgattaattcagtcattttataatcttgctcttggtgagtttaaactagatttggctaaaatagaggtgggagtgttggcccttcaaagacagtttgatgtgttcaaaattgtagtgcatttaaaagggttagacttctgtgatatttgtccaacgtcaatcagtactcattgcatttttttacttaggctcttgatgttagtggatactggtattatatgcaacttctgaataagttttaaagaatttgaataatcagttgaataaaaacctgaaaagtggtgaatgaaaatttgagagataaggaaaggctagagttggcattcaggggacacaaatagtttgaagactctggtagtagaattatgcaagttttcttaaaattaggcaatatataatattgatactacgaaattcagtacttttccgtaggagggggtcaggtctcattgccttttccgtaccccaaaatatgaaaggtggtctacaattttgttgtggcattgtcacagcagttggccccatgttacatttcctcttgtggcacctctgagaggtgtttcttcattacctcttgacaagagtatattttgattgactgctctatgtgcttgtttattttttatagcatttaaatcaaacggtattgagatggattgggttatgaaacataatggtccaaatgacgctagtgatgggacagtacgacttcgtggactaccatttggttgcagcaaagaggaaatagttcagttctttcaaggtacctctagtattagtcaaagtttagtagtattgtaattttatatttgtattgttttactgtttttaatttgtaaaacccatttgattttggaacttttaagtttaactatgatagtcttggttaatgtattaaaataatatgctccagttaatattcaatacagaatgtgtagaatatgtaaaacctaattaatgtgcagtaacatatttgagaattgtgatgaaatgaaccgtgaattagtatatggagcatatatttgattttgtagccttttttcatgtaatataggtgggcttttagagtgtgtaattacacagtgtttttacactggtcgcaaaaaatttatttaatccagtaatatttgaaaaaatctttcatttgtattatggggtgatgggaaactaagcttttttgttttgttttgttttgtttagacttgttttaaatatttgattcagatgggaatgtttcagcctttaacactgttccccttgatggggttatttgtccttgggttaaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtggggatggagagtttgggatggtgttaaatttttatttttgggggttgtgggtcactattgcttaaatgggggggtagccataacatttttctggggtagtttaaaagaattgataattatctaaatttaacttggaaactacagatttgggtggggaattaatgctaatagttaaattaaaattagattgtttccatttctctgtaggatgttgttgataaatgcttttgtataatcacctatttcctttaaaacacctattatgtactaaaagagacaaagtaaaaatatactttatgaattgttttccgtgactaatttctttgtaaaacttaaatatttaattaagtttgtaggtttaaactgttaacttacggtgtatttaggcaatttaaattgggttatgtatctagatatagaaaaacttactgcattttgcccagtatctaatttacactaatacatttatgctgaaacctgtaccttaaaacatttttaaataggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggtatgtgtatctaatgaacaaaggttctgttgtcattttcttaatgttcctgacactttgtcaagaaatacagaaatggcagtaatttcagtacctattaggttttaaaacctgttcatgaaaatacggattcccatggctagctgtgggacttgactgatgcacatattggcacctagaaaacttacacagaaattaaaaataagatgttggcatattttgacctttttttgcctaaggatgaaatttaatttacatgtctgaacttaattaactttctgagattttaaatttccatcacgttgactgcttttttcataggttttaagttgggaattgcaaacttgcaatcaagttacacagactgttaaccacaaaatgtttttgtaaactaaattataaaatttatctctggaaagtgtgtagtcatgtgtttctccttaaattacacaggttatggaggttttgatgactatggtggctataataattacggctatgggaatgatggctttgatgacagaatgagagatggaagaggtaaaataaatattaaagacatttttattcataggtaaattttagtatttgctttgcaagctcttagtggtaatataggaaacttgtataaagttaattcagacaaatttcagtgcattcctatatagagctttataccttgtatagtatgtatgtatacttccctacttgtatctgtaatagtttataatcttggcaaattgtgttttccaggtatgggaggacatggctatggtggagctggtgatgcaagttcaggttttcatggtggtcatttcgtacatatgagagggttgccttttcgtgcaactgaaaatgacattgctaatgtgagtaatttttaataactattagtggttttatacttatcctggtgtctaaatctttaagcattcttaatgttctcatgtttatagcttaataccaaaatcccttgaatataaaaatagatctacctttaattctttttttgagatggagtcttgctctgtcccccaggctgagtgcagtggtgtgatctcggctcactgcaagctctgcctcccaggttcacgccattgtcctgcctcagcctcccgagtagctggaactataggtgcccgccaccacgcctggctaattagatctacctttaattctaatcactgatggatatttttgtatccattgtgtgtcaacctacataggattcaaacaagtaaaaagctacattcgtgaagtccagttaagagtataatgaaagactgatcagcatagaatggtgatgactataccattttgtgctggtgtcttttgttgtaccgttttttgttttgttttcttttttgagacagagtcttgctctgtcgcccaggctagagtgcagtggcgcgatctcggctcactgcaacctccacctcccgggttcaagttattcttctgcctcagcctcctgaatagctgggattacaggggcacaccccaccactcctggctaactttttgtatttttagtagagatggggtttcaccatgttgatcgggctggtcctgacctcatgatccgcctgccctggcctcccaaagtgctgggattacaggcgtgagccactgcgcctgacctgtattagggtttgaaagagtgaatatataaatattagtgatttggtttggctttctaggctagatagtgattagaaactgaggagttggaaataacaggaatagatgctgttgttgtcactgatgtgaaactggttggtttcagatttgttaggaggtcagcaaacttcagtccatgggctaaatccggtcacaccattcctctacctgttgagtggttacattagagacccaatggccattcaggccaaaagtactgactctggctttgaaagcaatggtgtgctctagatcttactgggaatcagctggcctgagttccaactgcttttaatgatagtttaaaacctggctaacttgtgattagaaccaaatgatatcttttggggaacaatttcatatagtcttaaataggtggctttattcaaaccgcatagttccaaatcatgatatcccgtatttctctctgtgtgtttgtgtgcttttttttttttgacagagtctcccactctgtctctctgaggctggagtgcagtggcgtgatctctgcttactgcagctcccacctcctgcgttcaagcgattctctgtctcagccttctgagtagctgggattacaggcgtgagccactgcgccctgcctatctgcttattttaaaagcagtaaattctttacattatccctaagtgtatactctgatattcacagaacctctgtagttgactaagttattagtctgacagggcagtggaagggtttgttttaattgatgaggaaaaatcaaggtatgtggtaatttactttaatattctcaatagaaaagtaaataagtgtttccttttatttagttcttctcaccactaaatccaatacgagttcatattgatattggagctgatggcagagccacaggagaagcagatgtagagtttgtgacacatgaagatgcagtagctgccatgtctaaagataaaaataacatgcgtaagtggtgtctttggcacacaatcttatttcctaaacgtgaatttataaaataagaggctctaagatctgtaggtaacgcttggcagttgttgggatttaaaaccatttgacctctataatggctttctgtgggctttatatatcgctgtactagtaattaataagcatactttgtttaatattacttaattgatcttttttacaaagcttgtattgatgaattttatccatcattcctttctcccctgttactctttctttttttcttaaagaacatcgatatattgaactcttcttgaattctactcctggaggcggctctggcatgggaggttctggaatgggaggctacggaagagatggaatgggtatgtaaagtttttaaaatatgcagggttagctgcttatcgatgagtctcaattttttttcttttttctttttaaagataatcagggaggctatggatcagttggaagaatgggaatggggaacaattacagtggaggatatggtactcctgatggtttgggtggttatggtaagtatctctagttcagtttgtgttagtccgcatatgtagtgcaaactttaaagtgcaggtattacttttattattttatgcagatatctcctgctgagtgattcttaatatctttttcttaaggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataatagta

SEQ ID NO: 12085 - DNA, 440 bp, Homo sapiens
caaaaccaaaatgtacttatttattaggtgtcacttggaagcgcaattttcaacaacgcaaaactataaaaaaaacccaacgtcggcctccacaggctaatcagtctccgaggcactgacggcgggagagatgaaaacgcgaaggccagaggagaaaaagaggaaggatttgcagagagaacggtaacgtggtggacatgaatacacccaagaaacccggatcccgcgcggcacattgggacgaagcgcgctggcgggcggccagcaactctgggccaggggaaggaggcggacacccagcccgagagccgaaatcggccccagtggacgctttcatcttcgcggcccagaaacactcctatttttcaccgcacaatgcaaacatggtggaccagaaaatccgccccgcgtttgccggtcgaaccacgtggggccctttc

SEQ ID NO: 12086 - DNA, 1584 bp, Homo sapiens
cttgactgaagctatgattcatcttaatgcttgtatccacttcctttaatgagcaatttaaatattagggcatacaccacctgtcttttttgaaagttgtatgtgttttattttcccaggattactctcttaacatcttaaagcagtaaaagtatacagtattaatgaaaccaaaattgcccttttaaagcaggctaattttccaaatatttatttagttcataaaattcacattttattttttaaacattataggttagaagaattacaattgtaattccctggcaccatgatagcattattgtggtagtactgctaggtgagggaatggtatgttaagtctgtttttgaaaagtaaaatgaatacgagttcacaatcacgaaatacagattgttaaaagtcttgtaacagaaaaatccaaagttagtatagtttttaaataagccaaaactacatggagcaagttgctgtcataaaagctgccttaaaaaaaaaaaaaaaaaaaaaaaagcaagtaagtcagtgttgatacatgagttttgaaaagtgagaaacttacttaaaggatgacaaaatcatggtttgttgaatgaaattagccttggaatttaagcaacttaagtcacattttaaaatttgttctaagcacagtaataaaaaagcatatttgaaaatttcattttttgtttattcagtaatcataaaaatgttagcccatcccacctatcaatacaaaatggttcaagaatataatcctctcttgaggacatttctgtcagtattcaagaaagaccatctagaaatctgtgtcacatctgacacctcaaaagctgactggaaatttacgggttttggaaaaaatagatcttcaagtaaaatattcatttcatacttaggctattcagaaaaatttaaatttcatggaagcatatattcatgaagaaaagatcctgcagtattaataagaactcctttgtaggcagggaggtacctaggattaaccactaaatataatgctcttaatccataaattttctatgtattttttataggctcacaaacttaaagtgcatggttaaaaattaatgtaaaaaataggatactgaatggtgatagtgtttatgtaactattcagaggtaatttatacaagttaaattcttagtatgccataagcaatataacttggattagtgttcattgagtcagcttgaaataggtcaagtgtactggccaggtgctgtggctcacgcctgtaatcccagctacttgggaggctgaggcaggagaattgcttgaacccaggaggtggagatcgtgccattgcactccagcctaggcaacaagagtgaaactccatctcgaaaaaaaaagaaataggtcaagtgtatatttcatcatctcaacacccttggcatagaggtgctcaatggacatggtgaaattttactgtggatgtatacaggtaggccactacaatgtgatacttcctaaaatttactccaatgaaaatgttaatacaaaattttttgaactgaactctaatacattaccaaagcaaagtcctgatttttttctcactttt

SEQ ID NO: 12087 - DNA, 4238 bp, Homo sapiens
ggctcggtcggcgcgggtggagggggcgtgaggccgccctacggtggccgtcgagggacggcgctacggctcccacgctaggccaaacgcctccggcggccgcgcccgagagccccttcacctgcagggcgaccccagccggcgacgcgtgaaccacgccctcagccgccttgccagcgcccccagccgcgcgccccagcaccatgcggccgccctgcgcacggagccccgagggacaggggcacccgcaggcccggcccctagcaccgccggccggccccgaggtccgggacgccggcgccgccgcggagagggcaccgggtgagctgcggtcggggacccggcctaggcgggggccgtctccagggcaacgcgcggcgcgggacccggaagtggctccggcaggggctctgcagccagggggcccggcgcggcgcggcgcaggcccggtgctcacgcggagttggccggggcccgttgcgtctctgcggccccgaggaaacagtcctgggtccatgggccgggccgagcgggcgtctgcagaaacgcagggacccggatggagccgcgggccgcgagaccctgcggggacacagctccgccgagtcgcgtttgagtggcaccgccatggccggggtcccggccggggcgagctccaggccaaggccggccttaaatagggccgctctggcccctgcaccccgtggaggagccgggcggagggagagggcgaggtcgggcccctgcgggcacgggagggtcaggcggccccggcccctccctcctccgccctggccaggtccccacggcagggccccaggctgaatctgaaggcaggcgaagctcttggcaacagtcccctgtaatgttaccaactttcctgctcagattttatttcctgacctttgagttcattccgtctacagattatttcggcaaggtataaacggcctttactaggtgaagctggagagccaaatgccgcctctgctctttgcagcccagtctgtaagggccgctgccaggccccgggccgaccccactgtgcacgccaggcccagccccttccctcccacagctacccacaaaggcagtgctattggcacccccattggacagagcaggagccgtcttggggtcaggtgacctgcccaaagtcactgctagggaaggacagtgccagggttcaggcccagcaaggtgaccccacggcccccgagccgtccatctggcacccagcaggttgctggagtcacctgctcccgccgggctcgttttcggttcacctgcgagccctggagtcccttttcccggccctgtggtggcttcttgcagatgccatttaagggcttgcatcagccctgggtcaggcagccgcagaagaccagggcagtaacgggcaaactgcctaagagcagagtgtggtccagctagtggggagctgcgaggatcctgcaggaaagagccactcttgccccttcccatccgttttggcattgaccacttccgggggcctcccctggccactgtccccaaggccccctttccccagtgctgccctagaacaagcactttggcttccccaggtggtgggccccttggaagtatccttgggagggtttgtggaaaagagcccaggagtgcctgcagatcccgccctggactccattttcccgtagtcctggtgctggagtttgtgtccactttcgccagctgattgcctggggagggatccgcatggtgtcctcatactgacgtgggttttgcggctctccccgcaggccgacgcctccccccagggtcagctgcgggctcccaggcctaggcgcccatgacccctacgccaacagccgcctggacaccgccgccgccactgcgacctagcgccgccgccgccggggcccaatgccggtcatgcccattccgcggcgggtgcgctccttccacggcccgcacaccacctgcctgcatgcggcctgcgggcccgtgcgcgcctcccacctggcccgcaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtggctgtgttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctccccgtatgcactctcaggggcagcgcccacctgccggtggctcctgctcacatgtcttcgggtcgtactgcggggtgggccctccgttccgcctctctgtgggcctctctccaggaccacagctgccagggactttagacatcaccctgggaggcccctggacacagagggctgtgtgcccaggagcaattccggaggggggccctcctggctgcacagccccttctgcgtgccctggccccagccccagccaacgggacacggaaggctcccctcgctgacacaccacactgccacaaagctgcttactctgccctgggccgcctgaggcctggcactgcccgcggaccaccctgtgtgtgtcatcctgaggggctgtgtgggtcctgagtccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggagcaggcggcagaggcctcagtgcggcaaacacagccccagagcctgtgtggcaccagcagcatcttagagccccaggtatatgctgagatcttatctcacgctgtcctccagtgtctggggggcccaaatgatggcacaggggcaggtgggctggaggggcgcagatgcctgtgttcagggagggtggccaccatgggccgaggtctcacccaggaccccttgctctgctcctcagccttgcagtcacggcagcactatggtggactgcccatggccgtgtgactttgggggcaagtgggagggcgccctgaataatgattgcaaggacaacaggcagaggctaccctagagcaggacacagggtgtggtactgacaaccctagtgtcacctcaaatccatgtccccacactctgggcatgggtgggacttgtgaccctaccctgtcaggcggaccagtggcccaggagccatgaggacagttgtgtgccactggaagagaaactttttgaaaaaccctaaatcaggtagagaaagcaaaaaatctctggccgtaaaccgtgctctctaatttatcggcagcttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgctcgtgcggtgtcaacgctgcagggagttgtggcaccttggtgccctctgagcacctggccgcctgctgtccccggtgcctgtgaaattcgtcatgccatgacccacctgcattaaacctatttttttaatgtgttgatggagtgattgcttaaa

SEQ ID NO: 12088 - DNA, 2169 bp, Homo sapiens
catctgcttcctactctattttatctgcagcctgttcactgcgggttctggagtgcctggccgctctcttctgcctacagtactctgggctttcgcgttgtcttgcctacagcgcaagctggcggtgctgctgctgctgctgggccgccggcgcgtggacttccgcctggtgaacgagctgctcgtctatggcatccacgtcaccatgctgctggtcgggggcctgggctggtgcttcatggtcttcgtggacatgtgagggccgtgggtgcgagcttgatgtatcgtcccggcctgtgctgatgcttctctccatgggtggggtcggccagcgccttcccttcgcccatcccccaggcagtcgctgctgcccggcgcccacggagagaaaagaaagggctgagacttctgtgatgggggcgcggacaccacccctaggctggcttcctggacccaccctccccgtatgcactctcaggggcagcgcaccgtgccggtggctcctgctcacatgtcttcgggtcgtactgcggggtgggccctccgttccgcctctctgtgggcctctctccaggaccacagctgccagggactttagacatcaccctgggaggcccctggacacagagggctgtgtgcccaggagcaattccggaggggggcctcctggctgcacagccccttctgcgtgccctggccccagccccagccaacgggacacggaaggctcccctcgctgacacaccacactgccacaaagctgcttactctgccctgggccgcctgaggcctgcactgcccgcggaccaccctgtgtgtgtcatcctgaggggctgtgtgggtcctgagtccccagccagccttcagggtccccttggattgtgtagatgcagtctagcggggggccggagaagggctcaggtgggaggggcctcagcaggctcccagctcaggggctggcctggggggaaccctgggagccaggggctgactccagcaacactggcctgtctgcctgttctgggagggctgtgaggatgtcttgcagatgctctggatttctgcggaggcacctccattcctttctggctttttttgcgggggagggctttgggcctctttctttgagggaacaccgtcaaagaaagcctgggagatcgaggcttcagtgagccaggatggaaacgcgtgtcccaagtgtccggagcaggcggcagaggcctcagtgcggcaaacacagccccagagcctgtgtggcaccagcagcatcttagagccccaggtatatgctgagatcttatctcacgctgtcctccagtgtctggggggcccaaatgatggcacaggggcaggtgggctggaggggcgcagatgcctgtgttcagggagggtggccaccatgggccgaggtctcacccaggaccccttgctctgctcctcagccttgcagtcacggcagcactatggtggactgcccatggccgtgtgactttgggggcaagtgggagggcgccctgaataatgattgcaaggacaacaggcagaggctaccctagagcaggacacagggtgtggtactgacaaccctagtgtcacctcaaatccatgtccccacactctgggcatgggtgggacttgtgaccctaccctgtcaggcggaccagtggcccaggagtcatgaggacagttgtgtgccactggaagagaaactttttgaaaaaccctaaatcaggtagagaaagcaaaaaatctctggccgtaaaccgtgctctctaatttatcggcagcttctgtggatgacctctgatgagcccgggctgcgtccacgccctgggcaggtaggcgggagcttccctgcgtgggcctcatttcttgctgcagagaatcttttgcactaagtcatgctgtttcctcaaagaagctttgttttttgttaacgtattactcagagtcacccaagcctcttggctgagggtgaaggtgggacgggaggcgggagggggctggtggtgccgttcgtgcggtgtcaacgctgcagggagttgtgcaccttggtgccctctgagcacctggccgcctgctgtccccggtgcctgtgaaattcgtcatgccatgacccacctgcattaaacctatttttttaatgtgttgatggagtgattgcttaaa

SEQ ID NO: 12089 - DNA, 1616 bp, Homo sapiens
gtagttttttagtagagacggggtttcactgtgttagccaggatggtcttgatctcctgaccttgagatctgcccaccttggcctcccaaagtgctgtgattacaggcgtgagccaccatgaccggcctatgaaccacttttgactcagcctgggggactgtcttctgggcacagctggcagtgggttcacctgaccctgtttagcagcagaagcttcaaggcctgttcctaattttgtattttcttaaggaaggtcccttaaaccacagaagcctcaggccccacaaaacctgcatccgcccctggctgcaggacactccagggtctggatgcagccagggccagccacagcctcactagctgaccgcacctttaaaagtacgcgcattggcagctttgttctgacggccacaccccccaagagacctccttggcctttggcttgggtgatgctgacccacatggaggggtctctggcccagcagtcctgggacatcccctgtatgaagaccatatgtctgacatggcacttgccaccctttctggtcatttgcccctcagcctgtccctgtcacaagatgacaggtgcctcgagggtgggggctctgctgtgcctgtgtccttggtacccagagcagggtagcagcgtgggggcaagtgcaggcacgcatgctgtgcttctctgggcgggtgcacagtgggaagcagggggtgtctaatccagagctggagtcaggggactgcagggcagggaggacacgggaaacccacagcaaggagcggggctgtggctctgctcctcccatggcacagccaccagatgggccaggtgtgagccctgatccatggacatgcgaccaccctcaccagcacgcgaaaagtcgagtgacgggtgaccacctgctttacacgccaccctctatctggccacgggcgccatctcacggtgccggcgtcccagcacgagccacatgggaggggagaattatctttggttagtttgtctctaatagtccttaaaacagaagacaaaaaatgaagacaggcatcaagatgctattatctcaatgtttatatatttaaaatgttttatttatttttgtggaggccatgttgccagccaggtcgcccaggctagtcttaaaactcctgggcacaagagatctgaggccggaatgacaggtgtgagccaccacgcccagccttatctcaatagctaaacgtgtggatctgcctcacatctggagaggcagagaggtgagccaccaacaggactattgaggaaggaaggagacctgtttattgattttaagttttttgtagagacaggggcctcactatgttgcccaggctggtctcaaacttctggggcaagtgatccccctgccttggcctcccaaagcggtggaatgacaggcgtgaactagcgcttcttgcctgacacgtttctttcggaatatttgccgccagccatcggtaaagaaaacaggctcttggccttttttgctgtgctacctcctggtggcctttgctcgtccagatgttcctcgaactcctgctcatgtcgggtaaaggcggctctctctcctgtggcggggatggggccacagtggag

SEQ ID NO: 12090 - DNA, 3344 bp, Homo sapiens
ggagcgagcggggccagcgctgcagaaggcggcggctggctctccgggacggtcacatcccgctgcaggggcgggcggaggccgccgcactgcctcccgcaccggggacccaggccagcgtccgggcaacgccccctgctcccggacagactccgtggcccgctcgagccctgggggctccgcagacccgcgcccgctccgcccgcagctcggccccgcgctgcccgcgtcgccgggcccgcgccgggatggggtaggggcagcgccaccgagtcgggcgatgggccgccctctgggcaccgagcagccccccgaggcctgaccaaccgcggggaccggcggaggtgggtgtgggcagggcggaccgcactctggggccgcccgggcaatgcgggggcgggagggcgtagagaaaatagggctgttgtgagctgtggggagcccaggagagctgctgccccccgacctccgtgcgttctgggcagtccttgaccccccacaactcctgccatctccaggagccccgcctggatgtcaagcggatgccaagcggatgccacagttccccccccagcggactccgtggggacatggcttcgctggtgcccctttccccatatctaagccccacggtcctcctgctggtcagctgtgacctgggcttcgtgcgagcaggtaagtaaaggggaacggggctgagggtcaaccacagctagtcaatgggtgaaacctgttaaacaccctggctcccgcagaccggcctccctctcctgtgaatgtgacggtcactcacctcagagccaactcggccactgtgtcctgggacgtcccagaaggcaacatcgtcattggctactccatttcccagcaagtatgaatcacccttctgctcccccaacctgtgtccttggatttcggcacatttcttcacttaagtgggggggatctggaagctggcgtatcctggctcaggctgcccttttcacgctactcccccggagtgcttggatgttgaagagtctctggttgagccttgtggcctggcactggggtgaggctgtcctcctctcccctcatctccctgcagcggcagaatggccccgggcagcgtgtgattcgggaggtgaacaccaccacccgggcctgtgccctctggggcctggctgaagacagtgactacacagtgcaggtcaggagcatcggccttcggggagagagtcccccagggccccgggtgcacttccgaactctcaagggttctgaccggctaccttcaaacagttcaagcccaggtgaggatctgtgctattggattctctggctgcttacctggcttgcagcctcttacttacttccccaagacaagcaacagactagctgagttgaataggatgatttaattcattgtactgccaggaaaggaaagaaaagcaggtgggaaggggattgggtatagacaggctggtattgagttgtttgggggaaggccttttaagcttcctgttacccaacttcacatcagctgcagcctgcatgagtgagtaattaacctgcagccatcccgctttttggtcgctaaccacctgtccaccaatggcttcctcccagggaggggctaccctacactccaagggcaacattatgatgggtccaccctttctaatccccagcatctccatcctgcatgtctgcagtatggaccccagtaacctggagtctgccttctggcttctcccttctcaggtgacatcacagtggaaggtctggatggagagcggccactgcagactggggaagtggtcatcattgtggtggtgttgctcatgtgggctggtgagtaagcagctagacaggggaccagggactcagtaaaggtgtgaggtggcaaaggttgtcaggagaaaaagaagtgagagatacagtggctcacgcctgtaatcccagcactttgggaggccaaggcaggcagatcacctgaggtcaggagtttgagaccagcctggccaacatggtgaaacccgtctctactaaaaatacaaaaattagcagagtgtggtggagggcgcctgtaaccccagctactcgggaggctgaggcagaagaattgcttgaactcaggaggtggaagttgcagtgagcgagccgagatcatgccactgcactccagcctgggcaacagaacgagactctgtctcaaaaaaaaaaaaaaaaaaaaaaagtaagagaaatagagtggagtggggagatacttagttcaggagggatgatttgaactttgaagagagggagaggaggctgttgagagcccagagaggaggactgcatgggcaccaggaattcaggatgttcttcatggattttctagaagctacgtaggtatctccctatgaggggggaagtggagatgaaggctcagactgtattgtgtttcagctgtaattgggctgttctgccgtcagtatgacatcatcaaggacaatgactccaacaacaatcccaaggagaagggaaaggggccggaacagagtcctcagggaaggccagtggggacaagacaggtgatgtgggggccagtgagggcggaaagggtgattctgcccctgaggggcagccagggaaaggaagaaggtcaaagaggggcagaaaaagatggagaatggaagatctgggatgggggaggctggagagaaagggtggcacctattaccttcctgaagttgagactcaggccattttctttcacagaaaaagtcaccatctatcaacaccatcgacgtttgagtgaagaaacacacccagaagagagactgcactaacaactggggatagggatggggtcagggggagcccaagatggtgatctgcccgagactcccagagggtaatgccactcccacaatctcaggcctggtacccatcctctttccactgtgagcagagccagaaggtaggtctgttcagagtctgtgcccctggacctggggagtggatatcagatgggatatctccttccattccccggtccaggggagagtcactagttgtacccgtactccattaggtcccaaatggggtgccccatttcacctgtatcaggactctgagcatccccagctgccccacatcttgcctgtggccctcagagaggggtgtttctgtgggtactcctcttaccccagcaaataaaaggaattgtctgaccctagaggcagatgctgcactgcactactccaatgtcttccatggagcctcaggtgctccccctctcacctggcagccccttcagctgctagtgatatcacttgttggacatttttccaataaaggttcttggacaaactgga

SEQ ID NO: 12091 - DNA, 265 bp, Homo sapiens
acgcctgtaatcccagcattttgggaggccaaggcgggcaaatcacctgaggtcgggagtttgagaccagcctgaccaacatggagaaaccctgtctctactaaaaatacaaaattggtcgggcgtggtggcacatgcctgtaatcccagctacttgggaggctgaggcaggagaatctcttgaacccgggaggcagaggttgcagtgagccaagatcgcgccattgcagtccagcctgggcaacaagagtgaaactctgtctca

SEQ ID NO: 12092 - DNA, 4239 bp, Homo sapiens
ctagggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaatggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataatgggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggttgctcagccttggcactagtgctgttctgaccattctctgtgttggggctgtcctgtgtatggtgggctccacccactagatgccagtggcaccccctcccagagatgacaaacgaaaatgtctctagacattgccaaatgtcccctgtgaacatcccctattgagacccactgctttagcgagagagggtttacttaggaagaattgggatagaaattcccagctgagagaacttagctgtggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagacctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattgggggggaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgcccttagtgataatctctcaattatgacattcatttgagtttagggtgtataatttttcct

SEQ ID NO: 12093 - DNA, 4239 bp, Homo sapiens
ctagggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgcccttagtgataatctctcaattatgacattcatttgagtttagggtgtataatttttcct

SEQ ID NO: 12094 - DNA, 168 bp, Homo sapiens
tttttttttttttttttttttttgagacagagccttgctctgtcgcccaggctggagtgcagtggcacaatctcggctcactgcaagctccgcctcccgggctcacgccattctcctgcctcagcctcccaagtagctgggactacaggcgcccgccaccatacccgg

SEQ ID NO: 12095 - DNA, 174 bp, Homo sapiens
tttccttttttttttttttttttttttttgagacagagccttgctctgtcgcccaggctggagtgcagtggcacaatctcggctcactgcaagctccgcttcccgggctcacgccattctcctgcctcagcctcccaagtagctgggactacaggcgcccgccaccatacccgg

SEQ ID NO: 12096 - DNA, 923 bp, Homo sapiens
ccccacaattttcccacctcagcctcccaagaagctgggagtacgggtgtgtgcaaccacacccaggtaagttttgttttttgtgtgtttttttttgcatagaagaagtctcactatattgccctagctggtctcgagctcccgagctctcaaactcctgccttgacttcccaaagcactgggattataggcatgagccaccacacccagcctctaaacactttgcatgtgtttcctaaaaacaaggaattatgtgggaacataaccacagtaagacgattaaaatcagaaaattcaccttcatacaatactattagctaacctcgcccggcctagccttgacatttttgaggagtcggttctgcagaatgtccctcagtttgggaacatctgttgcttttctcaggactagattcagtttgtgcatttgtggcaggaataccccggaagtgatgctgtgctattcttagtgcatcatagcaggagacctatgatgtcagtgtgttactggggatgttaattttgatcattggttgagatggtgtccaccagctgtcttcacagcaaagttagtattttctctttgtaaaataagtattatgtagccgggcacagtggcttaggcctgtaattccagcactttgggaggccaaggcgggcagatcacctgaggtcaggagttggagaccaccttggccaacatagtgaaaccccatctctactaaaaaatacaaaaattagcatggcgtggtggctggtgcctgtaatcccagtgactcaggaggccgaggtgggaaactcatttgaacccaggaggcagagcttgcagtgagcagagatcgcaccactgcactccagcctgggcgacagagcaagactctgtctcaaaataaataaataaataagaaaagaaaaaagaaatc

SEQ ID NO: 12097 - DNA, 151 bp, Homo sapiens
tcaggcgattctcctgcctcagcctcccgagtagctgggattacagttgcccaccaccacgcccagctaatttttgtatttttattagagacggggtttcaccatgttggccaggctggtctcaaactcctgacctcaggtgatccacctg

SEQ ID NO: 12098 - DNA, 2388 bp, Homo sapiens
ggacacctagcctggcttgccaggagaccggggtgggggcgcctccttccagggctgaaccggaagtggaggagagctgcaatggccttcccatgcccagaagctgcaggagcagacaatggggttggcaagctctgggtagggtacaggccgcacaggtctgagggcaagatgcaaatgtcactttcagtaccaagaaaaacgaggcaataatctagagtcctgggctgaacgtggacagctcccgaatcatcaggtgggtggggattaggacaaaatcgtgtatcctggggagatggagggaaacagaactgtgtattggtgtgctaatgtctcagtgcttggtacaaccctggcaactctgccaggccgtattcttgttttatgtacaaagaaaccgaggcaggctgcatgctcaaggtcatgggatgcaggcacgacaggttttctgaactcagaactgactcagatttgccagtcggtttggacttctcacccactctgaagatcacaaaagaaagaaaggtcaggaagctcttagtgcctggtgaatactggatggtaaatgctcacaggtctggaagggaggaagggttccccccaaacggtgggtctggtctgttccgggcttcacaggagaccaagcagagaataagacagtgcggacgggatggagggctcaggggtcttccctgcagaggttcctgggggcgtggcagggctgtggctgacagggtgcttcctacggttttttccaggcccagaggctattggccaaaggcagaccccgccggtccttctttgaatccttcatccggaccctcatcatcacgtgtgtggccctggctgtggtcctgtcctcggtctccatttgtgatgggcactggctcctggctgaggaccgactcttcgggctctggcacttctgcaccaccaccaaccagacgatctgcttcagagacctgggccaggcccatgtgcccgggctggccgtgggcatgggcctggtacgcagcgtgggcgccttggccgtggtggccgccatttttggcctggagttcctcatggtgtcccagttgtgcgaggacaaacactcacagtgcaagtgggtcatgggttccatcctcctcctggtgtctttcgtcctctcctccggcgggctcctgggttttgtgatcctcctcaggaaccaagtcacactcatcggcttcaccctaatgttttggtgcgaattcactgcctccttcctcctcttcctgaacgccatcagcggccttcacatcaacagcatcacccatccctgggaatgaccgtggaaattttaggcccctccagggacatcagattccacaagaaaatatggtcaaaatgggacttttccagcatgtggcctctggtggggctgggttggacaagggccttgaaacggctgcctgtttgccgataacttgtgggtggtcagccagaaaatgcccgggggcctctgcacctggtctgcaggccagaggccaggagggtgcctcagtgccaccaactgcacaggcttagccagatgttgattttagaggaagaaaaaaacattttaaaactccttcttgaattttcttccctggactggaatacagttggaagcacaggggtaactggtacctgagctagctgcacagccaaggatagttcatgcctgtttcattgacacgtgctgggataggggctgcagaatccctggggctcccagggttgttaagaatggatcattcttccagctaagggtccaatcagtgcctaggactttcttccaccagctcaaagggccttcgtatgtatgtccctggcttcagctttggtcatgccaaagaggcagagttcaggattccctcagaatgccctgcacacagtaggtttccaaaccatttgactcggtttgcctccctgcccgttgtttaaaccttacaaaccctggataaccccatcttctagcagctggctgtgcctctgggagctctgcctatcagaaccctaccttaaggtgggtttccttccgagaagagttcttgagcaagctctcccaggagggcccacctgactgctaatacacagccctccccaaggcccgtgtgtgcatgtgtctgtcttttgtgagggttagacagcctcagggcaccatttttaatcccagaacacatttcaaagagcacgtatctagacctgctggactctgcagggggtgagggggaacagcgagagcttgggtaatgattaacacccatgctggggatgcatggaggtgaagggggccaggaaccagtggagatttccatccttgccagcacgtctgtacttctgttcattaaagtgctccctttctagtcctttttctgcccagaa

SEQ ID NO: 12099 - DNA, 1759 bp, Homo sapiens
ttgaatctcatcccaggcaccatttatttccctgtccctttctgggacccctgaacttctcttcccagaagagcaaacgaaccaaatcccaggcccttgtcctgccccacagtgcctcacatcccttcggaagagtccaaggcctggggaggggcatcttcagctgaaggaggacacagggtgtctgctgggaagactggctgtcccacagcagtgcccagccttcgcaggacctctcttggtctctgtccgtgggtgaccctgctccagcctctcagatgatgctggtcctgcaggtgccctggctctgctccaagtggctggccttggtgctgttgctgaaggaggccacggggtgcagtgggaactcacggaggtgccattgctgccacttcttctgaacctccagctgcacctgcccgggagaccagccatcagcccaggaggagaggacagttctgtgcctggagccctgctcactcccccagtgactccacgcaggccctgccactcctgcccagctgccctgtcccctagcctgcaggccacgcagattgactgtttccagccccaatgtccagtagctactgagggtcccctctctcctgggcacatgcacctgcaatctcattacatcgtgtcttaaagaaaggacttgtgcaccttgggacaagtgtgtgcccttgacattacaagagcagtggtggggaaagctagctccctggcccccaggctgagaggaaaagaatcccggattaagccagaggctgagttctctgaaggtctggggcactgacaggggctactgggcagagggccagcttagaggagggtgtggtctgaaggtgtgggtagggcaaggcctgactccactcagtgatgggtccccagtgattttaagtgatttaagatgggtccccacttattcccaggaagccacccaagctcagaactgatctgggaactagggagtttctctttgtaaatttccttcacaattcccagctgcagcagctgaacctttgaagctaggcttgatatttgatttttgggaaacatcaaagatcactcccattcaagtgcaacaaaccagatagatggtcagtagtcacagaaagccttagctcatgttaaccacatagctctgtatgccagagcctggggtcctgacccagatgctccatgtgaggctcgagtcctcaaagtgagtgtgcagtctcccaaggagtcagtgctcatctggaggtccctaaggattgagctgcagacagttctgagtcacccgtttcacatatgggcagactgaggcccagaacagggcagtgactgagatcgcccattaagcaagcagcagggcagtcaggaacctgggttctgcccaactttcctcctgcatttgctgaacagatcaacatcggcaccaggaatgcttgttaaaaaacactttctcagaccccagtccagacctacagaatttatttctgtggaatgagaaactaggaacagggtccagccatggtttgaacaagccttgctcccattaagcaaattcagactcctaaaagaactggccaagccacctgccaccagacccaggactccctctgaccctttccatcccccttcctaccacccctcccaggtagctccttctgacccggaaaccaatggctaggagctctcctgggtacctgggtgacccaagactactcacctccccattgaggaagcagtagaggacggccaccaccagtccctg

SEQ ID NO: 12100 - DNA, 21860 bp, Homo sapiens
ctgtttatgaaacacaacatgctgatctttaaaaagttatgttctaccccgaagtgatttgagcgacttatattgatcatacaagtcattttgtattttcagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacaggtgataattaactttgatatttaaatgtttacatatctgtaaagtaacagcagttgaactgtgcgatcttcgtgcttaactctgttttgggaattattttttcttttagtttatgtttatctctcctctcttctctgatggagtctcactctgttgcccaggctggagtgcagtggcgcaatcttggctcactacaacctccacctccctagtagctgggattacaggcatctgccaccacacccggctaatttttgtatttttagtagagatggggtttctccatattgatcaggctggttttgaactcctgacctcaggtgatccacccaccttggcctcccagagtgctgggattacacgtgtgaaccactgcacccagcctagtttcattatttttagagtttgttctgtgttgttggaatttatggaagcctcatttttaatgaataacttaattcaattaagtaaatcttcccatggttaacttgcttatttagcaaactttttctttggattctttgttgcaagatttgaatagtcctttactttttggaagactaaatggactctcttctgactctacgatagatattctttaccagcttggaacaactcaggatcctggtacaaaagacaggtacgattttatttttcatttaattaagcacacacatgcacataatcatgctatagtaaatgtttctgacagtttttccttagatgatctcataaaagacaatactgtgatatattgtatgtttaccatatgcctcacacgatgtaacttctgcaagtattcatgaacattagacatacatttgtatgtgtttggacatactttaagcaaatttgaacttaaatagaattctttgttaatactgcttttgaggaatggaataaaacatatatttttaagttggctacgtgtgaaaggaaccttgtaaagtgatggtatcagagtcatactgtcttaggtagtactttatatgtgtatatgaatgtagggatattgtgtctgtagttggtacttcaactgtttttataatggttctgtttatttattattgattatcgtattcatcgaaatcttttcatgactttctgcaccctttcctgctgtttacagaatgaaacaatatcataacatgtaaatgacatttgaacacattggctaaatatttagtgatttttttcttttcttttctttttttttttttttttttttttttttacatttaggtaattttaatgagttgtcctaatgtcattctaccttgatgtcttctacttccaaattgataccaacttgaatttttgtttgttttgttttgagatggagtcttgctctgttgcccaggctggagcgcagtggtgcaatcttggctcactgcaagctccaccttctgggttcatgccattcttctgcctcagcctcctgagtagctgggtctacaggcgaccaccactataactgactaatttttttttttttttttttttttttttgtatttttagtagagacggggctttaccgtgttagtcaggatggtctcaatctcctgacctcatgatccgcccacctcaggcctcccaagtgctgggattacaggcatgagccaccgcacccggccaacttgaagtagttttgaaacatatttttgttgataaatttttgagcaaatatttggcattctctgtttttatgtgtagcatccatattagaaaaacagagagatttcttcctgatttatgttactttttaatattttgattaattatgtttaaaatgaagtcatttgatgttttattaatatctttataaattattaaaattatggattacatttaaacatagattgcaattgtttttgatgaagtgaataacaatttgtgccaaatttgaatcataatcgttagtagtggttaaaatatatttaaaatatcagtgttaaatatttttccagaacaggttgcttgaaatctgttaggattatttaatttttaaatattgttgtggctttttaataagaagaaaattaagcttaattcattttctctgcatagtactttttaaaacatgaatgtttgttatataaaactgacattaatgacaaggttgttagactgagaaaaatgtcttccttgtcttctgaattctctttattccccatcatgtgaaattgaaagtcttatctttcagaattagtattatataccttcctatccctgtttcttttagtgtgaagccaagaatcttatattctgaaatagaaattgaaggaaaataaacaaaatgtaaacacagtgttttaagaacttgagaaatctaaaagtctttcgctcccaggttgtggttcaaaattgggtgtgttttactggttcccaactccaggagattgggattagtggggttagttgacctataatcttgttattaatgttagttctaaatgacagatacctgtatttttaaaagtactatgcagagaaaataaattaagcttaatttccatcttataaaaattatacttaaaaaaaatatgtaagtgttgagagtgtattctgttgtcagaatgaatgagtgtgggtggctattactagtatttaatgctagggtccagggatgtgaaacgtgctgtatttcatgagactttgcacaatgaagaattagtcccagatcactgttctagtatgttatctcaaaccttttgatggttgaaattggtaaggttattggaaaattggaactggaactagtatgtctttgttgccgagagatttcctttttttcctattttagattaaaataatcaaaaacaattagtgcattattctcataaataccctactcaccatgcagagatggtatttatctatatgaaatgccaattgcactatatagttggttatatgaattcgttttcttcgtttaagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagtaagtatgatttgtgaaatcttttttatcccccagtactagatcagttagtgttcacttgataaaacaaaatattttacatgtttattaggagaaacataatattttgaaagtagcaaatataatcaagtatacttttgaaatgaattgtcaaatattaatttatctttgtgttttaagaagatatgttagcagtactgccttcttttttttaacctaaaattatgcttaatgtagatgttgctgtggttcatagtgtttattctcagttgcaaattttcccaccagattatctttaatgtacaactctggcaggatagtacagctagacaactttgggggtgggcatggtggctcacacctgtaatcccagcactttggaggccgaggtgggaagatcgcttgagtcaggagttcaagaccagcttgggcaacatgcaaaacgttgtctgtacaaaaatgcagaagtcagaaagctgggcacagtggctcatgcctgtaatcccagcactttgggaggccgaggtgggcagatcacgaggtcaggagttcgagaccagcctggccaacatggtgaaaccccgtctctactaaaaatagaaaaactagcccggcgtggtggcgcgtgtctgtaatcccagttacttgggaggctgaggcaggaggatcacttgaacctgggaggtggaggttgcagtgtgctaagattgcaccattgaactcaagcctgggcgacaagagcaagactctgtctcaaaaaaaaaaagtcagccggacacggtggtatgcacctgtcgttccagctacttgggaggctgaggcgcaagaattgtttgagtctgcagaagttcgccatgctgcctcacgccactgtaccccagcctgggcaacagagcgagactctgtctcaaaaaaaataactttggggagctgagatgggaggatcacttgaaacgaggcgtttaatgccagactggctaaaatagagagaccaaatctctacaaaaaaattaaaaattagccaggcatggtggcatgttcctctatccctaactacttgggacgctgaggtgggaggatcacttgaacccaggagttagagcccacactgacctatgatgatggcaccactggcactgcagccagggcaacagagcaagacgtcatctcaaaaaagaacaaaaatgtaaagctagaaaatttgagacttttctagattgtccttttgacaagtagtttttatttacccacatttcttcaccatatttagctaagtctttgctgaacttactgatagctaactattaagtctgcagcagaatacatttttgaagagttcctgtaacacataaaaagtaggcctattgttctctggtaggtcatcatatttggccttagcgattggcataatccatgacttaattactgagcctcactggtagttttttatttgcaaacatgaatttaagccatttgtcatgtggaatttaacgtaaacatttgtttggcatgatttttttgtttgtttgtttctctacatgaccttttcaggtcacacagaatgatagaaccattttaaaataatttacttgattttctgtactcattgacaagtctaactcaacttgcattgtacctacattcttcaattttaaatatatatatgtgtgtctatatatatatatatgcagtcttaaatcttacaatgttttattattcaatgtcaaataaagtatataatgtcagagtatactttgaactataacagaaatatttgaaatagtttcttctaaaaatatacttgtatcattaatatgatatcttttattttttaggttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggtaagacaaaaaaataacttacattttagttgttttattacataagaaagggccatgtataaaggccaggtaataataaatttagtgagggttgagtgcctttaaggatctgaatttaagctataaagtactgatatctcctttctccccctcaaaatatgctgtcactggaatcacttattctttatgatgagatgactagcagatgcattgggatgctagctagatcatacaacccttattttcaaaaatttctacaaacaaaaagaaaaagcccaaaaaaacatttcagctgctggaacagtatggacactgatcactgagtactgtatgtgccttgaggcattgtgtttttgtgtaacgagattgccatactgatagtttgcttctctttacatgggcattagattaggtttcagataggagactccacataaatcacatacaaaatgtggaagataggctggttgtggtggctcatgcctgtaatcccagcactttgggaggctgaggcgggcagattgcctgaggtcaggagttcaagaccagtctggccaacatggtgaaaccccatctctcctaaaaatacaaaaaaattagccgagtgtggtggcatgtgcctggaatcccagctactcgggaggctgaggcaggggaattgcttgaatcagagaggtggaggttgcagtgagctgaaatcttactactgcactccagcctgggcgacaaagcgagactctgtctcaaaaaaaaaaaaaaaaaatgtggaagataatttatcatactgcactccagtctgggtgacagagtgagactccatctcaaaaaaaaaaaaagtggaagataatttatcatatattatgattatcataataagctgggtgtggtggattgtcatatattatgataatcataatttattatttatcataataaattaaatcctgaaaggtagaattatttcaagagtaattctagttggctttttgccaaattttgcttttggttacctcacgtgaccttgggcatattggttaatcttataacatggggctagcaatacctgcctcaaggattttttgagacagttaaatattttaatttgtgtaacatacctagcatagagcctatatgagatatggtagacactagtaaataacttttctccttgttatttaatagtgctcattcaagtcaaactttagtagtacctagaaaaatagataatataatttttataaaatattgaaggagttagttttattaagaagaagggcaggtcgggtgctgtggcttatacctataatcccagctctttgggaagccaaggcgggtggaacacttgagcttagaagtttgaggccagttttgacaacatggcaaaacctcctgtctaccaaaaaaagaaatcataaccaaaattagccgggcatggtgatacgtgcctttggtctcagctactcaggaggcttgaggtgggaggatcacttgagcctaggaggttgaggctgtagtgagctgagatcacaccactgccctccatcctgggcgacagagcgagaccctgtctcaacaaaaacctaaacaaaacagaggaagaagagaaagatatttaactgcctgtagtaattaattactgggaaaatatctctgctaaatatgcattaaaaggaaatgcttaaattaccaacttcacccgagggcatgattctaggtatttgaaaatttggtttgtgcttctgggtagcatgaactctttgtgtcccattgatttctctcttggtttcttagtaaggctttatatacattttgggggtgaggtggggcaggatctctctctgttgcccaggcctgtagtgcagttgcacaatcagtgagccgtggctcactgaaactttcgggctcaagaagtcctgcctcagcctcccaagtagctgggactactggcacatgccaccatgcccagcttatttttttttggttgggggagtgggtagagacaggtttcaccacgttgcctaggctggtctggaattcctgggctcaaatgatctcttctcttagtttcccaaagttctgagattatcagcatgaccttggccttgttatatatttttaatatgctttttctcataatttttattttaagataaccacaccaatattgactaaagttaacgggagttcgttatgctaggtattcattatgtgcaaaccgtttagtactaattttttctaaccctggacacgtttcttacacttttatctcctttggtattcatatattttaagataaaatcatttctttcctccttaaaaaaaaaaaacttaactactagacccccagagacatttgttctttagctactgatttgatatgttaaaataaacttattcatattttctgtttcctttttatctttcaaaataaaaagctgcatataaatcttgcatttaactttttaaatattttgtcttgccaggttctttgtgaactatttcagacatctcctcaaagagggaaccttccaacatctgggaacatttcagggtttatacgaagattatttttacagttgatgctggaagatgagaaagtgacaatgtttcttcagtctccatgtccagtgagtatttaacacttaatcattggctgtgtatacatgtattttacaattttgtatcagagcctgcagttacctcctatgttctaacttcgagtatagcaaagtgaaactagcacagcctttatacctaatgacagaacttgacaatttcaggatagcgctctccctcatgcctaggaataacataattttaccttagcctgagaagtatagtttgatttgtggaaaaaaatgaaaaaaggtacagagtgataatgcaaaagttgaccaacaaatcatggcaactatgccatatctaaattaattatatcttgtaggatttattgagtattttattcttagatgcttttgagattattttataacaatatgtattccaaaaagttacttcctgatttctttgatttcttgattttcagctgtacaaaggtagaattaatgctactagccacgtcatccagcatccaatgtatggagcaggccacaaattccgtactcttcatttgccagtctcaacaacattatcagatgttcttgacagagtgtcaggcaagtcagatttaagtattagtttttgtttaactttatgtttgatgtatatggaggtttattgtttttataactttattttctgcatccactttgcaaccattgatgactaggaaagttcaagacatctttatagtttgaagcataagaagccagtcaagtggacaaaatgtaaaatacttttaggcacccctaattttttggtttattgtgtcacagtgagaaatgggcagctagaaatacagacaaataattgatggcatgttctcacaataaaccatctggtcattttatactagattaattgcaggatatttggttgaatagcaagattctaattaatacacatttactaaattgaaggtggtgatcagtgatcaagacataaatggagtaggtagaattgactggtcacctcattgtttatcgtagtcagtgaagaaagcagacagaacattttcccctaggttcttgcctgtattttataggatgatacctttaaacaacatatgggatagttttttaaaaagcagtttttgatggcaaaggcatatcaactttttattttatttatttatttaattttgagaggggggtctcactctgtcacccaggctgaagtgcagtggaacgatcttggctcaccacaacctgtgcctcccatgttcaagcaattctcctgcctcagcctcctgagtagctggcattacaggcatgtgccaccatgcccagctaattttttcatttgtttagtagagactgattttcaccatgttggccaggctggtctcgaactcctgacctcaagtgatccgcccacctcggcctcccaaattgctgggattacaggtgtgagctaccgcgcctggcccatatcaactttagatagttggagtgtattgccactgtgaaattctggttaatcagtgagtgaacttgctgagcatctgcaaagtgcaatcactataatttgtcctaagattataaacatgagcaagacacacattccacctcacaagatagttgtgatcttatgtctgttgtcaacttctaaaataaactagaaatgtctgtttgcattataacatgaatataagtagatatatttctatctgtatacataagaagggacctaagtttttaatggaagctgtgaactgaagcaagaataggagtatctaagaaaaaagttggaaatgtctatcagttaaaaatacaaatctaaagcccagagtaaaagagagagttaaagagatttgggagttgttaccacacatagatggtaagtgaaaccatgtgaatggatataatcattataggtaggaaagattgttttctgcttcacaatcgctgtgtctaatatgcatgtgcataaaatcgtaattctttcctaccgttttacaacttatacaataggttgttagcatactgttataaatattaaaaaaaatttatttgaaaatgactgccttatctgttacagagaaacttttttgaaaatttgatgttagacagtattttctatcagtttcctgaaattgtccattctacatgatgaagaaaaatgaaaattaaaaagtaaataaatgggccaggcttgttggctcacacctgtaatcccagcactttgcgaggccaaggcaggtggatcacctcaggtcaggagtttcagaccagccctgccaagatggggaaacacatgtctactaaaaatacaaaaattagttgggtatgatagcgtgcacctgtagtcccacctatctgggggactgaggtaggaaaatcacttgaaccctagaggtggaggttacggtgagccgagattgcgccactgcactccagcctggacgacagagcgagactctctcaaaacacatacaaacaaaattaaataaatgaagaaagtggggaggagcactgaagctcagttattgatattgatatttcatatgtttaacttgaagtgcaaaagtagacattctaatacaaaataactgaaaattgaacattttaattagtctttactgtggaagaatgctattctaaaacattctagcattcaaaatattttacaaaatagttttctgtattgcataaaaataaaagctaatcgctttggaagtacacgacctcaaaagttatatgtgctgaatgtaacctacttagcgattttttttggttctttaaagtggatttatactctttagccatattttctgatatatttacttgtacgtttatattagatcaacatgtataagaataagtaattcagaagtattgcctcagtaaatttacctgctatctgtagcttttgacagtatactttctttttttttgtttgagatggagtctttctctgcattacttgagcccatgagttccagaccacctgggcaacatagcaagacctcatctcaaaaaaaaaaaaaaaaaaaaaaaaaaaagcaaagacaacaagagaatattaaaactggccaaaaaggaagtgacctattattttttctctctctctgttttttttgttttttgttttttgttttgagacggagtctcactctgtcccccaggctgtgcagtggcgcgatctcggctcactgcaacctctgcctcccaggttcaagcaattctcctgcctcagtctgcagagtagctgggattataggcacgcgccaccacactcggctaatttttgtattttttttttttttttagtagagatggggttttgtcatattggccatgctgatgtcgaactcctgacctcaagtgatctgccttcctcggcctcccaaagtgctgagataacaggcatgagccaccacatcaggccgacaatattactttcaaataataacctttatgtgtcagtctgtttgcttttacaaatttctgtcactggttttaagcagtatgatgattgtgtgccttacaattttttcttcacatttcttatgattagagtttgtcgagtttcttgaatctgtgtgttttagatttcactaaatttcgaaatattttggcaattatttcttcaataattgcctcccctttttttataattacagttacttattaggctgtatgaagttgtttgacaccccaaatctgtgtttcctcttttcccccccatcattttttttctctatttttaaattttggataatttcctgtgtctgatctgttagacgttttatatctccttgtccttacttaaagtgtataggttttcttcagctttcttgaacatagtagtctgtttgtactatttttctcttccttatggattgtatgttctcgcttctttatttgcctggagaattttcttggatgccagacaatgtaaattttactttttggggtgctgaatattttgtattctaatatatatattttattttttcatgaaatataatgatattatttgaaaacagtttgttgcttttagacttgcttttaatctttgtaagtaggatcagagcagcttttaatctaaggcaagacttactgtaattattggtaatttttataaaccaatgttgtctagtttggtaactgttaagcacatgaaatgagactaagaaactaaatttttagattgaatttttaattttaatgaattttacctttaaatatgtacctcattagaatagaattaaggtaccaggtttgaaaatgcagttctaaatcccatttgaccccactattaaggctctgtccttatgagtactctgttaggaattcactagatgtctaagagcacaaagcattttattccctgaaaccctggggttgcttgccctgctacttttcgatagtacctttcctggccttcagtggtttgctcacataggttcgtcagtacatgttgaagtcttgaagaccctgtatagatctctggagatccagggatctccagatctctagatgcaaatctgcatagatgcaaatattttcttcctggatttccggctcttacatcctcagtctagggtgacaactaggttgtgctgagctgtggcctaggaattcttttccagacagctcacacaatcctaggggtcacctcattggtttccacttacccaggcatcactgccctgccctgcctgatactcagtgtctgaaaagtattgttaatatatatttctagttaaggttatttcacgtgggagatgaacctgatccttataattccagaagtggaattctaaaacagagcagctttttgcatacgttcaagtacagagaaaaaaataaaacagaaatttgtattaaaaaataaaaaagtaaattaatattagaaaccagagcatttttaaaaggaagttgagaaatttttttttagtgtttgaatggcatttattctttatatttacttttgaaataagggtaataaatgaaaattggctaaacttctaattgcactaagtaaattattacctaatattctttgtgtgcttttcttacctgattatgctatgaattaattttgtgaatttcttattatttaaatgtttcactctgacctgtgtcagtatgtttgccatttttagttgcttggttgtttttgttagaaagtaaaatgtattgttgcaccatgcatttgttatgtgtataaaattttttacttcacaaaactgtctataggcaattagcaattagtattaagaagttgtataaattgaaatcactttcatatactaaaaactgtaaaatgagagttattacaaaagatgttgtttattgttttattgtctcaacctttttaacataaaagaccgggtcataattgtgctaaattagggaagtaaaaagagaattgagctagatgcagtggctcatgcctggaatcctagcactttagtaggctgaggcaggcagatggcttgagcccaggattttgacaacagtctgcacaacatggcgaaacctcgtctctcctaaaaatacagaaattcatggcatgtgcctgtggtctcagttacttgtgaggctgaggtgagatgatcacttgagcctgggatgttgaggctgcagtgaaccgcgattacaccactgcactccagcctgggcaacacagcgagaccttatcttaaaaaaaaaaaaaagagaattggagacttgataacagttatatagtgaaaaaaattaaaatttcaaatcaattcattcagcctttaaatttcttaataactaaatcacattatatgatcacccatttattttataatttttagtggtgtgctgtatgccacagtaatgaaaggaatattcagagtaataactatctatgagagcccttaatactcattttttaaagtaaaacacattaaattttaaaacatattactttgttgtctaagattcctgtttttgtcctaaataaaaattaacagaacaggaaatctgttacagaaatttgttcttttatactttcatttgtaatataagcagaagtctagtttaatgctatagactgaatcttgagcttgagtcccatatttgccatatacagattatatcagtagcctttctaaggctgtttcttcattttgaaaataacattcatttctatgttgcgaggactgaattagatgcagttgccaagcacattgaactatggctaaaataaagcaagttttcatgctactggtttttcattgtttctggaggtggtaccattaaaatactgtatataatactttacagagattagatcttaaatattctggcttaagtacagtggtgagtcttcctcatcaatgtcagtaaagattgggtatcaggcctttacctcatgccatttctcctaaattcctttatattgccttagtattaaggataatattatcttgcataatctccctctgaaacatatattacttctcttcttaatgatttggaaaagcagtgtattttagataatatcttcttacagatactccaagtatcacagctaaattaattagtgaacaaaaagatgacaaagaaaagaaaaaccatgaagagaaagaaaaagttaaagcggaaaatggatttcaagacaattacagtgttgttgttgcctctggtatgctttctattttttataatcttgattttgtttgggtttctataaaatattagaattttagttacaggaaatttatgtaatacattgtactaatataaaaagctgactcgtaatgatgttttaatactagatttttatctttttatttttattttttttcactttccactaaataggttgtcatctgtatttcagagattatagcagctagctacagtttttactttttaggaaaatagttacagatgcaatgccaaaattatttatttgttgtcatgaaggacgaatagaattgggagattagatattggattagaaggaacatttctgttttctgacattagctaggaatgcatgccttattaaaatattttaggaacactgttttccttcatattagtgtgttgactatgtagaatcttactgatccttttcttttagggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggtaatattcctcaatgaataaacgtcaaagaaattttagtagccttaaaactatgtaaatcagaggcacagtcaccaaaatcattttaatcaggtgccattgatgagatcagtgagttagtgagacttcttccatacagttcctccgaagagaagtgagagcaaaggaggagtaatctattacgtatcctttttaacactatcaagttatttatttctactttactggttttctaagtttttctgtcagtgtgccatgaaatgattgatgaaatagacatttagagagttcatgacaagttatttaggaaacaccgtggggcaaatttgtaggactagttcaagcagtagaactcttagaccactggtagttaagccatatgttcttcccagataaaacacatttattgagcaccatcctgtctgttgttcaaggtgataacaggttgagcatccctaatccaaaaattcagtatctgatactttttgagtgctggcatgacacaagtggaaaattccacatccgacctcatatgacggttacagtctaaacacaggcacacaacacagttttttcagtgtccacaagaggaaaaagatcttccagcccccttcagatattttttgagcatgcccgattcctccctacatatccacagtgggtaacaaaactgcaaatgtgcatgccagacgtgccaacagcaggtttcccacgatgccccacatgatgccaagatgtgtgtgcattactgtgtttttttgctctgtggtgttggaaatttaaaaaaggccccagatacccttatgggtaacaatgataaaaagaggaagtatttatgtttatctgtagcacagaaaaacaagctgttggagaaactggacagcaatgtaagtgtgaaatgtctttcaagagagtatggtgttggagtgaccaccatacatgacctgaacaaacagaaagataaaccattgatgttctgtgctgcaagtggtgaatagaggttaatgaaaaatagaaaaagcactccatgaagctaaaaatgaagatattgattgtgtattgaaacagtgaatccatcagtgttggcagtgaacacgtgcctcttaatggtatgctgatcatgaaacaagtaacgatctatcatgatgaactgaatgttgaaaggagctgtgaatattcaacacactggttgcagaagtttaagagaagatacgacattacatttttaaagatttgtggtgataaagcatctgatgatcaggaagcaatggagaagttcattgataaatttgccaaagtcatggctgatgaaaatctgccagaacagtttataatgctgatgaaatatatccctgttctggtgttattgtctcaaaaagacactgggctacagttgatgggacagcccctccaggaattaaggataccaaggacagaataactgtcctgggatgtgctaatgcaactggcatacataagtacaaacatgctctgataggcaaaacctttcacacttgttgttttcaaggagtgaatttcttaccagtccatggttactctgacacaaaagtatggatcaccacagacatcttttctgattggtttcataaacactttgtaccagtggcttgtatgtactgcccataagctagactggatgatgtaggagtttgttattccttgatatcacccaattcatcctccagctaaaattctcaaaactaatgtttatgccatgtactttccctcagatgtgacttcattaattcagccatgtgaccagggtatctttagatcaatgaacagaaaatataaatccactttcttgaacagcatgctggcagcagtgaacagaggcatgggtgcagaaaattttcaaaaggagtttagtataaagaatgccatatatgttgttgccaatacttggaacacagtgacaaagacacagttgtgcatgtctggcacaacctctggcctgcaactgtgtttagtgataatgatgaactgtgtgtgtgtgactttgaaggattctgtatgtcaagtgaaaaaaaatgatgtctgacctccttacatatgtaaaaaatataccttcagagttcagcagtaagctggaagaagtagatgtcaaagaagttttgaactttgataataatgcttcagttattcattcattgactggtggtaaaatagtcgaaatggttttgaatcagggttatgatagtgatgaagaaggtcaagataacaccacagaaaaggtgcttatagaagaagacatggtgaaaatgtatggtgggcatattgaaggattacggcagcgtgcattaacaacagaatgaaaaaccatgtcagtttttaaaattgaagagagacttctgagctaaaaaccatgttaatgaggcagatgactccacaagaaccatttttaaaagccttccagcagaatgtctcttcatcccccgtaggatccacttcctggtccctcagctgcttctgatgtttcttcttaactaaaaaacacagtttatagtaacctttgaataaaaacacagcatcataggtgaagactgaaagcctgctgttgtttgtagctgctttttcctttttttttttttgagacgtagtttcactcttgttgcccaggctggagtgcaatggcgtgatctcggctcactgcaacctccgcctcctgggttcaagcagttctcctgcctcagcctcccgagtagctgggattacaggcgaccaccaccacgcctggctaatttttgtatatttgatagagacggggtttcaccatgttgaccaggctggtcttgatcttctggccttaggtgatccacttgccttggcctcccaaagtgctgggattgcaggcatgagccactacccccggctctgtggttggttttgtttaatagctgaaacaggtatcctggtgatgctactatgctgcttagttgtcctgacacattattttttcagtgttaatggtatgtcatatttttactgttaagtacttaatgtatgaataaatgtaagaaaacaattgcctattgttagcatgtagattaagagtcaggaatgatgactcttgttgacatgggtggctgagatagtgacacctttgctttctgatggttcagggtacacaaactttattacaggcacaaaattatcaaaaatacggtataaaattaccttaaggctatgtatataagggatgtgtgtatgtgtgtatacacacaaaaataaattttgtgtttccacttggatcccctccctaagataactcattgtgtacatgcaaatattagaaaatgcaaaaaaaagaaaaaaaaagaaatctgaaacagttctagtctcaagcattttggatgagggatacccatcctctattttatcaccattttcatgctgtattaaaatgaaattgccaactcagttcaaaggaatttttcttcttagctttacattgttgattcatggtggaggcgaacaaactatcgactggtgggttggataccttggtccagagaggtccttgtgacatatctcatggcccattacctaggtgatgtgagtcttgccttctgcctgcaataaagttttgttggaatgcagctatgcccatttactagtgtattgtccatagctgcttctctgctacaatgtagattagcagttgtaacagagactatatggcccccccaggttaaagtatttattagctgtccttttatagaaaaaaatgtcccacatcagatttatggaaatgtctgttcctttgtttacgttttgcccatgactttttaacactttcacagacattattgttcattattatatgtcagaaataaactcactttttgtaaactttccaatggctgttgaattttttaattgttttgaaattggtttcagaatcaaactcttgcctgtaatttagtaaaagcagataataattaaaccaagtaaatgtttctttctcggtttccagatttaacttagttatatcattttaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaaggtatgtgcataatactactttaaaaattacagactgtcatacaaagaggcagagatttctatagctaatgacttaattgacttgtgtttttattatatcaacataagatataatttttttatgactgaatttttgtaaatataaaaaatggccattatttcatttggaaactaagttgcattatttcttataacatcatttgttttatgagcgcatgtactttaatttctgatatttctgtgagagctatgtgaattgtcattttataataaaagtgagaaactcaacttacaactttgttataatttatattgagtggcatttcttgcatataaacatgttttctcatataattgggatcacatatttttgttttttacttatatattccattaattttttttgagacagagtctttttctgtctcccaggtcggagtgcagaggcacgatcttagttcactgcaacctccgcctcccgagttcaagtgattttcctgcctcagcctcccgagaagctgggattactggcacccaccaccatgcctggctaatttttgtattttttgtagagagaaggtttcaccatgttggccaagctactctgtaactcctgacctcaacttatctgcccgcttcggcctcacaaagtgctgggatataggcatgagccaccgcacccggcccttatattccattaaatatttttgaatatccatttttgaattggctattttttcataaaaatgtaagaaaatttatttgttccccaatcatcgaaacattgtggttgtttccaatttttactcctataaatgctatataagtagttttcatagtgtgagtatgatatgaacttacttaaactttccatctttctcatgactaaaattcagtctttagttattggtcttttgtattcttcagcaaattttggtacattgtctttgcccagtttttcagcacgattatttctctcttttgttttaatgtttaaagggtctggttacgtgaccttttggttttctttggtgagtaattcagagttaaactaatatggtataattttttgttttaagtaagggaagtctttgtcattaatttttcttaataggatactttagagcatattatttgctatgagaactttgagaacttatttattttaacataggatatacgttaaagtatgccctaaaggacagtgcttctcaaacttcagtatgcttacaaatgaccagcatcatactgttaaaatggagattcttcatttcaaactagcttgcaggtgatgccaatactactagtccatgaaccattcttccaataacaagactaaagaaggcagtatcagaagtcatttaaaggtcattgtaccgtctagccataatacagctatatctaaataaatgatgttttgtgctcttttttgagtagcaagaaagcagtaatacctgcttttgtaaatgaaagaatattataaaaatataccctttcttacctattcagttatttgtaatttattgtctagatcatggagacttacttgctagctgtccagaagatgaggctctcactccaggtgatgaatgcatggatgggatactggatgaatctttgcttgaaacctgtccaattcagtcaccattacaagtttttgcaggaatgggtg

SEQ ID NO: 12101 - DNA, 428 bp, Homo sapiens
atctagtagtaatagaataattggtagataaacaagttttattacatttttccccaaattatttaaaatagtaaaccatagcatattaatcaaaggtagttttgtattatttgtgataattttgagtaaaatagaaatgatgacataattacctatttggctggttttattcatagggagcatcaggtacatgtgcatcacacatctttggttcctctttttttaggtgaatattagactgtttaagtataatttttattgtagatcaaatattttgtgttgaaaaatagctccaacattaattatggtgaaagtcattgtcaaactatattttgttgtataagttttccttttacaagttcatgatgaatacaactgtgaaagctgctattttactgggattttaataaactgttcaatctagtata

SEQ ID NO: 12102 - DNA, 1592 bp, Homo sapiens
tgtggttcactatattgattagtaactggaaatggggtcctggtaatacatacctaagaatgtgaaagtgactttagaattgggtacttggcagagtatggaataattttgagtagcatgatttaaaaaaaaaatctagattaccttgaatagattgttagataaaatgtggatgataaagcttctgccagtgagggcccagaaggaagtaaggatcataggggagaaaacctacagtgtcttagagaatatctgaattgtcataagcagacttggtagacatacaggtgtttaaagtgctgacaaggtggtttagaaggaaatgaggaacatgttaccggaacctgaaggaaaagggatctttgtcatatagaagcagaactattaactcatttgtgtcctaaatatagaaagcagcacttctgctgtaatgaacttggatgtaatgaacttacatgtaatgaacatgtaatgaacttggatgtttagctgagatttccacacaaagtggtgaaagtacaacctgtctttttcttgctgcttatagtgaaatgtgcgaggaaagatataaattgagagaagaactgttgaaaaacaagcaatcagtgcttgtcaatttgtgaaattacctatccagatcacagaaggtgctaaaatttagatatttgctatcagaaaagcatgctccaaagtataagccaagagtgaggctggacaaccttttgctagtgccttagaaacatcaaaagtcagagtattcagtcacatagagggctctttgaagagattaggcatgtaactcatggatctcctcagccgtctaagcataagcgaggaatagaggatatgatgtgatgatggaagcatccaagagccatggaacgtaagttgcctctggaagctggaaaaggtgaggaactgttatttcctaagagcctccagaagcaatgcatcctttgattttagtcccataagacctgttttggatttctgacctctggaattttaaaataataaattgtgctgttctgagccactgagtttgtggcaatgtgttatagcagcagtagaaaactaatacagagtttggtctgtagttgtaatgcctttgtctggttttggtgtcaggatactactagctatatgggatgggttgagaatttctaatatatcaaattaaggatactgttaggtgtgtttaataagagacactgtctgggcatggtgtaatcctagcctgtaatcctgtaatcacacttgtaatcccagcactttgggaggccaaggcaggagggtcacctgaggtcagcagttcgagatcagcctggccaacatggtgaaaccccgtctctactaaaaatacaaaaattagcccggtgtggtagtgggtgcctgttatcccagccgttcaggaggctgaggcaagagaattgcttgaacccgggaggtggaggttgcagtgagccgagatggcttcattgcactcaagcttgggtgacaagagtgaaattccatctcaaaaaaaaaaaaaaaaagagacactgcagattgcaacagtagtgaactggaagatgtatcaaaagaaatcattc

SEQ ID NO: 12103 - DNA, 16431 bp, Homo sapiens
agcttgctgatgaccgtatggcactggtgtcaggcatcagcttagatccagaagcagcgattggtgtgacaaaacggccacctcctaagtgggtggatggagtggatgaagtaagttccatgttagtttcatagcatcttgtttttttaagtaattatgacaatgtattttaagatatctgtcatataaacgaatttggctacacttgaatgtatatttctagaaatactttagctttaggttaagttgtctatgtgtgtgttaatgattttagctgtagttttaacattggtagtaactacctgaattataggaagaaattgaaaccccatgcaacaaggaagaatgtgattttctggtaatttgaattaaaagctgctcacacatcagcaagccaacaagtttgctgaagaccgaattctgtatgctgagtgtagctgatggaggcagaccatagcctgcctggcatcagtggagttctgtgacttcatttgcttagattcagtatgatgttggccggattaagcagaagatgaaagaattggccagccttcatgacaagcatttaaacagacccaccctggatgacagcagcgaagaggaacatgccattgagataactacccaagagatcactcaggtgaggagtgcaagtgagtcctggggaaaccagcgagccttctcatggcaatctcagaaactagagtgttactcagaatcagtctcctggagtcatttcccaacctgaagttctcagagggacctcaagaggccctgaagtcctccagctgtcagcgtaggtacctgtgaggccttggaggtatggggactgtttttcaattgttggcagataactgctgtggacggattaagtaaatatgaaatttcaaacattatcgagttcaatcatttgattttaaaatgtataactaatatcgtatactagtgttaagaaatttcaatgctaaattatagtcctcataattgaaaaaacaacttagtatcctagaaaaaattttttataaatattaaatttgattaattttaaaataataggactagtgttgaaacctcagtgtttacattttttactgaagtctcctgggtgctaattatcagaggagtgtggtgctttgagaaaagccctggggggttggaatgttggaaccctggctcttagcagtttaacagttacacgattctcatttaatccctctgactctagtgttctcatctgtaaaatgggactaataatcatagtaccatcctcataggatgcttgttagggattaaatgagaggaatgcaataataatatgatatatgataatacaggttgaacattcctaatctgaaatccaaaatgctccaaaatttgaaactttcttttgagtgccaatatgacactcaaaggaatgctcattggagcattttggatttcgaattttcagattggggtactcaactagtaggtattctgcaaatattccaaaatctcccgaaatttgaaatcctaaacattgccaatcccaagcatttcggatgagggatactcagcctgtctaacgtgatgatatgtgagcagctgggcacacagcaggccctacatagcaggagctgaaatctagtgaaatctttctgtgtatataaatgaagccacagattccttttatctgttcacctttctctaaaccagactgagtgaacagagcctctcacttctcactctggcttgtgatgtggcagtgttagcagaggggcttctctcccaggcttgccctgagcctcgggcttgttctcttagctcttccacaggtgccagcgtgccgtgcaggccctgccgagccgggcccgggcctgctccgagcaggaggggcggctgcttgggaacgtggtggcctcgctggcgcaggccctgcaggaactctccaccagcttccggcacgcacagtcaggctacctcaaacgtgagtgctgcccgggcctagtgaagggattttgagtaagaaaagcactttatgttttcttttttgccactattttttcatttagtccagtacctttcattgttagcttttgaacatgctcataccttgtacagtaaagggaagcctcctccccatgtgaaaccctggcttggaatgaaggcacagcgtggggtaccgaccaaggctgggggagggcaccaagatagttcagcatctcagcaaacaaaatttgttttgtgtcaagctgcaagaatttgaaaatcaaccaagcacattttaaaaacctgttgttttctggatgttggggtttgggagagctgctcttcaataggtaaaaagcagttgttattactgaaagccacatatttgcataacaaccaaagtgtttgagagcacctgagaaaacctccccagggtccttgaaacacttcctctgctggcaccacaggtttcacccagcagaccttttcttcccaaatagtgcaaagccagatttcagctctcttctcattctaatcaccctgtaaactgggttttttaaaattgcccttgcaatcaataaagtccccacatactccaaaaaacctagttctccctccctctgacaactggcatatttgtattttaattttattatttccaaaatttgattagggccatatggaattcatactagagatgcttctagagagaaatactgattttttaaaatgttttgtaacagcagttagattaaatatttctgcttcacttagagattctcagatggttgtgtcatttttatcttggcatcaagtgaattgtgcacatttacactgtgacttttgtcttgagtaatcccaaatgcctgcatattgttgtatgtttgtaatcctttactctccctccacccccgttggagataggcttctttaaagcggctaagaatatctcaattttgactgttggagtttactctagaattcccccttttaatggtagaacaatactcaggatggtttacatattcaagtaaaatgaattcctatctgtgataggcatgaagaatcgagaggaaagatcccagcattttttcgacacatcagtaccactaatggatgatggagacgataacactctttaccatcgggtacgtgaacgggctgcaaagctgattgctgtgtctgtgcaccccattctgcatctttcacctcctagacctcgatcttctgtgcagtgtcagtggattgatacagttgacttgtatattcatcaggttgttttgcagcaggtggaagaacagccgtactgtttcttcctttccaaaggccacagggagaccttgtaatctgctttccagagcctttgggaaagtggtcaacacgctgccttcttaggaagagcccagagaaacagagggctatcccgggggttttgtttatctgcccttgtggagttggcagacgtgggcttctgtcttccctgctatggcctcagagctttagatcctgctggtttagggaatttgaatctttcctgttagggaaaaatgagtgcttactgtgctttgtagaaatattttcagaattcattttctttaaattattttcattgtctttaaattatatctaaacaagtataccatagctttcctgagagggaaaacaatctatccaacacattgtgcactgtcttgctagggttttacagaggaccagttagttctggtggagcagaacacactgatggtggaagagcgggaacgagagattcgccagattgtacagtccatttctgacctgaatgaaatattcagggacttaggggcgatgattgtagaacaggtacgtgagctggccttcctcgtgaataggttttcctgccatactatctgtaccttctttttcctgtactcctttcagggaaaaaaattggagccaattttcccaacatgtgtgtgcacctgtcctttatgtgtgtgtgggtgtgtgtgtgtgtgtgtgtgtgtgtgtgtgtgtgtatattaatattaatcaaatattaaatttgattaattttaaaataataggactagtgttgaaacctcagtgtttacattttttactgaagtctcctgggtgctaattatcagaggagtgtggtgctttgagaaaagccctggggggttggaatgttggaaccctggctcttagcagtttaacagttacatgattctcatttaatccctctgactctagtgttctcatctgtaaaatgggactaataatcatagtaccatcctcataggatgcttgttagggattaaatgagaggaatgcaataataatatgatatatgataatacaggttgaacattcctaatctgaaatccaaaatgctccaaaatttgaaacttttttttgagtgccaatatgacactcaaaggatatatatacatagcaatcctaatcagaaaatatgaagttcaaaatgctccagaattcaaaactttttgagtgttaacatgatgccacaggtggaaaatccctacacaagacctcatgtgacaggttgcagtcaaaactttgttttatgcacaaaactagtaaaaatattgtggccgggcacggtggctcacatctgtaatcccagcactttggggggctgaggcacatggatcacctgaggtcagcagttcgagaccagcgcggtcaacatggtgaaaccccgtctctgctaaaaatacaaaaaaattagctgggcatggtggcaggtgcctgtaacagctactcgggaggttgaggcaggaggatcgcttgaacctgggaggtagaggttgcagtgagccgagattgcaccattgcactccagcctgggcaacaagagtgaaactctgtctcaaaaaatatatatatatatattgtataaaattactttcaagctatgtatatgaaacattaatggtatatgaaacataaaggtataagaaacattaatgaattttgtgtttagacttgggtcccatccagaatatctcattatgtgtatgcaaatattccaaaatctaaaaaaaaaatcccaaatccaaaacacttctagtctcaagcttttcagataagggatactcagcctgtatatgtgtgtatttacaaattatatacataggctactgtcattccctataagaatattaataaatctttttttgataaatgaagttctaatattctcttcccatgcctcgagggtactcatgtgagcaccctactctagagacctagttgactctgaccgagctcagcaatgattctgacgctatagaagatttcccttctaattttggcaggttattgtgtaatggcaattggaaccactagcgttcaagtagaattaaattgttgttcaccgttaaaatctgattagggcattttattatcttgccagcagggatttgggtcctgatccccctgaaaccaactgcagaatggagtgttcaggctctggaagatccagttacattaattactccagtggttcccagtgaactgctatctcttctaatccagcatgtttccaataaaagctctgttcttcctcatagcccagtgtccccgtcttccaatttaattgtttaagagattaaacaattaaacatcttccccttgagtccaaatttttaattttaggtggtagactggagtttaccatttcctgctctgacccatagagatgtggatccacgtttatagacgtgatagtcaatttgcaggtctacttatgacaggggcgagcttacctggtgttctctgcttacttgaatccaagtacgtaggcagcaaatgggcgcagagcttctgtgctgctcagagcctctgtccactggaccatagatttcttagggccccaggaagtccgaatatggcatttctatggcagctgaaaccaataaggaaacctcagtctgtcagtacttctttctcgtgagctagatgtgatggcactaaccagcattctgccatcgagctcctgacactgcttgagggtgaactccagagccctccgtgtgtacctgcagcacacagggaaggaaaacatcatcttatggatgatgatgtctgtaatttgcatatctcatttttgacgttcagttttcccagttgctattgttgattgtctgtaactgtcatttattacctagggtacagtccttgacagaattgactataacgttgaacagtcctgtatcaaaactgaagatggtttgaaacagcttcacaaggtaatatgtctttcaagacttgggaatcttaggaactattttcaaataatcaagaattggtaagagggttcttttccaccataacgatcttcagcattcttgtgttgtccactctcaatacagtagtgtaaaaagggattcatcatttcatttaaagccaattgtgggggctgttgccgttttattgcagttaatgattccaggtgtatctcacacttaaatccaaaattgctaagaactcctttttgtgacagtaaattctaaagagattggagttctttcttttagaaaatatttcattcttttctaatgcttcttgttttaggaaatcaattgggcatttgctaaaatatgtgttgaaaatctgtctgcttgttgccgttgacttgggcctctcttgtgatacattcctgatgaattgctgatggagaatcattctgcagaagataaaaatctaatcttctctttaattaccacagcatatctgtattaccttgagaaaagagaagtttgttgaagtgagagtagtaattcttttattctgtgctaataaggtagctgtttcagggatgtttttatgatattctcttttaaaaaaatagatggaaagcatcttaggaatcttatcggttataagaaacatgcataaacggctgagactctcatatataattggttacgtattttctttaaaaggaatataacaatacttcacaaattaaataatatccatttccttgtatctttgagacccagtggagtttctagccatataatgagtgttttgccaattcactgttggactactctaccatttttctgaaatcagtcgcttcctataccagagatcgccccatttaatagcagtattgggtttacaaaaagtcagcccttgcactagtctaaccagaagccctgagctgtcttttcagggggcttgttgccatgtgtaggtggatatgagactccagcctgtggtgggaagagaagtctgaccttgtctatgcagggtttttttaagcatttagattaatttggttgccaagccctgtctattaaaagtgaaaactaacttaagtttctcactctgtaatacccaggttttgatgtgctgctgaattatgcattggttttgaagtttcttaaataaaaactagtgaaatatgttttgtaatataacacagataaaaggaaaagctttctctgcgggagtgagcaaatctagtgggaactaaaaattttgttttaggttctactttataaatcattttgagaggttttacagtatattatttagtattggcttccctggtgttctgggttacttattagaaaagtcagcgtgctccatcttccctccagccacaaggctgtaggcagcacgcgcgtgctcggcagtcggctagtctaagggtgattgagcgtcgggagctgctccccatgaccggactctcggtgctgtccccgtgcctgatgtttcctcctggtggatgaggggctcctccaggtgggcgggcaggctcacttaggaaacaagcccaccgcgggggatggagcaggagagattgccattctcgccagggctgccttcccgctgtctcctcctccctcctgtgccatagcaaggtctggaagaggcagcgcatgctctccctggacgtgcctcccggcgccctctgaactctgctgtcctctggctctcctttctcagtgctctgcgtctttcgccagccaggtggggccctttggcatttctctagcaggcatgatggagttcccgctcctgccgagcttccaggatgcggtgttaaggtgaagagatgtgcagggtgcagcctcgtccccagattgagcttggagggctcctttgctgtatcgttagcggcactgggaggacgcgcctcagagggatctttctgcatatgacatccatggggcacacgtgtctgtttttatttcaaaggatgagtttttgtttccaaatttaggggaggtcgaaatggggcctcttccgggtgtctgttgcctacctgccaggtacggtcctccagcccgttgtttccttccgcggtgaaggaactgtgcattcgctccaggaacacggaccgggaacaggcgacccgtgctgcaggggcacttgccacggcctgcaggaggaaaagccgggagaagcaggcccagctgcacccggaagcatgagctttcacttccctgtcaggctttgtcttagtagtaggtttccaacaaatccatttccacgtccagggtaaataagcagcaccaggatcatggggctcttccactcctggtgattgaattccgtgggattgattggagggattacaatcatgtagcctgtagcagagacctcagtcactgtgcagagagatctggaagcctcattctggaaacgagtgggacttgatttgggattttggggaaaatgacggccttttttccctcctctttttgtaggcagaacagtatcaaaagaagaatcggaagatgcttgtgattttaatattatttgtcatcatcattgtgctcattgttgtcctcgttggcgtgaagtctcgataagtggcattgggttttcgtgtgtgccgcgcgtgtggatctcccgggtgtgaggggcttggcctgcgccccgccagctgcccgcagaggtgcagcctcgaggaatctgagggcgtcggggcagcgaacctttgcatccacggactcctccttccctagtcctgctcaagcggtccggggaatgggtttttgtttttccttcattgttgagaatttaaggacctttgatactgctgcacaatagagattgagttctgggatcagttataatatatattttttttagaaagagaaaatgagctgagagtttacaggcactgcagaagctgttcagtattatatgtgtatatgctatttttttagcagccatgtctgagcagaatgttaacataatttttggaaaaattttctttaaaccatctggtttttaagaaatttggtaccaaaaattgatgagtagaggcaaaaatgccccttcatctttctctatatattttccagttgaaaacaaactaagaagtcctttaagaatttataatccgttccccattaacttaatttagcttttccatcactgttaatgatcagagtaacaaagtgtgaaaaataagaaaccatcattgatgttaattaacacatttagatgggccagttaaaacagcttcataagttttaaattaattgtaaatggaatattcctcatttaaaatttttgcactgcattttctactgtaaaccaaaagaggttactaagcaaaaccacctaaatttaagttggtgatttaaatgaatctcacattaaaagaaagcttgacagtgttatgaaagccaccagactcagccagtgtgtccccatgggtatccccagccatccttgctcaatccattacttatatactaactacataatgacctgttcaaaccagactctatttaatgaactgtgaatttacacagaggccattttaaatgggtcaccccatttaggattagtggatctcaaattattaaccaaacatcactccatttcaaagtaaaatattccaccagcgatttgatttattggctcttccattgccactgagcaatgcccaggaagcaggcacattgccaaggactgggggcatcttgactaggaagctcctcgtttgtgtgagcgtgggtcagaccgccaaagtaggacttcatcgtttacctacctattatcaatatggtgcttgaatatattcctataactgtagaacagtgtggaaagtgatggtaactttgaagttgttcatgttttattggctttgttttaattgacactagtagagttttaatggtctttgtgtaaattttaatggcttttccattgtttttgcttctcttaaaaagtttaagaagaatatgacctcattaaatgtgctgttttatttggaccagtcacacaaaatgtctctctagagttgactttaaagttgtttacagaaatttaaactcaattccagagattgaagttgtccaaacagctcatgggcttagtgtccaaacccctgcccagccttccctttccaagttggtgccacctccaggtagccattggtggttttcctattactgatgtggctgtggaatgataaggtcctagaggggccctggcatttcaggaagcggacctggtattccctgacaaacattgcttaggaaagagggccggagaataagaagccagcacctcatcagtcagccctgcaatgtgagacttccgtagctgttgagagtcactgcaggtgttctttcatcccatctgattttaacccatggttgagacgttccaagttagatctgctgctcttaggtgtggggctgtccacattagggaacttgcctcaaaaacagtccacagtggcaataccggacttctgttcaagctttttaaagtgctgagccttacaaacccctgaaggaaagtgaccctttaagagaggatcatctttttttatatttattttcaccaaatagggtgatgagggttggtttttgttccctcaacccatttgggtaaaataacggatctgattagaaactgttttaaggaggggctgggctcggtggctcacgcctgtaatcccagactttgagaggccaaggcggtcacgaggtcaggagttcgagaccagcctagccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaattgttttagcgctgggtttcccaaggtgggagagacagacccagcctggagctggcccctggcctgtgtgctgacttcttggggtcctcaaaccactgtatttttctgttgagcctgtacttggggagagatcagtagcatttgaggaagtaagagaaaagaatcatggtacctcagggtttctttccctttactcgctggcagccattgtctgtgggcacctcatgtttttccacactctactgggccgtggaggtaacgatcacccaggccagtctcctctgcctgggatgcgccctctgagaggaggcctagcagggcaggctccctctgggcatccctggatgcagcctctggacacatgcctcctttaaagtgtccgggtgcagctcaggttgagtggaggtagaaggagaaacagacatgtttaccacgcgttttccaaagctcctgatctttcccaagattgtaactgaaaactgctgtctcttgttttgttcgttttgggggtggtggtgctggctgggccatgcttgtgaagtgatgtgtgtctctgatttaacggattcactgttttctctgctaattgagagagcgttatttacattatttatttgttttgacacaagtgctttcagtgttttatcctagctaatggcttcttaaaggtaataaaacccttccaacgtaattggtcagataaaactttttttcttgtatgcttaaataaagcaattagtgaagcacttctatccaaaatgacttttttgtccttttttaaaaccaatttactgttactggaaactttttgtacaataaagcaatcacgcagattaaagaacatcctgcaatcctagtattaattttaacaatgggttcatgttttcttccagtgcatttgtgttaggggagggcttggccagttttgtgatcctctgggcccctgactctgttttgtgcctgaggcctttgcctcagtgtccgaaagtagatctatctaatggatgctttcaaagggacaatctatttactatctgatatacaaaaagaacaactgcctaaaaggcagataagtatttttcttatgaaaatatatgctttatatacataccaagaaacatttggaaatctccaaataaaactgtgatgtgccttgttgagaagcaattcttacacacaggctgtaagagacttgactttctaaatgattttgtttcctactctgttacaccaaaaacttgagagacaagtgtctgccagtttaactcaaagccaagactatgtttccccttgattgtgcctgtcctggggtcctccgaggaggacctttgtcctgaaacttgactttgatgcatttgttttgctggtgggagatgtggacctgagtgatggtaggggtatgtggtttcatcaccagaacctatacaaacaaaaaatagcagctgtcatgccaggtctctttggcacccttggcgtttggtcctgaggtgttgcggcgactcaacagcagaacccttcagagcctgtcaacaaaccacacaaaagaaacaacctcctcctcttgcactctcaccgtgttttttgttaagaaattacatttccccaactcgcatgttggccactggctctgtccaagaatcaaatccactctcgagggagagacgtttgccatagggttcaagaatattctgaccggcaatgctatttaataacattgaagaaatcctccatcccgaaggggaccacataaaggcggcaacacctctttggtgacctcttgggttatgttctcagctgagtctttggtggcccagtcttgaaccagcactacaagagtatgcagacgcagtctgcagaagcattgctgtcagtggagagctgcaggatgccaccaatgacttggaggcatgacttgccaagaggcctggaagtggggagccactggggtgtccctttgaatgctcactttgacagcaggtaaacaggctggatatggatttcctctgtgaaatttagcaaccatcctataagaagtctgatcctgatccaacgtttgagcaatctagaatccttcctggtccgtctgccatagttacgtagccacaacaaaatttacctagcctagcaccatttctatctaaatctaataggatagcatgtcattctacatggggccttaattgtgatcagcatcccttactctagtcaagccatgtgggaccatgtggagagatcttttcacagaagggatgtccctagttgggtgtagagaagacagctcatcacaaagacttcctgcttctctgtggttctaattcatcgattagttatggtaagtttccattccttctaagatttaggtaggcaggcctggttcatccaacatgaactacatttcagaacctagcactgtgcatgcacataaatgcatgcctagaattgtatatcttggcgtatattagctcttaaaaactaattttcttggccgggtgcagtggctcatgcctataatcccagcactttgggaggccaaggcaggtggatcgcttgaggtcaggagtttgagaccagcctggccaacatagtgaaaccccgtctctactaaaatataaaaattagctgggtgtggtggcacacgcctgtaaacccagctaccagggaggctgaggcaggagaattgcttgaacccaggaggcagaggttgcagtaagccgagattgtgccactgcactctagcctgggcaacagagcgagactccgtctaaaaaaaaaaaaaagccgggcgtggtggctcacacctgtaatcccagcactttgggaggccgaggcaggcagatcacgaggtcaggagatcaagccatcctggctaatgcggtgaaatcccatctctactaaaaatacaaaaaattagcaggccgttatggcaggcacctgtagtcccagctgctcgggaggctgaggcaggagaatggcgtgaaccctggaggcggagcttgcagtgagccaagattgcaccactgcactccagcctgggcaacagagcaagactccgtctcaaaaaaaaaaaaaacactaattttcttgaccacccagatgccacttctaaccttgctgcctgatggttttaattctgttttgaaaacaacctcctcccaagtgatgggtattagaaggaactaatgagaaccctgggtgcaagcagagacttttagcacgtatgaaagtgcttctgatttaggactcggagttagatggtgggtgtcagctgcgtgtgtcttgtccccaactccatgccaccctcgggcagacgtcatggtaccagtctatggccaggctttcttactacacaaagagacattccatggagtcaaatggcagagacttgtgtacaattatctggtcagttgaggcaaaagaaaataatcatttgtccaattgtccaaattagctctgtggattgtcctgaatgctcggggtaactgtgtggttctccacttcagttccgtaacctggctaagatggaccatttaaatgaggctccattcaacacaatgcacatttaaatgaggctcagttgcaagagaccactgggcttagcgttttcaatttgtcaactataattctataattgcttttagctaatcatccaaatgattacatgttgtaatggaggcagaagaccctcgtatgcatcatttggtctctttttctcagaggaagtgctgaaggatcaaatgttttgtgtgtctctgtgtgtgtgtgtgtgtgtgtgtgtccgtgttttaacttggtgttctgacgcacaacaccataatagacctccattttcatcaacggtgggggaatgagaacaacgccccccatcccaacatcccccttttccagagggggaaactgagacccaagtttccctcttgccaaggccacaggactagaactagaatcgtcagttttctgatttccagatcaggactatttctgcttatgccattttaatttttcatttctttccataaaattaaatgaccttcttcaagaaagatttaatggtcaagatgcgatttggtaaaaagcttcctcaaggatttttttcttattacaaagatgagactggctgaggctgagagatttgcaagcagtggtatgtcattatccccagctcagttttttgtgtaattggtgtgaagagattgctgctgatgaatcagcctgctgctcaacagaaaataatgattcttttgtgacgtgagtcagtgtacgtacgtgtacgtttgtggttgtttatgaaaggtatgtgtgtacataaaatgcttatcaagatggataatgtcattttaaagtggtaaataataaaaaatagtcctgagcaaaactgattttacaattgcctgagaatgcagcacttcattttaacactatgcaatggctagaaattgattttttttttttaaatccaattaagcctcaaggttggttatccatttaaaaggtcggatgagttaaacaatgacagtaccttcagttcgtgctaataaatttgcacagaacttcagcacttacatcgtgtgcctcacagaggcatacattttgtatgtgcacaacactgaactaccaaagtcccagcagtggtacagatacaccagcagaccctggaccccaactgggggagtccctgagctgaccgccggccctatcacctcttccacttagatccccgaagcaccccccaccccagagtgctgagtccttccatctacctggcccccttttctgtggccccaagagcactgggagatgaaaagttgcctctcatttaaaaggggggaaaaagatgtattcactacttggttttgtgtgctgctgagtttataatgtaacaaataaatcctgttttaaaaatagtactttatagtgtgtatttactgtgtattcatagtgcattaagaaaaagacttcggccgggcacagtggctcatgcctgtaatcccagcactttgggaggcagaggcaggcggatcacgaggtcaggagatcgagaccatcctggctaacgtggtgaaaccctgtctctactaaaaatacaaaaaattagccaggcatggtggcgggcgcctgtagtcccagctactaaggaggctgaggcaggagaatggcgtgaaccagggaggtggagattgcaacactgcactccagcctgggcgacagagccagactccgtctccaaaaaaaaaaaaaaaaaaaaaaagaaaagaaagaaaaag

SEQ ID NO: 12104 - DNA, 11146 bp, Homo sapiens
cttcctccagttaggagccttgatgccggaggggacagtggtaggtggggaggttgagtgcaaagggttcaggctgtaagtcatgttgggttggaatgggggcacaggaaggtggggctgttggggagccacgctaagccgggtgtctgtagcagagccagagaaccgggacactgaagagggtgctgaagggggcgactctcagggatcgagccagggcccccgaaggtgggatcgaccagggtaggagacaggaaaaaaaaggagagcagcgggtgggggcgaaagcagggccgaggagagagcactttggacagaacccggcggggaaagggcggcgccgaggcttgtcaggggcgccccgcagcgtcccaggcgcacctgttgggaagaaaggaaggggcttcccggtgttcgagggaaatccagtccggaggggctgactcggagcttgggactcctggggagccaccgcctcctccccagcggcggtcaaaaccgggcaagcgaaggggcgtgaccctggtgctcaggtttcttcctcctcacctgggcaaggaggggtgggggccacgacttccggttcaggtgagtgtcccttcggtgacgtcaggtcatcctcggccgcccctccggtcccgcctccccctcccgcgctcccggggcgcgcgggccgcgcccccgacgccctacatatactcaggtgcgccccacctgtccgcccgcacctgctggctcacctccgagccacctctgctgcgcaccgcagcctcggacctacagcccaggatactttgggacttgccggcgctcagaaacgcgcccagacggcccctccaccttttgtttgcctagggtcgccgagagcgcccggagggaaccgcctggccttcggggaccaccaattttgtctggaaccaccctcccggcgtatcctactccctgtgccgcgaggccatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtagggtctccccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccggtaaggccgcgggaccgacggggcggacgcgcccttgaccgaggtggcggggtggcgcgcgtgggagagccgaggccccacggctgggggccctgggttgccggggagctgcagggcgaggaagtggtcggctgggggcggcggggctgggcgggagcgggccggggttccggcggctgcacgtgggcgcgcacctcggtcgcccacgttcctcttcctcccccaacccagcctcgtccccggctcggagcagcggtgcttaggccggggccatcccctcctccattcccgggcaggccatggcctccgtcatctcccgtccttttctcagacagaaacggccccggggcgcggggcacggggcgcgccgagggccgaagggcggtgcggctggtcagagtgggccgccgcctgctgcctctaatcttatcggccgattagccgaagccacaaacccggtggcctcgatagcgggctcagagcagggacgccggctggcatgtgcgccgcgcggggcttcggaccaccgtctcggcttctcttcgctgcaccctttcacccttccccctatccagggcagtttcaccgaaaccccggcgccccgggcggatccttgagcggagagggcggggcgggagcaggaaggccgcgctgtcgggaggggcggggacctgcccgcttggcccaggtcttggacacctgggcgcccctggccctcggcagaacacggcgccggacagaagaggtccagcggttagtgggcgcggccggcggcacgaaggctggagccgcctgcatttccagcaatgacggcgccctttcccctcgcccgcagcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtgagcccccgggttctcccatctgggaggagcaaggctgggcaaggcgcccatttggggcctcactatactgaaaccctcattctgtctccaggtcttgccgccttggtagcttgctcctggtatggccatcagattgtcacagacttttataaccctttgatccctaccaacattaagtaagtctgggaaccctgcctcctaaggggacaggtctggggtcctggaatagggaggagggcagaggcacgccagggtttctaaccacccccttctcttcacaggtatgagtttggccctgccatctttattggctgggcagggtctgccctagtcatcctgggaggtgcactgctctcctgttcctgtcctgggaatgagagcaaggctgggtaccgtgtaccccgctcttaccctaagtccaactcttccaaggagtatgtgtgacctgggatctccttgccccagcctgacaggctatgggagtgtctagatgcctgaaagggcctggggctgagctcagcctgtgggcagggtgccggacaaaggcctcctggtcactctgtccctgcactccatgtatagtcctcttgggttgggggtgggggggtgccgttggtgggagagacaaaaagagggagagtgtgctttttgtacagtaataaaaaataagtattgggaagcaggcttttttcccttcagggcctctgctttcctcccgtccagatccttgcagggagcttggaaccttagtgcacctacttcagttcagaacacttagcaccccactgactccactgacaattgactaaaagatgcaggtgctcgtatctcgacattcattcccacccccctcttatttaaatagctaccaaagtacttcttttttaataaaaaaataaagatttttattaggtacgggggtgttctactctctcacattaccccatgtcttcatcctaccttctgtcctgatgagacgctgcttcctggctcacaaggcggggctccatagacaaggggaaccaaggtggggcagggacagggtaaggctaacacaaacaatagaaagatggttctgggcccaaagtcttcccgcgccccctccaattacaatctaatcaaatctggccagtcaaatatccaggtcgtcatctgggtcttcttggtccaggtcatcataagcatctggctcatagaagatgtggctggtagcctgccctggcctaggccgcaggagagcctgctgtctgagaagggaagatttggtgctggtgagggtagctaacaggttgggtctggatactttcttccaggtgactgtgactctcattcaggcaacctgttaggcctccatgtcattttattggtccaagtccctttctctgacctccatgttagagctgaagcaccatttggtactgggatagatacccttgtactgctctcctaataaaaccgtaagttcctagcagcttgagggcaaggatcttgtagtcttgcgtcatccgcccacatactgggcacagaacagcaagcgtgtactaagcccttgttaaccagcctctgccacgcccatatagccttctgtcctcctagcaccactgcctagggatagggccacctcccaagggtctggtctggctcagcccaggcccagggtgctctggggacaactggagctgtgacccaagggtataagggagagaaaagagacataaaggtcctctgccattatagggggaatgggtggatcaagaacttggacttgtctctggaggtggacttcagtccctataaagtcaggttaatcaataacctgttgccccaacctctccatggcccagatgctgggatctactcagggatccacgtacccaggtcccaaccttacttttcagaactgaactggaagggcaggatcaggctatctctggcttctctctctttcttggacaggtgaaggttaaaggtcaaatgagttgtgggatccacctgtaggtacaaaggatgctgccactctgccccatccctagaatccctgaccccacccccaacctctgcagcttttattttctctcccgtgaccagatactaaactacatttccttgttctggccttggcattcttagataccgggggtatatgaggatcggagtagggctgggactctacagagggcccctcttggagatccaggctgaagtccggaaggatggagaaccactgagtctggagagaaaaaagaaaagagtttttttcatcttactgaagaaactagacagactccaggacctcacatcctcagcccccaatcacctatttaactgactgctttcagctcctgccctcaacttttttttttttttttgagacagggtctggctttgttgcccaggctggagtacagtggcgtgatcttagctcactgcaacctccgcctcccaggttcaagtgattctcctgcctcagcctcccgagtagctgggattacaggcacgtgctaccacacccagctaatttttgtctttttagtagagatggggttttgctatattggccaggctggtctcaaaccactaacctcaggtgatctgcccacttcggcctcccaaaatgctgggattacaggtgtaagccactgcgcccagcctctattttattttcaaaagtgaaagcaagttgattaaggaagtaaaggaataaaaggatggcgactccttaggcagagcagcccacttactccttttttgagacggagtctcactctgttgcccaggctggagtgtagtggcatgatctcggctcacctcaacctccgcctcccaggttcaagtgattctcccacctcagcctcccgaatagctgggactacaggcacccaccactatgcccagctaatttttgtatttttagtagagatgagatttcaccatgttagccaggccggtctcgaactcctgacctcacaatctgcccacctcggccccccaaagtgctgggattatgggcctgagccacctcgcctgggccccacttacactttataaccttggtaagtgacttaaatttaaacctccttgggccgggtgcagtggatcacacctgtaatcccagcactttgggagaccaaggccagaggatggcttgagcctagttattcaagaccagcctgggcaacagggtgagatctcatctgtataaaaaactaaaaagctggctggatgtggtgctacatgcctgtgctcccacctccagctacaccagaggctgaggcaggaggatcacttgaacatgggaggtcaaagctgccgtaagttatgattgcaccacagcactccagcctgggcaacagtgagaccttgtccaataaaaaaaaaaaaaaaaactccaagggaataaaaccctccctggactggctttccagcctgaaaaatggtgataataaaacaatctaccttaaccatagctgagaggattaaatgaagtgagtgatagaaaacagagaaatacctaaatcagctttttttaaaaaaaggtctcactgagggctgggcacagtggctcacgtctgtaatcctagcactttgggaggctgaggtggaaggatcacttgagcccagaagtttgagaccaccctgaccaacacagtgaaaccccatctctaaaaaagtttgtttttaaagtctccttgaaacatcagcattttcattgttcttcccatcgtgccacccctttctctgtcccccgtttccagtccttctctgttggttcttctgacctggtcagttgggcgctgtcggggcctccgacacaggatgtgggccgaggcctggcccatggtaccgcccagggtcacctcagtctgagcaaggctgctgagagctcccacagggcctggtccatgaagctcttcatgtagcaagcccagcacactcactttccccactgaggagctgtcacctagaggaggacaagaaatgtaggatagtagggagcattcaggttggtggcctgggagctaacagtgaagaagagagagcctcacaattccatcacagtgctgccaaaatcctgacgtcccttggccaatctcactaccgtgctctgagcctcctccagcccacaccttaatctcctctatcatcccaatgtaaagctgatcaaggcaccgctctaacttctattcttcagcagctcctgccttcaggatggaacgaacgcttccagcaggtggtgtccacttactttccagcctcatctcttacacacggaagtacttgtagtttctggaacttcccaagatctcagtcagtgccttcaattctctgcctccctttttgggagcatttagagagtgtcaggtactatgctaaacgctttaacacaatgtttgaatccttacaaaggtcagcgtttttaggtcaaactgtatgaaatcactgacatttaacaatttttttttcttttctttttcgagatggagtcttgctctgtcgcccaggctagagtgcagtggcgcaatcttggcttactgcaacccctgctacgggctcaacaatactgcctcagtctcctgagtagctgggactacaggcgcgtgccaccacgcctggctaatttttgtatttggtagagacggggtttcagcatcttggccaggctggtcttgaactcctgacctcgtgatctacctgtcttggcctcccaaaatgctgggattacaggcatgagcctctgcgcccggactgtttttatttttttgagatgacgtctttctctgtcacccaggctgcagtacggtggcgtgatctcagctcactgcaacctctgcctcctgggttcaagtgattctcctgcctcagcctcccgagtagctgggattacaggcgtgcaccaccacacccagctaattttttgtatttttagtagagacagggtttcaccatgttggccaggctggtctccaactccaggtgatccgcccgccttggcctccccaagtgctgggattacaggcatgagccactgcgcccagacaatatttaacaacttttaacctaagaaatggcaatatagtggttcatcctaatacttcccttgtaccttcccccatatacaggggaaagtgaagcaatgagagatcaagcaccttaatacaaagctgggcgtctgactcctaagtccattcgagtacccacagtgcacttcaaggctagtctcagtgcccctgcccggccaaatttgcctggatgacctcttgctcttcaagagagtgcctttttttttttttgagatggagtcttgctctgtcgcccaggctggagtgcagtggcccatctcagctcactgcaagctccacctcccgggttcacgccattctcctgcctcagcctcccgggtagctgggactagaggtgcccgccaccaagcccggctaatttttttttgtatttttagtagagacggggtttcaccatgttagccaggatggtctcgatctcctgaccttgtgatctacccacctcggcctcccaaagtgctaggattacaggagtgagccaccgcgcccggccaagagtgcccttctttaaggtgccctgtgcatgcctgtatcatcatggcctttatcagaccatcttgtaactgcctgtttacttatctccatcttttatgggacttcgagctcctggaaggcaaggacccagctacagtcagtctgtattttgccattatctagaattgtacctgacacattgtatatatttactattgatttgttaaatgaatgaatgagtgaaacaaatgagtaaaaaaataacttggagaaaaaaaagcaaatggtagatggcattaaggagaagtaaaaaaaaaaaaaaacagacaaaaaagtcaaaaaaatgaaaaaaggtctgactggagaacccagatgtttattctagggtagaaaggaaaaggggcacactccttggcagagggagatgtatgaggggaaacaatgaaggaggggtctcaccaggacaagagtcctgatggctcacagcatgcaggacctggcagagtgtggtgcagggaaggcgaagtagcagccagctgagtgaatcgagagcaatggtgacaggaacaggatctgtcctcttgcacatggctctcaaggctcccagcggccccccaggaaaggcctcctcagtttttgaccagttgagagggtctctgaagaagtcatggtaaaccagcctgcaaagggaaaataagacacaatataatattgccccttcccccgagaggatcacaaagttcatcctctgatctttatggctgttttctcaatttttatgaatatcctaaatattagtgaaagataattactgagagagagcatacagtgattgagagcacagactttggtgtctgacagcctgatctccaagcttggctttgctacttgcccaaggtcagctaactgatacattatttctaagagttgcctcattggtgaaatgagatgccaacctctaagcattcagcacagtgcttgacacatagtatatgcctgataaatgttagttatcaccattatcaaatatttcctgtgtgtggcacctaaagattatcaccctgggtgaaaaaagagaaagcagaggacgtgagatttggtcctgcctgtagaacagcttaaagaaagtcaagaattaagtcaagaagtaacaactacagaaaaaacagctcaggaaagggagactggcataggtagcagaactttttttcccagatatctcttttctatcttctcttgtggagtgcccgcttttttttttttttttgagacagagtttcgctcgttgcccaggctggagtgcaatggcgtgatctccgctcactgcaacctctgcctcctgggttcaagcgattctcctgcctcagcctcctgagtagctggaattacaggcatgtgccaccatgcccaggtaattttttgtatttttagtagagatggggtttctccatgttggtcaggctggtctcgaactccagacctcaggtgatccacccgcctcagcctcccaaagtgctgggattacaggcgtgagccaccgcgcccagccatggaatgccatctgaacatacaccaccgcctctatcacaacaatggctgatgcaaaattggaggctcaacagataagatgtaaactactattatcatccactgagttgccgggactaggaagtagaaagcatcctactaatggttcttaatgtctcctgatcaggcatgccgctgggtttaggaacttccttatctcaatactttcttctcccccatattagtcaataaatcctggaaattctacccactaaagtcctttacatgtgttctaaactttccatctctactgccactgccttaaaccaggcctctatcacttcctaccattattccctaaaattcattaggtcaggaacaggtctcactcactgccgtctccagtatcttgcacagcacctggttgatagttggtgctcggtacatatgtaccttaaagagtgaagccggattaacggattactgcaatacccttcccacatgttctccctatttccaggctatttctctctcgacttctatgatctttgctttggactccccaaatactcatcactcctcttattaattcttgcctcctgaaagatccatatccaattcttcaatgaatatttaaggaactgctactacataccaggttctgcgcttgttgtaaagaaatttccttagcattataggtctcaaatttaatcaaatctcttccaactggtacttaccgattgttgatatcagagtcaaaaccttcacgaaactcttcctcgctcacttcacagcccaggatatgcacttgctccccactaaggcagagatgagaagggattgtcaaagagtgggcacaggtgccctatccagggtaggccggggagacactgtgggatactcaccacagtgcagatttcttgacaagcgccttcaagagactgcgcccctcccactccacggaatctgcagagcgagggacggataaagggtatgagagcgctgggattaccgccttcgcgaacccgtcgcgatttccacacctagcctgtgacccctggcccttcctgcccacttccgtcccctcagccaggcccgaaccgcaccccccgccccgccaccgtgcctctggctctcaccccgaagcagcaccaggccgcccaaggccaacagcgagtccaacatctccaactcgcgtccggtccctgctctggcgccctctgatggcgtcatgacccagtgtccttcctcctcggggtgaaacgggccgagcactcgggcgtcctcccaccattaagacctaacatagtctggaatgagaggtgattatgttcaatattcccaggggggcgctcacgcggagggcgcccctccccgagccctggcgcacagtcgtacggacaacgaccccgtctacattttcactgtgaccggggcgggaagagcagttggggcagttgtcagtgggagggggaggaggacccacaagccccccgcgagggccctaagcgcgggccaagtgacgtcactctccccgcccacgcagtttgaggcggggcctgcttcgcctcaggccccgccccgcggccaccttctgcgcgtgcgcaatactgcagcctcgcttggagtgcttttggctttccttatacctacccgccatagaccgcgcaggaggaacttagt

SEQ ID NO: 12105 - DNA, 4022 bp, Homo sapiens
cttcctccagttaggagccttgatgccggaggggacagtggtaggtggggaggttgagtgcaaagggttcaggctgtaagtcatgttgggttggaatgggggcacaggaaggtggggctgttggggagccacgctaagccgggtgtctgtagcagagccagagaaccgggacactgaagagggtgctgaagggggcgactctcagggatcgagccagggcccccgaaggtgggatcgaccagggtaggagacaggaaaaaaaaaggagagcagcgggtgggggcgaaagcagggccgaggagagagcactttggacagaacccggcggggaaagggcggcgccgaggcttgtcaggggcgccccgcagcgtcccaggcgcacctgttgggaagaaaggaaggggcttcccggtgttcgagggaaatccagtccggaggggctgactcggagcttgggactcctggggagccaccgcctcctccccagcggcggtcaaaaccgggcaagcgaaggggcgtgaccctggtgctcaggtttcttcctcctcacctgggcaaggaggggtgggggccacgacttccggttcaggtgagtgtcccttcggtgacgtcaggtcatcctcggccgcccctccggtcccgcctccccctcccgcgctcccggggcgcgcgggccgcgcccccgacgccctacatatactcaggtgcgccccacctgtccgcccgcacctgctggctcacctccgagccacctctgctgcgcaccgcagcctcggacctacagcccaggatactttgggacttgccggcgctcagaaacgcgcccagacggcccctccaccttttgtttgcctagggtcgccgagagcgcccggagggaaccgcctggccttcggggaccaccaattttgtctggaaccaccctcccggcgtatcctactccctgtgccgcgaggccatcgcttcactggaggggtcgatttgtgtgtagtttggtgacaagatttgcattcacctggcccaaaccctttttgtctctttgggtgaccggaaaactccacctcaagttttcttttgtggggctgccccccaagtgtcgtttgttttactgtagggtctcccgcccggcgcccccagtgttttctgagggcggaaatggccaattcgggcctgcagttgctgggcttctccatggccctgctgggctgggtgggtctggtggcctgcaccgccatcccgcagtggcagatgagctcctatgcgggtgacaacatcatcacggcccaggccatgtacaaggggctgtggatggactgcgtcacgcagagcacggggatgatgagctgcaaaatgtacgactcggtgctcgccctgtccggtaaggccgcgggaccgacggggcggacgcgcccttgaccgaggtggcggggtggcgcgcgtgggagagccgaggccccacggctgggggccctgggttgccggggagctgcagggcgaggaagtggtcggctgggggcggcggggctgggcgggagcgggccggggttccggcggctgcacgtgggcgcgcacctcggtcgcccacgttcctcttcctcccccaacccagcctcgtccccggctcggagcagcggtgcttaggccggggccatcccctcctccattcccgggcaggccatggcctccgtcatctcccgtccttttctcagacagaaacggccccggggcgcggggcacggggcgcgccgagggccgaagggcggtgcggctggtcagagtgggccgccgcctgctgcctctaatcttatcggccgattagccgaagccacaaacccggtggcctcgatagcgggctcagagcagggacgccggctggcatgtgcgccgcgcggggcttcggaccaccgtctcggcttctcttcgctgcaccctttcacccttccccctatccaggacagtttcaccgaaaccccggcgccccgggcggatccttgagcggagagggcggggcgggagcaggaaggccgcgctgtcgggaggggcggggacctgcccgcttggcccaggtcttggacacctgggcgcccctggccctcggcagaacacggcgccggacagaagaggtccagcggttagtgggcgcggccggcggcacgaaggctggagccgcctgcatttccagcaatgacggcgccctttcccctcgcccgcagcggccttgcaggccactcgagccctaatggtggtctccctggtgctgggcttcctggccatgtttgtggccacgatgggcatgaagtgcacgcgctgtgggggagacgacaaagtgaagaaggcccgtatagccatgggtggaggcataattttcatcgtggcaggtgagcccccgggttctcccatctgggaggagcaaggctgggcaaggcgcccatttggggcctcactatactgaaaccctcattctgtctccaggtcttgccgccttggtagcttgctcctggtatggccatcagattgtcacagacttttataaccctttgatccctaccaacattaagtaagtctgggaaccctgcctcctaaggggacaggtctggggtcctggaatagggaggagggcagaggcacgccagggtttctaaccacccccttctcttcacaggtatgagtttggccctgccatctttattggctgggcagggtctgccctagtcatcctgggaggtgcactgctctcctgttcctgtcctgggaatgagagcaaggctgggtaccgtgcaccccgctcttaccctaagtccaactcttccaaggagtatgtgtgacctgggatctccttgccccagcctgacaggctatgggagtgtctagatgcctgaaagggcctggggctgagctcagcctgtgggcagggtgccggacaaaggcctcctggtcactctgtccctgcactccatgtatagtcctcttgggttgggggtgggggggtgccgttggtgggagagacaaaaagagggagagtgtgctttttgtacagtaataaaaaataagtattgggaagcaggcttttttcccttcagggcctctgctttcctcccgtccagatccttgcagggagcttggaaccttagtgcacctacttcagttcagaacacttagcaccccactgactccactgacaattgactaaaagatgcaggtgctcgtatctcgacattcattcccacccccctcttatttaaatagctaccaaagtacttcttttttaataaaaaaataaagatttttattaggtacgggggtgttctactctctcacattaccccatgtcttcatcctaccttctgtcctgatgagacgctgcttcctggctcacaaggcggggctccatagacaaggggaaccaaggtggggcagggacagggtaaggctaacacaaacaatagaaagatggttctgggcccaaagtcttcccgcgccccctccaattacaatctaatcaaatctggccagtcaaatatccaggtcgtcatctgggtcttcttggtccaggtcatcataagcatctggctcatagaagatgtggctggtagcctgccctggcctaggccgcaggagagcctgctgtctgagaagggaagatttggtgctggtgagggtagctaacaggttgggtctggatactttcttccaggtgactgtgactctcattcaggcaacctgttaggcctccatgtcattttattggtccaagtccctttctctgacctccatgttagagctgaagcaccatttggtactgggatagatacccttgtactgctctcctaataaaaccgtaagttcctatcagcttgagggcaaggatcttgtagtcttgcgtcatccgcccacatactgggcacagaacagcaagcgtgtactaagcccttgttaaccagcctctgccacgcccatatagccttctgtcctcctatcaccactgcctatggatagggccacctcccaagggtctggtctgg

SEQ ID NO: 12106 - DNA, 286 bp, Homo sapiens; identical to SEQ ID NO: 6447

SEQ ID NO: 12107 - DNA, 37437 bp, Homo sapiens
atcttgtaggcggggacacgccgaggtaacttccagggtgcgccttcgttgtcttctccaagctgtagttctacgtcccgacctccctatcataccacactcttcagcgaccacgcaggcactttcccggtccccaggtgagcgccaggtggctccgaggcgcgtgtatgaggggggtggcatggcatggcatggcttgcaggcgccagagccagaccccgagggacggtgtccctggaaggtgggcgggccggccggcgccactggacgccgatgtcgtttgcgagccccctagtcccgtggtccaggctcagctgtggcggcgtgcggggtgcagcaggcaggagtgcacatcgcaaggtgagcagtttccgctggggatggcacggtgggcgcggttcgagggtctcgccccgcgacactttgctcctgtccaaggaccaaggcaggagcgctctggccccaccttccagggcgctgactttaggggagactggcgggagcgccggcggaccttagcccggccctgtctggcctggagacgtggcagagcctgaggggaagccgctgtctcctgaaacaggatttcggccgctctggccctggagaggcccaggaggctcgagagtcatcacaccaggacctgcaatgaaaggaagcttattttccctgaggttaccccatcggtgcttagcgccgcttgggagagtttttgcattctctcgtttctttgtttggtcttgggacctgcttcaggcaaatttgcagatagcacgtttcctagattgacagaatttatagccaatagtgtttttgtcattcgaagtagttattttgagagacaacatgtgcatttctgcgatcgtgacacatcttggcattcagtctttctcctgtgcagccagtgtttaattcagtgaaaatttataaaattttatttcggggtcagattaggctctaactagcgctcactgtctggtagtagagacaatcttgtggcacgagtaggtcagcaataattgctcttaatgctttaaagtttatcagagcttcactcttccatttcttgtaaacttgtaaatagacatccactttttttttttttttttaacagaaaaaccaaggcacaagcaaattggaacaacagggtctagccggactgagaactcagttttccaaaccattttcttcactttttctttagtgttgatatatgaatagtacttttcgtgacaagacttgagccctaaaacagttaccaactctgacacttcagtattgttttatcataataggtttttttagtagaaggcactatgtttatgcatgtaaaatttacctcagtattgccattacggcagttttcatataaaaagccattaaagacaaagaaattgattatttattccacttaatgactttgtattcattgtacagtttcttttgcagacacatttgttaatgttagggattctcttacaataggacttctactagtcattgtaaggattggggagcatctgtagtagagggtgaatgaccaataaaaaattaaatgaagaaaagagggagctttggttgaggagtggtaaaatctccaaaggggcatttctatctcaggttatttaccttcgatgtataggtactgaatgaaaggattcagcctccccggatccctgttctctgcttagtgccatagatctttcctacgttcacagccaaactttttgaaagtgtcatgcgtgttagtctcacctgccactgctcgattcagtttacactggaatctttctccactctttatatgaaaaccgttctccctaaattcatctccagtttggcagatccattgaacttctcagatagtatcctatttggcttctctgcagcattaatactgttgcccattcatactgcgaaactctggcttttggacaccacagtctcctggttttcttccttttagctcatctcttattctctgcaaacttgtcttccatcttactaaaccaataattggtttaacatcatattctcttttctcttggtattctcttacgtaatctcatctcaaaacatgatgttagactatcagtacactgatgacacccacatttatgtggttgctaagctccagaccaagtcagtgtctctacttagatgtttgttgcaaggaacttaaacagcatgtcaaagactaaacattttatgatttcccccatccgactcccccagaaagaacatcaaacacattggccttctgcagtgtttcctatctttgtgcatggcaccaccatctatctagttgtgcaagtcatgcctcctttcccttcctccatacccagtcactgaattttgccacctaatcttgtcttgaacttatttacttttctccatctccactatcatcacttgagtctaggtcagagtttttcaactttggcactattgaaatttggggccacttaattcttgtgtgtaggctgtgcattggaggatttttagtagtattcctaacctcttcatgctatatgccagtagtagccctctagttgtgacaataaaaaatgtcttggacattgccaagtgaccccttgggggcataatcagcccttcccactatgaaaatcattagtctaggttgttacttacttctgatggaactacttctatatcttccttaatggcctgtctgcatctgctctgtctgcccagtggcccaggctgcatactttgttcagatcttttcaaaaaataaatatgaattgctaataactggaatcagcctaaatgtccttcagcaggtacatttatacaatggaatactattcagcaataaaaaggaaccaatttgatatatgcagcagcttggatgaatctcaagaacattatgttgaatgaaaaaaagccaacttcaaaaggttatatgctgtatgattcgatttatgtaacattcatggaacgagaaagtgatagaaaacagagcagtgtttgccagggcttatggttgacgggaaggtagataaaggaacaacatgaggaagtttctttttagtgatggaatggttctatgtcctggtcgaggtggtggttatacgagattgtgcatatgatgaagcttcatagaactatgcacatacacacacacagtaaatgtaaaaacatgtgaaatacaaataagatctatagttaatagtgttgtaccaatgtcagtttcatggttttgatcattgtagtgtagttatgtaagatgctgttactgagagaagctgggtttggggtactcaagaactctgctgtttctacattttttttttgaacctaaaattccttcaaaacagttaaaacaaaagacagttatgctaccctcagcttgaatgccttacagttgtaggatatgataaatttctcttcatagattttagcctgtaaattgttaagtacaatgagttctgagatcctctccaaagaaccagtgtatcagtatgttcagctcccctgttctttgttcttcattttaaagtttaaattcctagttctttatttctccttgcccccagtttcagtaaacaatccccttctagcctctatcaactgctctgaccttagtcacccttggtcacctgctctgaccttagtaatccttggtcatctgctctgttcttagtcatcctggatcacctgttctgtaaccgtccttcccgccaaactactcaccctgctgctctggctcatacccctgctctctttaaaatagccagttggaattagcttagactgcgtggtccaaccctagccaatgggggaaagacacagcagtagggactagctgcgttaggataagaaccccttcccctcccttgttcaggtgtgctcttgacattgctccatctgtgagacacacccttctatagaagtaaaattgccttgctgagaaaattaaatttatgttcgagtgctatttcttttgtggcaccgaaaatttatttctaacacagtgacactctgttctttaaaaacccaagttttttaacctggtttatgaggctgaacaccttctgggcttctgtctgtccctccagtcctgattcttctttctctcccttcacatggattttattgaatgtatcttgttcttcccagctcagttggtatatatatttgctatatattcacttttcctggactctgcctttcttcccttgcctaattaagttcttatccttcaaatctcggtttatctgtgacttatttggggaaccctttccttacctccaagtcaaaatcatattcctgtcaaacaaaactgtgttcttaccctcagagcacataattcagctaccattcattgtaaattggtttattatttgattgtttcctgtactagactgtaagtatcctatttgtttttgctaatcattgtcatttccaaaggcatcagtatagtgctcgtcaagcagttgaccttcgctaaaaacttattaaatgaataaaaatattaaaaacaaatatagcatatttagaagttggttctgtacttgagatacacttcaggatttgtaattttaaagaaagttttctcatattttataatccattgttgtctattaggatgctgctatctaatggcatttttgctatagttaacttttctaaaacctcagatatacaatttatctgttactggatatgctttaaaatgtgaactaggaaaattgtgaattaatgcttttatcaagtgaagcacattttattttattttattgagacaaggtcctgctttgttccccaggctggagtacagtggcattctcactgctccctgcagcctcaacctcctgggatcaggtgatcctctcacctcagcatcctgagttgctgggaccataggcacatgtcaccctgcctggctaattttttaatttttttgtagagatggagtcttcctatggtgcccaggctggtctcaaactcctggtctcaagggatcctcccacctctacctcccaaagtgtaggtttacagcggtcagccactgtgcctggctttattttttttttatgttaatggggatatcttatacacagtactttatgagagaagaggaaaggcttcaaaaatacattaaatattttatttatttatttttagagatcttgctctgtcacgcaggctggagtgcagtggtgcagtcatagctcactgcaaccttgaactcctgggttcaaggcatcttctcatcacagcctcccaaagtcctgggatttcagacgtgagccactgtgcccagcctcatttttattttaaatttaataatgactgaaatttatattatttacttattttattttttagaaatgagatcttgctatgttgcccaggcttgtctacaactcctagcctcaaatgcttcccgtcttggcctcccagagtgctgggattataggcatgggacaccacacctggcccagacataactatctctaacatgcattcatgtggcagaaatcaaattagtaatttactatttgaaatgtagtagataattagttatattgttattataacatgaaattatttcccacttataaagtatctacatgggaatgttacagattgtttgatattaaatattctcatagattgctttcttagaaatttggacaaactcttcgtctggaaataagttgcattataaacagtaaaggtggacatctatctcttgatgattttttttttagtcgttctctattcaagctttaaaaatatacttttggttactgtgtaatatttgttacatttttgtgtttttatagtataccataattgaagaaaaatgatggaagagagtggaatagagacaacaccacctgggactcctccaccaaatcctgcagggctggctgctactgctatgtcttctacccctgttccattaggtacatgtagttgtctaacatctcgtgtgttttgagaatagtgaagatactatcatcttttctcagagtcaattaagaaaagaatgcatatattaaaacttctctattatttttcaggatgaaaggaaataacctttttaatttaaagaatagaaagaaagtcttgtgtatttaaagtaagaaaacatcagtgttttgctttaggtggacttttgttctttatgttcataattttaccatcatttatattatggcagaaatatcctaaaaagcatgtgttagctttgtcttctgttctttttcttttttttgagacggagtttcacttgtcacccaggctggagtgcagtggtgcgatctcatctcactgcaacctccgcctcccaggttcaagtgattctcctgcctcagcctcccaagtagctgcaattacagcactcaccaccatgctcagctaatttttgtatttttagtagaaatgggatttcacaattttggccaggctggtctcaaactcctgacctcaggtgatccacctgcctcagcctcccaaagtcctgggattacaggtgtgagccactgcgctcggcctactgctctatgactttgtggtgattaacctttctgagccttcagggcataggtttttatgctcaaactagggatgaaaaatcgctttattttattaaaaatacaccaaaacaaaccaaaaagcaaaaatgaacaatgccataggttcatacagctgcttcttttacttatgggagttgaaagtcatttacactcaattatatttgttgtatattttaaattacacattttaaaataattcttgggatatgctttggtaagttaaaaattttgcaagaagaaagtaattagacagtttgaaaactaaataaaaaacatttctaattctgtgcttttatcctctccacttttttctagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtaattctttctgatactttgaaatacatggctattaattaatgttttattcttttttaaaataatagctttgttgagatataatttatgtactctacaattcacccaattcaaagcatacagttccatagttagtttacatcagaattgtgcatcccttgtcgcaattttataaccttttcatcactttaagaaagaaaccctataccttttagcagtcagcccctactgtcccccaaatcctcacagctctaggcaactactaatctactttctatgtatatggatttgcttatcctggtcatttcatatagatggaatcatataatacgtggtcttttgtgactggcaacttttacttaaatattttcacttaaatatttaacttaaatattttcaaggttcatccatgttgtagcatttgtcagtacttcattccttttcatggctgaataatattccagtttatgaatatgtataccacatttcatttattcaattaatcagttaatgttgggttgttttccactttttggctatttagataatgctgctataaatatttgtttacaggtttttatatggacatgtttttatttttcttgggtgtctacctaggcatggaattgctgatttacatggtaattctacaccaaactgttttctaaagcaggtgtaccattttaccttcttattagcagtgggcggggtcccactttctctgcattaatgttcttctctttattcatttctttggtttccagagttacctatttcacatttttgccatttaaattattaaaataaggctggtataatttagtatatgatttttttatgtgatatacaactcagtagatgattagtatatgggatgtcagaaaattccaaaattttgtcctaatatttgtgcatttatagagaaatttaaaggtgaagtctgagtttttttaagttttactgaaaaaattatcaggactgactgttccagggagtagtgtttttttagccaggtaaaaagtcagaaacaaataaaacctcatgtatgccaaaagtttgtgatactgggtcatttcctttccctaggtcagttaaatctacttgttttgtttctttggaataattgttgcaaatgagttatcaaaacttcgtccttgtcatcctctgcctgttgtttctcattttagggaaaagcagtagctttgctgtgctttttattatctatctttccctgtctacctttacaaatgaaaattattgcagagtgcaagtactatattcatgtctatgtatatgtgaattttctttctgagttaacatgaagtatatagagtatgtgtaataattgtgtgcttttttgtgatgaacttcagtgctcaattaattttatggattaaagagacctgaactacagccgttcatatccaagtgctgaataggacagacctgaagaacttttggatatacgctttttgtccattttcaggatacttggtttaagactatataaagggaaataaatttcttttgaaattctgtttaatttgcgttttataaaggtttgtgttaatctttgattgtataactcagtcttcaaatgcctgaatattaatattaaagttgtttgagccactcctttttataggaaaaagtttatggaataaattatacatatgaaaatttttgccattgattaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaaggtaagacgtgtttaaaaattatgtttaattttctaattataaaactaatagatattcattagagaaaatattgaaaatacaggatggcacaaggaaaaataaaattcttttttattagcagttttctgtagctgctctcagtctcttgcctatgcatatctgtgtaaacgttcctttgaattaaaatcaaattgaagtagtgacaggtcagatggatactatttcatgttttctggtctttactgagcatatatcatggatatcttcctggccgtaaaatatttttttcagaaatgtattttggtttctcttatggctgcttcaccatacatgctgttgcatttatttcccgtgttttattttgctaatctgcctattggcattttctaattgtaattattttttttaaattagttaatttattttaattgacaaaaattgtatgtgtttattatgcacaacatgatgtatacatgaagtgtgtatacattctggaatggctaaattgagctgattaacatatgcaatacctcacatatttaccatttttttgtggtgagaaaacttaaaattttgaaatataaaaccttatatttcaagaatataatacattgttcctaactatagtcaccctgttgtacaagagatctcttctaattgtaattcttatcaataaatcatcatcatgattaggtctggcatggtgcctcatgcctgtaatcttaacactttgggaagcccaggcagggggattgcttgagtcgaggagttctgtatgagaccagcctgagcaacataatgagacccagtctctaccaaaaacttaaaaaaattagccaggcattgtagcgtgtgcctgtggtcccatgtactcagaggctaaggtggtaggattgtttgagcccaggaggtccaggctgcttgagctgtgatcatgatactacattccagtctaagtgacagagtgagacactgtctcaaaaaaaaaaaaaaaaaaaaaaccaaaaaactatgatgagcactgttgtatgtaaatctttatggacatctttttttcctccgaattaattcctgatgaacatttgagtgaacatttgaagaaattgatacctattccacttcaggaggtttataccaaaatacactggtataacatttttcactggccagcagtagttattaatttggactagggtattttctgatttgacaggcaaaaaataataccacattttaatttgctttcctttgctactgaatttgaacattttctcgtatgatttttagccatttgtattcttcttttgtgaaatatcggttatgttctttgcctagttttaaattgggatgattttcttttcttatgaatttgtaagagctcctaatacagtaagaatacttttctatatgctctcatatgttgcagttttctcaatttttagtttacattttcattttaataccctttttgacagaaaagttcaatttcaggagtcagttctgtcagtcttttcttttcttttttcttttcttctcttttcttttctcttttttgagacaaagtctcgctcttgtcgcccaggctggagtgcagtggtgcgatcttggcttactgcaacctctgccttctgggttcaagcaattctcctacctcagcctcccaagtagctgggattacaggcatctgcctccatgcctggctaatttttttgtatttttagtagagacgggggttcaccatgttggccaggctggtctcgaactcctgacctcaggcgatctgcccgcctcgcctcccaaagtgctgggattacaggtgtgagccaccgcaggcagcctctctttttctttacatttttttttaatgctaaaaaagaccttttctcactacgatactgtgataaatgttcttctgtgatccctttctagttcccttaatgtttaattttttagacacttagcgtttaatatagttgatatttctttactatatgaggtagagatcaaacttaattttcttccagctactcaatggagtatttcaatatcatatccccattgatttggtatgatccctatattatcttccttaagaaattgtgtgttaaaatcagcttctggcctctgtattctagtccactgctgtttccctgttcttgtagtagagcacactgttttaattacttttactttgtgttcattgtactaacgtgtactgaggtggggatgtggaacattcagtgataagtaagataggacagttcaagtctgcatttataaatgtatatcagtatttagttgtgtaagttgtataagctggctgatttttcttttaaatttttctttactcatctttcccaattttttttgcaatgaattttgaaatcattctgccaagttccaatattctgctaagggtttgtttgcaattttattattataattataatttattattatattaaagatttaaaattggtagatgattggctgatttgtagtatttgagcttcatgtttcaggaatgtggcatttttctaagcttgtttattttttaatacccctctgtactttttaaaaaagtttttttttgcatacagactacaacattttgtccctcgttaagagcatgtgtcagtgtgtttgtcatgagttgtaatacccagttcaactctataggtcttgtaaatagtaagtcatgatgtttcagcatatggttggttggcagtcttaaatttcaattttatgaactcatcttttcctgagtcaccttagtttaatggcagattggaagatggggaatcatggcaggttagtcagatgccgtctcaggaggcactgctccctggagtgtcttttaccgtttgtgaagtatcgcacaagaaggaatactcaagacttggttccttttagtagtaatggctctaagaatccagaggaatagatctgaatataaatggcgagtttgggaatgtacaaaacaagaaacaagaagtaggaaaaagaagaaactagtagaagatagcaaaatgttgtacgttaaggtaataagtaactgttctgcccccagacaagaggtgtttttactctttttattttttttattagggaacaagtatggacttacgtagacacctgattgggacctttatttgggaccctaagggacaagttttgcccaatcttttatataaataagtagaagtgaaattgtatatatgtatatacacacacatatatatgtatatatagtatagcatcctttccatacccatgctactcaaagcgtgatctgtagattgctgctggtctacacactgctgagtcaggaaaaaaaattgagagtatcatttagaaacttaatagcaatttgatattgtcatgaccttatatatcttacaaaagtactggtttaggatgcattggaaacttttaaaaaagttttcttcacaatcatgaagatcatggtgttcctcacttagagtgaatacttacatattgatttgttttatgcagggtgtggctgggaatcctatggtgaagtctgtgcttgataagacaaaacattcagtagaaagcatgattacaacgctggaccctggcatggctccctatatcagtatgtacataagttagaccggtatctgccattttttttttaagggtatgtccacatcagccactaattgtaattctctgttcgtttccactgattgtgtaatcagtggaaattcttattatattcttgcattaatttaattgtcagtcttattttttggtgttactaattcatcttttttaaaagtcattaaataaattttgaaaatcccacagaatgatcctagaaggagtaaaaaccatgaattattggtatacttgctgattttaattttaaatataggttagcattgctttatatgaattttactttattcactactgacatttgaagtgatgtttgtttcatactttttttttttttttacatttctcctgttatctattttaattaaatgtttgtgtgtaattgagggataatatttttggaggaagcaaatctagttaataatatctaatgactgggtatattgggaaagctatttttaaccacctctgaacactaatcatccagaatcatccagacagttgatagatactgtctgctatttaatttttatgtacatatccaatatgtgaaaaaatatcacaaggcttagtgaccaattattagtaattctgtaaaagataacttttaagtcaaaattgtgcagcaggtacctgaacagcgatttcagtggcaataaaaagccaatagctttcacaagtcttgactatgttggtagtttactgtctagtaaatatcaaaagataaggcctagcaattgttaagtgtctttattgaatgcttctgccaggcactttctcataagagctctgcaaggtaggtattttcctcaagttttggacgaggaatctaggtttggagggatgtaagttatcaccctagatcacacaacttggtggagctgtattgaactcatgctcaatttttttacacttagccactttgcttcccttgtagtagaaaattgaatcaagcattaaatcaactgagttgttctttgtgtttgtaactgtccaaagaattcaaaattggagtccaccatatatgttcttttctttgcaagtacatattttgaatgaaggaaaaaaaggaattaatatttttggagcttttgctgttttaatggctgtactatgttagactatgaaagcaattaccttatttaatccttagagcaaaccctatgaggtgccaggtgtttttattcttcttcttctttttttttttttttttgagacagagtctcactctgtcactcagactggagtgcagtggcgtgatctcagctcactacaacctctgcctcctgggttcaagttattcttatgtctcagtcttctgagtagctgggactacagccgtgtgccaccacgcccagctaatttttggtagagacggggtttctccatgttggccaggctggatagcaggcatttttctacaaagaaacaagctcggtgacttccacaaggtaaagaagctagtaaatgataaaggtagagccatcaagaaaaatgtgtaacaccgaaggggaaaaaagaaaggtacagaaatgaaatttctattattagcaaatgtcataactttatcagctttaaaaagtaataaaatcgaatttaagaaagctgacatctttactgacagcaaagcatcaccattctgatctaacaaaacaactcaaagtaaatcttaaggtttttttttttgttgttttttttttgaggtggagtctcactctaccgccaggctggagtgcagtggtgcaatctcagctcactgcaacctctgcctcctgagttcaagcgattctcctacctcagcctcctgagtagctggacctacaggtgcacgccaccatgcccagctaatttttgtatttttagtagagatggggtttcaccatgttggccaggatgatctcgatctcttgactttgtgatcctcccgcctaggcctcccaaagtgctgggattacaggcgtgaaccaccgcgcccggccatcttaaggtatttttacacaaatattctagaaatcatttgatgtaacaatttcgtatgtgtcaagaaactcaaaaagtattagaaatggcaggactactcatcacaagctgaaaagccattttgagctgaagcttaatggagcagtacttagctaaggtcgagagatgtgtcccatgtggaggaaaaaagtgaaaaaaaaagtatattcttcttctcttttatgtcctagtaacttctgaagtatccagtacagatgtgatctgtgagacattatgtcagtcaggaaaaagggatccattatttttaaaacccaaatatttgaaaatatctttcactgttccacatgatatttattagggaaaaacaaccttgtttctagggcaaaatgttttacattataaacaattttcatgaaaaatctcttttgccggtgataactattaatgccaaatatcaaaatgtgctgtgtttagaacaagggctttgaattcattatatcacagaaatgtttggttaagatttttaaaaataatgaaacatttggtcaaattggtctgtctagaaatagtagtacttaggttgtttaagtaattgaaaaattaaaaatatttgaaaatatttttatttcgtattactcttaatattttaaattttaagttttatgtgttatttcaatttcatatatgcttgcatatttatattagggcagtagtacatgtataattgataaatatctatttgtggtgtatgctcagaacattgtggggatatttaataaaaagcttgatgaccccatatttaaactattttctaggttaaaaagtatatttcatggtagtgcttgtttagtacataacttctctgcaactcattgacaaatcacttactatcagtaagtctttattttaattttccgtggagtatactaaatatgtaacttacacttcacaagccagatatgtgatttctggcttgtgatatgtaatgtcagttttgagtcctgacattagtgctaagtagatacgttaccttgggcaaaactttgttggcctcagttttctcaagcatataaaaaagataatgatctatatcttgcatggttttatgaaactggtaataattatgtatattagatgttagcacctggtatggtagtaattatgagaattgcattattttaatttgaaagttaaattttcctctggtctttttagaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaagtgagtaacagaacaccattttcaggacatggaaactggcatttaattttttcacaattctgataatctgttgtctctatggagctaatagacttttacatactgaaataacaatgaactttgcttttagtagacagccctatcgtattatgaagatatagtggagttttaatttaaagaaatttaagataggttttgattattgtgggagggaaagaaacattgagagagcacaaaaggaatagttagtcctaaaagagatcttcttaatccagcattaacattcaaatcaattactgagatgataatatcccttgaatcccataagcttttattatccctattgataatgcttaaaaatatgtaagttccaggaattccgtcctctctttcatactttattttcctctctttgtgttattaccagcatacagtcatgcaagaacaaattaacagttcattggcatacaaacatctttctcaccttgaaaaaaaaagaaaaaaccaaaggaaaccccaacaaattctttgacctcccttcctctataacttaatgacctattttgcttccttttgcagctaaactccaaggagttggcagcacttttctcatatccttttcacattcagttaagtctacctcagttaggctttgatgtccagcactctactgatagtgctttcaggctcgtgctaatgttctccatcttattggacttaccagaggcttttgagacagttgatcatgcacttctctttaatgcttttttcacttgatttctaggattccacactttagtttttccctccttcatgtattgctcactccttctgtacttcctttgctgattcctcctcttctctccagtcttctgacggtcaccttctcatcaattcactctcagactatcccatggctttaaatactgtctctgtgctaacagttccaaatttatatctccacctgagaccttcctgtagactcttgatttatatataagttgcctttttgacaagtttacttgaatatctcaaacttaatatgtctagaactaaacttctttcctccacacttgctccctctagccttcttcaccttaattgatggcagttctagccttccgttttctcaggcaagaaaccttggagtcagccctgacttctctcattacccacttctaatccatcaagaaatcttatttgtaagacagacagttcttgtttttcaacataattgtgttccataaagttgctacagactgaatttgtgaatactgagccattgctcccaggggagatacgatggttaggatggttaggatactgtgggcctctggtcacattttgccaacctgtcaatacataactttgttttatgcctctttctgtttaaatacatttttatacacatacatgcacatatttttgattcattaatattgaactctcacagtcaacagtactgtaactcatgcttgaatgcagcttatttaacacactcgttttctcattaaggcacatcattgtcttcttgtgcttaggaacactacagcactccagcactacacttgggggccatttgaaaacagcagttaacatcaacaaacacaaagatgcaaaaaagaggtgctaaatagatcccaaaaaggatacctgtttacattgtgtcagctgaaagaagaagtcagggcactgccttgttcagcctcagctaggagtgtatgcatcaggcaactcaaatttctcatagctctgtgcatgtccgattttgagattataaataaatttcatgtgtagtcaatggaatccacaaaactaataggatcgatcaactgtatttatgtttaaggagaaacacattttcatatatgacattctgttgttttatttgaaggagcttataatagcctgcatttattgagaacatcccctgagccaggcacatagaccctttacctgcattcatttgatgtgtgtaaagcattagaatgaggtaattgacatagcatatttcattggggaaaaagtctgttgcattaattataattagtcactaaacacaaacccacactgacactagattatttttaattctactaggtagtgctacataagtttgaggtgttctttgagttgtatttagtactttatttaaatagaatatgaagcccttttcttttacacatatgcatactcacataccacaaaaccacttttctatattaggggctattaggcagtagttataccctatctaaatgtaatgcattatatataatatgaattaaattacatgttttctgccttttcacttttcacagtggtctgtccttacacacagagcaaagctgccaaaagcacatgcactttgaaatgcttcttttctctagtaggtttctcttgaatttgagccctagtatacattgccaataagagtttctttggtggtaggtgtttggacttaataaaatttagcaaaggtaactgacggctgtagggtttgaatttaatctagaaatgaaaaaaaaatacagcaaatgggtaaaataagtatgtatacatgataattgtacattaaactagttgtatatatataagataaaccataagcattcatacgggcgatttttacttgaaagactggaacaagtcacatacttagattgagaatgtatttgaagatttcccaagaggttttgcaagttggaaagagtttataggtctgagaaagaagacttttcaagatttagttgcagagagtaaactgaggaaaatcctaagtagaaatgattattagacaaaatggtgagtacatttcactgaaattagagactaaaacaagggatttctgtaaattgtgaagcattgtataaatgtgatatggaagttggtaaccttatttgatggaaattattgtagttgcatttatctttttataatagcatttgacagattatttttgctgctgatttttatccttcaaatttacaaatatgaattcattttccacaattttcagttcaagctcaaaactaaaattcattgaaactaatatataagaaagtgatttgtaaatttgtcggctttttattttttttcagaaacagtagagggagctaatgagaagaaaaataatgtagagtcttagagtataaaatggtaacctgtttttgttctccccaatcagattttatttgaagtaaatgggttttctgaactaaacttacgttaccttttaaaaataggaaattatttaaggaagtaaatcagttcagccaaaattaaagttaggaagcttctagaacttttatgccaagtattaactttattgaaaagccagttgtagttatgactactgttttatatagttttatattcaacaaatataatatctataagcatttatgaaaatattataaaattttaactattcactgaaccaagttgcttagtataagctcttagagtacaatattgttcttcagttctgaaatgattattttaatatggtctctaaactacctaattcttgatctcttatattgctaaaaaataaaatctccttctcaaaacattggtagggactaatattaaaatgtctgtatttgtaactccaaaagaggccacatttaattaatgtagtggtcagaggaaaaagaaaggccagatataaccccattttcattttcttatggattttataaacaaaaaagaaatttgtctacctagcttattatcctgtttcttgcaggaactaattaattttaattaaatgttttgtgaatcctgtgaaatataaagctctgtgctgtaggatagtgaaaaatgaacaaacttagtctctgttccctggaagcataaaatctaggaatattttgttgtagtgcatagctgagatatcacctgcaaagagttaggggatgaatctctgtacatcttactaatcccttaatagtttttacggaatgaatgtttacttaagctttttaaaaatcaaactttagccataactgcttcctgggaggagtgaattaggcaaatttgtaacatctggtataaataactaagttcatcttatctgttaatactgctttcaaaatcaacagctgcctctttaagtgttattagatttggtgatgccatatttacactatttgtattcttaacattgaccacataggccttcagaagcatttatttttttctttgttcagttttttatgtggtaagttcttattgaacacctattaagttaggcactgtgctggaaactagagatagaagagtgagcaaaaatatacaatcttggttttattgtactttaaatcctatcatcttcatctttacaagctagtatcttaaattatcttacacgttctcgcacagttgtcactttctctttttcacttcagttgtctctgaaataaattgagttttctcgagatgtgtcctagccttcttaattttcatttggataagaatttaccatttaatctgatattgtctgtttacctctgctgtccttataaaaattatccatggctacttctgttcagacttcttatcttgcgttttgaacacatattcatcacattgttcatggtcaccttttatgaaaggattcagataaaagcaataaacagaaaccttttccctcagtcatccagcttttagttttctattacatataatcagttcatgtcttcaatggtaattattttgttgaataagctgtggtgtaatgtatacatttgcagctttttattttaagtaactggtcattttggtgcatgtatatttaaaaggaatcagaagaaagagaaaaacatatttattattgatatgattgcctacctgaaaaattcaagagagaattaactgcaaaactgccagaactgataaaaactttgtatgtagtaagatggtctcttgccagatcaacattaaaaaatacagttttcttaaattatttaacagtaacaatcaatgagaaaatgtaatataaaaataatccacaatagcaaccaacatcataatgcatatggaataatttggaaggtgtaccccaaactgttgatactacggaaatgtaattgtattttgtcattttttactctacatttttgtattgtttgaacgtttacagtgagtatatatatgtgtttgcatataaatgtatgcatgtattgtgtaatcataaattagtatatttaatatgtaataatttgaaatggtctctaacctctgccattgttgtttagggtgctcaggaacggatagatagcttgcgtcgaactggggtgatccatgaaaaacagacagctgtgtcagtagaaaacttcattgcagaattgctgcctgacaagtaagtgtattatgtttctcttggaagcaaaatataattgggtctgggagttgacactgaatacttagcaaaaagtgtctcctgttttataaccagagagaaaagtatattttgatgctggctatatcacttaactagctgtgtgtcctgcatggcttagctggcatttctatccttgtgtctcttttttaattataaaatggagatggtcatgcctgctttctgagatcatgctaataattaataaaatggcactaagtataagatgatagatttggtgtggatataattgaccatgagtagcaaacacaattattctcatagttattcaaagtcgtggaatatatgggcaagaaggcctgatggcattctctaggtttgagtttctagtgagcagtatctctcctgtactcataatagtttagaaaaacctccagacagcataatttatcattgtttttcaggtggctttttatgggaaaaatttttaatttgcttaattgatttatattaaaataacttccctttgttgaaatctaccttcttttgtatttgcattatggttttgttgtttttattttttatttgtttgttcagtgttgaataacaatgggcatagcattttgtggcttgtaatatgcaaaatatatcctccaactttgaggcatattataggccagtgggaaagaagatatatgtagtacacagatgagcagttttaagtaattgtaaaacggaaacataattttttgctgacaggaaatatataaaatttcagtggaggtaactctgtggagatagtgtcaggtgaaattcatgaataattagggcttgaactggattttgaagaagaggtgaaacttggccaaatggaacaaaggaagtaggatgttctgggtggagaaaaagtttgaaggtaattgaaatgtattcttgggtcagtgattatatcaacttggctgaaggtttgttggatgggaaatcaagaggtgacgggacaaattgtgaagagctctgaattctaggttgataagtttcaactttctatgtaagcactgagaaaccgtccagtgattgttgtgtcatttttttttattaacctgttactgttcatttaataattaacattagaaattacaatatgcctttttgatataacaaaaattataacttgtgataatactagtactacttttaatactattcactcccttttcaccttttgcggtatcattgttaagtattttaattctgcatatattttaagctcttaagacataactggtaatgttctttgcagtcagtatttgtttattctctgaattctttcttgcatttctgtttttctgtctggggtcatttttcttcgaaaggaagcctaaagtacttcctttgataatacattatagttcagagctgctcactaccaattctctcagcttttgtttatctgaaagtgctttaattcacctttatttttgctggatgtagaagtctaggttggcagtttcttttctttcagcactttaaaaatgtcatggtactgttttctggcttccgtcatttctgttaaaaagtcatctctccataaatgttttcttttgagaagtgtctgttcatgtccttcgcccactttttgatggggttgtttgtttttttcttgtaaatttgtttgagttcattgtgattctggatattagccctttgttagatgaatatgttgcgaaaattttctcccattttgtaggttgcctgttcactctgatggtaataggagtggtgagagagggcatccctgtcctgtgccagttttcaaagggaatgcttccagtttttgcccattcagtatgatattggctgtgggtttgtcatagatagctcttattattttgagatacgtcccatcagtacctaatttattgaaagtttttagcatgaagagttgttgaattttgtcaaaggccttttctgcatctattgagataatcatgtagtttttgtctttggttctgtttatatgctggattacatttattgattttgtgtatattgaaccagccttgcatcccagggatgaagcccacttgatcatggtggataagctctttgatgtgctgctggattcagtttgccagtattttattgaggattcttgcatccatgttcatcaaggatattggtctaaaattctctttttttgttgtgtctctgcctggctttggtatcaggatgatgctggcctcataaaatgagttagggaggattccctctttttctattgattggaatagtttcagaaggaatggtaccagttcctccttgtacctctggtagaattcggctgtgaatccatctggtcctgtactctttttggttggtaagctattgattattgccacaatttcagatcctgttattggtctattcagagattcaacttcttcctggtttagtcttgggagagtgtatgtatcgaggaatttatccatttcttctagattttctagtttatttgcgtagagttgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctactttctcttgtgggcatttagtgctataaatttccctctacacactgctttgaatgtgtctgagattctggtatgttgtgtctttgttctcgttggtttcaaagaacatctttatttctgccttcattttgttatgtacccagtagtcattcaggagcaggttgttcagtttccacgtagttgagcagttttgagtgagtttcttaatcctgagttctagtttgattgcactgtggtctgagagacagtttgttataatttctgttcttttacatgtgctgaggagagctttacttccaagtatgtggtcaattttggaataggtgtggtgtggcgctgaaaaaaatgtatattctgttgatttggggtggagagttctgtagatgtctattaggtccgcttggtgcagagctgagttcaatttctgggtatccttgttaactttctgtctcgttgatctgtctaatgttgacagtggggtgttaaaatctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgcctttttttgttttccatttgtttggtagatcttcctccatccttttattttgagcctatgtgtgtctctgcacgtgagatgggtttcctgaatacagcacactgatgggtcttgactctttatccaatttgccagtctgtgtcttttaattggagcatttagtccacttacatttaaagttaatattgttatgtgtgaatttgatcccatcattatgatgttagctggttatttttctcattagttgatgcagtttcttcctagtttcgatggtctttacattttggcatgattttgcagcagctggtaccagttgttcctttccatgttcagtgcttccttcaggagctcttttagggcaggcctggtggtgacaaaatctctcagcatttgcttgtctgtaaagtattttatttctccttcacttacaaaacttagtttggctggatatgaaattctgggttgaaaattcttttctttaagaatgttgaatattggcccccactctcttctggcttgtagagtttctgccgagagatctgctgttagtctcatgggcttccctttgtgggtaacccgacctttctctctggctgcccttaacattttttccttcatttcaactttggtgaatctgataattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccgtcgctttcaggtacaccagtcagacgtagatttggtcttttcacatagtcccatatttcttggaggctttgttcgtttctttttattcttttttctctaaacttcccttctcgcttcatttcattcatttcatcttccatcactgataccctttcttccagttgatcgcgtcggctcctgaggcttctgcattcttcatgtagttctcgagccttggctttcagcttcatcagctcctttaagcacttctctgtattggttattctagttatacattcgtctaaatttttttcaaagttttcaacttctttgcctttggtttgaatttccttctgtagctcggagtagtttgatcatctgaagccttcttctctcaactcgtcaaagtcattctctgtccagctttgttccgttgctggtgaggaactgcgttcctttggaggaggagaggcgctctgctttttagagtttccagtttttctgctcttttttccccatctttgtggttatatctacttttggtctttgatgatggtgatgtacagatgggtttttggtgtggatgtcctttctgtttgttagttttccttctaacagacaggaccctcatctgcaggtctgttggagtttgctagaggtccactccagaccctgtttgcctgggtatcagcagcagtgtctgcagaaccgcggattttcgtgaaccgcgaatgctgctgtctgatcgttcctctggaagttttgtctcagaggagtacccggccagccgtgtgaggtgtcagtctgaccttactggggggtgcctcccagttaggctgctcgggtgtcaggggtcaggggcccacttgaggaggcagtctgcccgttctcagatctccagctgcgtgctgggagaaccactgctctcttcaaagctgtcagacagggacatttaagtctgcagaggttactgctttgtttttgtttgtctgtgccctgcccccagaggtggagcctacagaggcaggcagccctccttgagctgtggtgggctccacccagttcgagcttcccggctgttttgtttacctaagcaagtctgggcaatggcgggcgcccctcccgcagcctcgctgccgccttgcagtttgatctcaggctgctgtgccagcaatcagcgggactccgtgggcataggaccctctgaaccaggtgcgggatataatctcctggtgcgctgttttttaagcctgttggaaaagcacagtatttgggtgggagtgacccgattttccaggtgccgtctgtcacccctttctttgactaggaaagggaactccctgaccccttgcgcttcctgagtgaggcaatgcctcaccctgcttcggctcgagcatggtgcgctgcacccactgtcctgggcccactgtctggcactccctagtgagatgaacctggtacctcagatggaaatgcagaaatcacccgtcttctgcgtcgctcacgctgggagctgtagacaggagctgttcctattcggccatcttggctcctcccacagtagctcaccatcactggccatcagagaaatgcacatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcggcactattcccaatagcaaagacttggaaccaatccaaatgtccaacaatgatagactggattaagaaaatgtggtacatatacaccatggaatactatgcagccataaaaatgatgagttcatgtcctttgtaaggacatggatgaaattggaaatcatcattctcagtaaactatcacaaggacaaaaaaccaaacatcacatgttctcactcataggtgggaattgaacaatgagaacacatggacacaggaaggggaacagcacactctggggactgttgtggggtggggggagggatagcattaggagatatacctaatgctaaatgatgaattaatgggtgcagcacaccagtatggcacatgtatacatatgtaactaacctgcacattgtgcacatgtaccctaaaacttaaagtataatttaaaaaaaaaaagtcatctctccatcttcttgtgtattgtctctgtgaagataatatgttgttttctctggctgcttttaggattttctctgtcgttttattttttgcggttttagaatggtatgattatatgtatttgcttgcttgctctcataattattttttgtggattcgctgagcttcttgattctgtggattaatatcttcagttttggaaattctttacaattatgtcttcaaaacttgcttctggcccatttctctcccttctctttgtaggaccttaattacatgcccattcacctttgacagtgtctcacattgtcaggttttttcccccactctttttttcctctctgttccttagttttgacattttctattcacctgtcttcaggttcactaatcctgccttctgctgtgtccagcctgttgttaaactcttacatagagttcttaccttttaaaatgcaggttcaatttatcttttgaatgcctgtatctttaaatgtagttgaactgtctttacctctcttttcttgactatatgaaccatagttaacttttaaatcctcatctactgattccaatatcacggtcacttgtggtctgtgttagtctcctttttccttttggtttgaatatatggtgctgtctctctgaatgcatagtaatctttgaaaaccattgtttagaaaacaaaactctagagtctttaagtgatcttgagaaggttcatcctttcctctataataatatacacaattgtaggggtgtgaggaaggggagggtaatgtagtgtacttcagtcacagtctgagctgagtcaagtctaggtcggtgttctaaggtatattcactggcatcatagaaaaaactttcctcataccttcagtaacactttttaggatgtccacacctgaaagcttggttagtatgttattcaccatagagattattgtctgcaaattatgcaaaataaggcaaaataaaatttagctaagctcgactttatggaggcttcacaaatacattatcttgattgagaaagttgtagtaaaatacaaaatatctattagtctaccaaataaaataaatgtcattatttaatgtttttaattttaaagttttaggatatgaacactatagacattataaagtgccattttagtattcagcaaagttatttatgttactgtatattttactttgttgtttttttgaatgtgtaaataaaagtctcctaatccattttatatttcattgcattttattagatttacattaaaaaataggcattaaacattttcctgcttcatatccttttattgtttaaattcatttttgagggtatctggctgtttcatgatttgggttagctaaaatttgggtggtactacagttgttttcaataaagtcatttttaaaatttatcattttgtatgatatataagtctctttaaatgaagagaagtttcctggatttcatgaggctgttttcaaagactgactcattgtgaataattcagaaattgtgattagaaggatttattattaatgaagagagtatttgttattatttcctctgagcttattttttaatttgttagtaacttagttgagtacatattcatgatagagtttgtattataaaatttcccatattttagcaagtgacaattgaaaaatattactcataagctgtttgcatattcaatgtatgtaaatttacctgttgcatatttgagtacccttactttgattattctcccttcccatggagaggaagctttccatgataagtatttttaaattttttttctttgtggttattgtcttttttcctcttagaattaatacaattttatctgttgtttttatgaattgtccttttgcaagttggtaagaaaaagatttcctttttgaaatctgttctatctgaataatagtacttgttttttctttttgtctattcatgataagttttatttggcatataaaccatttgaaactcgtaattctgttgcagatggtttgacattggttgtttggtggttgaagatcctgtccatggcattcatctagaaacatttacacaagccacaccagtgcctttggaatttgtacagcaggttggttttctcctttgctttttcattatgctccagagaaacttacactattgttttcagaataaaaatttgttcggtttttttgttagaaatatgttcttgattttgtttcagtcatttttcttttagtatttttctttgctttttaatttcctgatccttccatgttgttttagtaccttcctccttttgttttccaggtgtctttgaaaggtaatacattacatggttaatcattatttctctcatttttttctttgtttttactctgagttctggaaaagatttaccttttctagttgttttatgtccgcctttcgtttgctttcccttttatctcacatttcatttccactgttatctccatttcccttttccttgattgattgtcctcctgttcatctttagtgaaatcaacattagaaaccttataggcacgtgtctttaggtttttggctgaaaaatggacctaatagtgtacctatccacacagtttccaggagaatgtaagtataaatgataatccttattcctcttttttttttttttttttggtgtgttttctctaatcctttcatgaacaaaatggaatataaatatatacttgcattggaatctctgtgctcttaagtggtattctattgacttttttctgtcaatttcataaaatttttgttacagttgtagtttgtacattgttaaatatcatttcaaaactgcctttcaaacttatttgggacatgaagacatttgagaatctaagaaaactattgggctgtctcccaagaaaaatgcgtgtatgtgtactttcatagaactttggcatatgtgttcacataatccctaaaagtaacctctggcctacttattacagtttagaaagggggctaagaattgatgcttggaatttgaaattttactgaaacttttatttataccgtaatttcttttcataagttcaagaaaacctttttatagatattaacattacactcatttcaatatgaaggtgattaaaagactgtaagtgaatactatgcatactattatgccaataaattagaaaaattaggtgaaagagtggattttctaggaaaatagaagttttgccatagttaagagtattaggttgaaccaaatgacgttgttgcctttgatggtcagaaatagttatatattgtcagtttcatatgattcagcttaattgaagcattaaaatggaagaactttatgtaactaaaaaaaaaaaatcactgagtaccaatggtgttacaagtgagttctacaaaatgttcagagatgatttgctgtatgaggtatcaaaaatagaggtagagagttttccagttcattctgtgagactagcctcttttaactttaaatgaaattatagtccaaagaactaaatgtcaaaaccattggtaaaattaataaataaaattcagaaatgtattagatgaacattgtatcctgaccatgaaaaatttgtcccaagaacagcagaatggttcaacaatagtaaatttatgtaattcagtacatgatctgcattgaaaggagaaaaaagattttgataagagttgaaggtatttgctagaaataatcatactaatagctcttagtattagacgggtatgtgtgtactacaaaatcaaagcaaacttcagatctaataaataaaacactgaaaacgttataattatgaggatgctcctgtcactgccactgttaacattgctgtagatctggggtcagcaaacagtggctcacagccaaatctggcctgtcatctttttgtaattaagtttattggaacacacccatgccagtttgcttacttattgtttatagctgcttttgtactatagcagcagaaatgaatagttgcaacagagaatgtctggcccacaaagcctaaaatatttaccatctggctcttttcagaaaaagtttgctgacccctgtgttagatatctgaccattgcaaaggacaatttttatgttgtttttaggaatatatactggaaagaagtagacatgaaagaatgaagtggactcgtgtgtaccagtaccaaaagatagctattacatattgctgagtaaaagtcaaaaacagcacatctagtatgatcccatttactagcaggcgtgtgtatgtgtgtgctttaaaattttaataagaatagggaaaaaggcctggaaagataacatagcaaactgttaatagtggttaattctgaataatggtatttaaagggtgttatttgctttttactttgctttttattctgtttgttttattttgtgtcatttggttttaaaatttagaagatacaaaactgtgtgcattgaaatgtcttctttttatcctcagctattcagctctcctccctgtttctttttattcattctaaaatgttttatgcttttttattgttggaattttttaatttaaggtaatggaaatcagcccttcaggtaattagaattatcagtatatattagtaaaaatctggaaataaatttcatacaatttgtacttgttaaacttaaatataaatgattcctcacccccataaaaaaccccagctgttctggatttttgccaataatatagaataccttgtttctaaaaagtgtggtccttggcttaacatcataagcagcacctagaaatttgttaaaatgcagattctcgggtcctaacacaggactagtgaatcaggagctgcattttaacaagatattcaggggattcataggcatgccataatttgagaagcacagtgttactggtgtctctgaggacgttagtagtatatctgctgtttctctttgaaatatagtgaaatactgatactgtagtatacacattggaagagagtacttagagcaggggttcccaagtgctggactgtttgcatcagattgacttggaagctattttacgtacgtaatactgtactgtttctcttggaaccagctgtagagtttccaattcagttatcttggtgtctcagttatcttagtgggatgtgagaaactggatatcgttaaaaaagaaaaaagaacaagagctcctcaggtgattgtaatacatggcacatttggtagtcatgtataactgtatagatccgttctagatgtggctatacttctctggactatacctaacaccctaaaacagaaaaaccacatcagtcttggatatcaagcaatgagtttattcttctgtcattcctttgtagatgaataaatgatttgaataggagcaaatatgagttgggtcaattaggaatgttgcatcagtggttgatgttgtccaggactggatattacttgatacatattaacatgtgaatcacatttccagagagaatttccataattgagcaattcttttctgaatggatttaagccttaattttcagttttcctctttctggttgaaattttactactataaaagataactttagcactgattttagtaccaatcttattattaacctgaagtgacacttaatttagaactagaactcaaaccttccgactgttagcctcgttaatggggatattttttaaaaaatagatgtgtgtaatgttacattgattgtgttctagccttgtaagttgatatagttggcagcctagctgtatttctcagagtttgtcataatctatatttaaaataacatgaaacactttgaaatgtcacttatagctagttccaatgatatttttaaatgtattataagtaatatcaatttcatctttccacaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcaggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaatatacaaatctatttacagcacaatttaatataccagatttataaggtggaaattcatgtgcagagacatttaacttaatgccatgtacttgattattttgttctttaaagaagagattattaaagaacatgttggttgaatgtttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgttttcagtaatatgggccaaaataatggaattgattattttcctttttggccatcacgtacacatgtaatctggaaaatcatacctttgtcaattttaaacataacttttggcatttcccagatttatactatgaacattggggtaatacattttattttttcattgctatatgacagctaaggggcaaatgattcaagtatattttaaatcagaagtattcaagttatttttgtataatactgttcagtacttccaagaataagctctgacaacagccattgtttctgcttccactcatattctctacacattttaatacagaaatttttgagagggggttactttattgcttgtgggttagtatgtctcttacttcaattaaggttacttatttggtttgccttaagcattacttttttaactttgtgccatttggtctttactttttatggatgttttcaaggaaactattttatattcaatctagtttatttagtctactgtatttctatttagtggaagccttttcccctcaaataatatattttatcatttttggacttatataaatcataattaaataaatttttttcttaatactgttggactttgtatatacaagttcagataactttttcgaagatagtttcttatataaatgtaatttaatttttttactcttctatacagttctttagatgtaaaggaattagcacaatctctggcagttttataaaagctgttgaagctcttgtcctgcactgtctttaggtatcataggtatcaggtttgctttgtgttaatgccacttcaagtcattatttggtttctgctatttttttacctgaggataagaagaatgaatattaaatttgaatattaaatatatgttactttccaagcactgtataatgactgttcagtgaatatcagacttccgtgtcattaaaagtcatgagagacagcacagagaggttataggttgccttggtgtacttttgtccaggagtaacagggacagaatactttctttccttccttcaagtacaagaaggctttctctaccatttgcgtctacactttattttaaaagctatccttttctagtagtattttatcatggcaatggcatgatgacaacaacagtctttcattacagactgaagggaagcatgtccttacttaaaatagttctgctactttccctcctattataaggaaattttacagattctaaaaataccttaatttttctttgatttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagaggaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctgtttgcttttgttctccctctgtcttaggaaaagccatctttaatatagttcttcaccaccgttggggttgttttgtgattttttttttcttccgaagaactcctggttgttattggattttgtattttaatacaaattattgaattttataagcttgtacacaatatttaattagtgtgaaaggaaacaaagaatgcaggaaaaataatttaatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatatatccattcaaaattatgcaagttagtaattactcagggttaactaaattactttaatatgctgttgaacctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttatttccaaa

SEQ ID NO: 12108 - DNA, 37442 bp, Homo sapiens
atcttgtaggcggggacacgccgaggtaacttccagggtgcgccttcgttgtcttctccaagctgtagttctacgtcccgacctccctatcataccacactcttcagcgaccacgcaggcactttcccggtccccaggtgagcgccaggtggctccgaggggcgtgtatgaggggggtggcatggcatggcatggcttgcaggcgccagagccagaccccgagggacggtgtccctggaaggtgggcgggccggccggcgccactggacgccgatgtcgtttgcgagccccctagtcccgtggtccaggctcagctgtggcggcgtgcggggtgcagcaggcaggagtgcacatcgcaaggtgagcagtttccgctggggatggcacggtgggcgcggttcgagggtctcgccccgcgacactttgctcctgtccaaggaccaaggcaggagcgctctggccccaccttccagggcgctgactttaggggagactggcgggagcgccggcggaccttagcccggccctgtctggcctggagacgtggcagagcctgaggggaagccgctgtctcctgaaacaggatttcggccgctctggccctggagaggcccaggaggctcgagagtcatcacaccaggacctgcaatgaaaggaagcttattttccctgaggttaccccatcggtgcttagcgccgcttgggagagtttttgcattctctcgtttctttgtttggtcttgggacctgcttcaggcaaatttgcagatagcacgtttcctagattgacagaatttatagccaatagtgtttttgtcattcgaagtagttattttgagagacaacatgtgcatttctgcgatcgtgacacatcttggcattcagtctttctcctgtgcagccagtgtttaattcagtgaaaatttataaaattttatttcggggtcagattaggctctaactagcgctcactgtttggtagtagagacaatcttgtggcacgagtaggtcagcaataattgctcttaatgctttaaagtttatcagagcttcactcttccatttcttgtaaacttgtaaatagacatccactttttttttttttttttaacagaaaaaccaaggcacaagcaaattggaacaacagggtctagccggactgagaactcagttttccaaaccattttcttcactttttctttagtgttgatatatgaatagtacttttcgtgacaagacttgagccctaaaacagttaccaactctgacacttcagtattgttttatcataataggtttttttagtagaaggcactatgtttatgcatgtaaaatttacctcagtattgccattacggcagttttcatataaaaagccattaaagacaaagaaattgattatttattccacttaatgactttgtattcattgtacagtttcttttgcagacacatttgttaatgttagggattctcttacaataggacttctactagtcattgtaaggattggggagcatctgtagtagagggtgaatgaccaataaaaaattaaatgaagaaaagagggagctttggttgaggagtggtaaaatctccaaaggggcatttctatctcaggttatttaccttcgatgtataggtactgaatgaaaggattcagcctccccggatccctgttctctgcttagtgccatagatctttcctacgttcacagccaaactttttgaaagtgtcatgcgtgttagtctcacctgccactgctcgattcagtttacactggaatctttctccactctttatatgaaaaccgttctccctaaattcatctccagtttggcagatccattgaacttctcagatagtatcctatttggcttctctgcagcattaatactgttgcccattcatactgcgaaactctggcttttggacaccacagtctcctggttttcttcctttcttttagctcatctcttattctctgcaaacttgtcttccatcttactaaaccaataattggtttaacatcatattctcttttctcttggtattctcttacgtaatctcatctcaaaacatgacgttagactatcagtacactgatgacacccacatttatgtggttgctaagctccagaccaagtcagtgtctctacttagatgtttgtttcaaggaacttaaacagcatgtcaaagactaaacattttatgatttcccccatccgactcccccagaaagaacatcaaacacattggccttctgcagtgtttcctatctttgtgcatggcaccaccatctatctagttgtgcaagtcatgcctcctttcccttcctccatacccagtcactgaattttgccacctaatcttgtcttgaacttatttacttttctccatctccactatcatcacttgagtctaggtcagagtttttcaactttggcactattgaaatttggggccacttaattcttgtgtgtaggctgtgcattggaggatttttagtagtattcctaacctcttcatgctatatgccagtagtagccctctagtagtgacaataaaaaatgtcttggacattgccaagtgaccccttgggggcataatcagcccttcccactatgaaaatcattagtctaggttgttacttacttctgatggaactacttctatatcttccttaatggcctgtctgcatctgctctgtctgcccagtggcccaggctgcatactttgttcagatcttttcaaaaaataaatatgaattgctaataactggaatcagcctaaatgtccttcagcaggtacatttatacaatggaatactattcagcaataaaaaggaaccaatttgatatatgcagcagcttggatgaatctcaagaacattatgttgaatgaaaaaaagccaacttcaaaaggttatatgctgtatgattcgatttatgtaacattcatggaacgagaaagtgatagaaaacagagcagtgtttgccagggcttatggttgacgggaaggtagataaaggaacaacatgaggaagtttctttttagtgatggaatggttctatgtcctggtcgaggtggtggttatacgagattgtgcatatgatgaagcttcatagaactatgcacatacacacacacagtaaatgtaaaaacatgtgaaatacaaataagatctatagttaatagtgttgtaccaatgtcagtttcatggttttgatcattgtagtgtagttatgtaagatgctgttactgagagaagctgggtttggggtactcaagaactctgctgtttctacattttttttttgaacctaaaattccttcaaaacagttaaaacaaaagacagttatgctaccctcagcttgaatgccttacagttgtaggatatgataaatttctcttcatagattttagcctgtaaattgttaagtacaatgagttctgagatcctctccaaagaaccagtgtatcagtatgttcagctcccctgttctttgttcttcattttaaagtttaaattcctagttctttatttctccttgcccccagtttcagtaaacaatccccttctagcctctatcaactgctctgaccttagtcacccttggtcacctgctctgaccttagtaatccttggtcatctgctctgttcttagtcatcctggatcacctgttctgtaaccgtccttcccgccaaactactcaccctgctgctctggctcatacccctgctctctttaaaatagccagttggaattagcttagactgcgtggtccaaccctagccaatgggggaaagacacagcagtagggactagctgcgttaggataagaaccccttcccctcccttgttcaggtgtgctcttgacattgctccatctgtgagacacacccttctatagaagtaaaattgccttgctgagaaaattaaatttatgttcgagtgctatttcttttgtggcaccgaaaatttatttctaacacagtgacactctgttctttaaaaacccaagttttttaacctggtttatgaggctgaacaccttctgggcttctgtctgtccctccagtcctgattcttctttctctcccttcacatggattttattgaatgtatcttgttcttcccagctcagttggtatatatatttgctatatattcactttttctggactctgcctttcttcccttgcctaattaagttcttatccttcaaatctcggtttatctgtgacttatttggggaaccctttccttacctccaagtcaaaatcatattcctgtcaaacaaaactgtgttcttaccctcagagcacataattcagctaccattcattgtaaattggtttattatttgattgtttcgtgtactagactgtaagtatcctatttgtttttgctaatcattgtcatttccaaaggcatcagtatagtgctcgtcaagcagttgaccttcgctaaaaacttattaaatgaataaaaatattaaaaacaaatatagcatatttagaagttggttctgtacttgagatacacttcaggatttgtaattttaaagaaagttttctcatattttataatccattgttgtctattaggatgctgctatctaatggcatttttgctatagttaacttttctaaaacctcagatatacaatttatctgttactggatatgctttaaaatgtgaactaggaaaattgtgaattaatgcttttatcaagtgaagcacattttattttattttattgagacaaggtcctgctttgttgcccaggctggagtacagtggcattctcactgctccctgcagcctcaacctcctgggatcaggtgatcctctcacctcagcatcctgagttgctgggaccataggcacatgtcaccctgcctggctaattttttaatttttttgtagagatggagtcttcctatggtgcccaggctggtctcaaactcctggtctcaagggatcctcccacctctacctcccaaagtgtaggtttacagcggtcagccactgtgcctggctttattttttttttatgttaatggggttatcttatacacagtactttatgagagaagaggaagggcttcaaaaatacattaaatattttatttatttatttttagagatcttgctctgtcacgcaggctggagtgcagtggtgcagtcatagctcactgcaaccttgaactcctgggttcaaggcatcttctcatcacagcctcccaaagtcctgggatttcagacgtgagccactgtgcccagcctcatttttattttaaatttaataatgactgaaatttatattatttacttattttattttttagaaatgagatcttgctatgttgcccaggcttgtctacaactcctagcctcaaatgcttcccgtcttggcctcccagagtgctgggattataggcatgggacaccacacctggcccagacataactatctctaacatgcattcatgtggcagaaatcaaattagtaatttactatttgaaatgtagtagataattagttatattgttattataacatgaaattatttcccacttataaagtatctacatgggaatgttacagattgtttgatattaaatattctcatagattgctttcttagaaatttggacaaactcttcgtctggaaataagttgcattataaacagtaaaggtggacatctatctcttgatgattttttttttagtcgttctctattcaagctttaaaaatatacttttggttactgtgtaatatttgttacatttttgtgtttttatagtataccataattgaagaaaaatgatggaagagagtggaatagagacaacaccacctgggactcctccaccaaatcctgcagggctggctgctactgctatgtcttctacccctgttccattaggtacatgtagttgtctaacatctcgtgtgttttgagaatagtgaagatactatcatcttttctcagagtcaattaagaaaagaatgcatatattaaaacttctctattatttttcaggatgaaaggaaatagcctttttaatttaaagaatagaaagaaagtcttgtgtatttaaagtaagaaaacatcagtgttttgctttaggtggacttttgttctttatgttcataattttaccatcatttatattatggcagaaatatcctaaaaagcatgtgttagctttgtcttctgttctttttcttttttttgagacggagtttcacttgtcacccaggctggagtgcagtggtgcgatctcatctcactgcaacctccgcctcccaggttcaagtgattctcctgcctcagcctcccaagtagctgcaattacagcactcaccaccatgctcagctaatttttgtatttttagtagaaatgggatttcacaattttggccaggctggtctcaaactcctgacctcaggtgatccacctgcctcagcctcccaaagtcctgggattacaggtgtgagccactgcgctcggcctactgctctatgactttgtggtgattaacctttctgagccttcagggcataggtttttatgctcaaactagggatgaaaaatcgctttattttattaaaaatacaccaaaacaaaccaaaaagcaaaaatgaacaatgccataggttcatacagctgcttcttttacttatgggagttgaaagtcatttacactcaattatatttgttgtatattttaaattacacattttaaaataattcttgggatatgcttggtaagttaaaaattttgcaagaagaaagtaattagacagtttgaaaactaaataaaaaacatttctaattctgtgcttttatcctctccacttttttctagcggcaaccagttctttttcttctccaaatgtatcctccatggagtccttcccaccactcgcatactctactcctcagccgccccttcctcctgtgaggccttcagcaccattaccttttgtgcctcctcctgcagttccttctgtcccaccacttgttacttctatgccacctcctgtttctccatcaactgctgctgccttcggtaatcctcctgtatctcacttcccaccttcaacttctgccccaaacactcttttacctgcacccccttcgggtcctcctatatcaggattttctgttggttcaacttatgacattacaaggggacatgctgggagagctccccagacacccctgatgccatcattttctgcaccttcaggaacaggtaattctttctgatactttgaaatacatggctattaattaatgttttattcttttttaaaataatagctttgttgagatataatttatgtactctacaattcacccaattcaaagcatacagttccatagttagtttacatcagaattgtgcatcccttgtcgcaattttataaccttttcatcactttaagaaagaaaccctataccttttagcagtcagcccctactgtcccccaaatcctcacagctctaggcaactactaatctactttctatgtatatggatttgcttatcctggtcatttcatatagatggaatcatataatacgtggtcttttgtgactggcaactttcacttaaatattttcacttaaatatttaacttaaatattttcaaggttcatccatgttgtagcatttgtcagtacttcattccttttcatggctgaataatattccagtttatgaatatgtataccacatttcatttattcaattaatcagttaatgttgggttgttttccactttttggctatttagataatgctgctataaatatttgtttacaggtttttatatggacatgtttttatttttcttgggtgtctacctaggcatggaattgctgatttacatggtaattctacaccaaactgttttctaaagcaggtgtaccattttaccttcttattagcagtgggcggggtcccactttctctgcattaatgttcttctctttattcatttctttggtttccagagttacctatttcacatttttgccatttaaattattaaaataaggctggtataatttagtatatgatttttttatgtgatatacaactcagtagatgattagtatatgggatgtcagaaaattccaaaattttgtcctaatatttgtgcatttatagagaaatttaaaggtgaagtctgagtttttttaagttttactgaaaaaattatcaggactgactgttccagggagtagtgtttttttagccaggtaaaaagtcagaaacaaataaaacctcatgtatgccaaaagtttgtgatactgggtcatttcctttccctaggtcagttaaatctacttgttttgtttctttggaataattgttgcaaatgagttatcaaaacttcgtccttgtcatcctctgcctgttgtttctcattttagggaaaagcagtagctttgctgtgctttttattatctatctttccctgtctacctttacaaatgaaaattattgcagagtgcaagtactatattcatgtctatgtatatgtgaattttctttctgagttaacatgaagtatatagagtatgtgtaataattgtgtgcttttttgtgatgaacttcagtgctcaattaattttatggattaaagagacctgaactacagccgttcatatccaagtgctgaataggacagacctgaagaacttttggatatacgcttttgtccattttcaggatacttggtttaagactatataaagggaaataaatttcttttgaaattctgtttaatttgcgttttataaaggtttgtgttaatctttgattgtataactcagtcttcaaatgcctgaatattaatattaaagttgtttgagccactcctttttataggaaaaagtttatggaataaattatacatatgaaaatttttgccattgattaggtcttttgccaactcctattactcagcaagccagtttgacatctctggcacagggaactggaaccacatcagccattactttcccagaggagcaagaagaccctagaattactagaggtcaggatgaagcatctgctggtggaatctggggttttattaaggtaagacgtgtttaaaaattatgtttaattttctaattataaaactaatagatattcattagagaaaatattgaaaatacaggatggcacaaggaaaaataaaattcttttttattagcagttttctgtagctgctctcagtctctgcctatgcatatctgtgtaaacgttcctttgaattaaaatcaaattgaagtagtgacaggtcagatggatactatttcatgttttctggtctttactgagcatatatcatggatatcttcctggccgtaaaatatttttttcagaaatgtattttggtttctcttatggctgcttcaccatacatgctgttgcatttatttcccgtgttttattttgctaatctgcctattggcattttctaattgtaattattttttttaaattagttaatttattttaattgacaaaaattgtatgtgtttattatgcacaacatgatgtatacatgaagtgtgtatacattctggaatggctaaattgagctgattaacatatgcaatacctcacatatttaccatttttttgtggtgagaaaacttaaaattttgaaatataaaaccttatatttcaagaatataatacattgttcctaactatagtcaccctgttgtacaagagatctcttctaattgtaattcttatcaataaatcatcatcatgattaggtctggcatggtgcctcatgcctgtaatcttaacactttgggaagcccaggcagggggattgcttgagtcgaggagttctgtatgagaccagcctgagcaacataatgagacccagtctctaccaaaaacttaaaaaaattagccaggcattgtagcgtgtgcctgtggtcccatgtactcagaggctaaggtggtaggattgtttgagcccaggaggtccaggctgcttgagctgtgatcatgatactacattccagtctaagtgacagagtgagacactgtctcaaaaaaaaaaaaaaaaaaaaaccaaaaaactatgatgagcactgttgtatgtaaatctttatggacatctttttttcctccgaattaattcctgatgaacatttgagtgaacatttgaagaaattgatacctattccacttcaggaggtttataccaaaatacactggtataacatttttcacttgccagcagtagttattaatttggactagggtattttctgatttgacaggcaaaaaataataccacattttaatttgctttcctttgctactgaatttgaacattttctcgtatgatttttagccatttgtattcttcttttgtgaaatatcggttatgttctttgcctagttttaaattgggatgattttcttttcttatgaatttgtaagagctcctaatacagtaagaatacttttctatatgctctcatatgttgcagttttctcaatttttagtttacattttcattttaataccctttttgacagaaaagttcaatttcaggagtcagttctgtcagtcttttcttttcttttttcttttcttctcttttcttttctcttttttgagacaaagtctcgctcttgtcgcccaggctggagtgcagtggtgcgatcttggcttactgcaacctctgccttctgggttcaagcaattctcctacctcagcctcccaagtagctgggattacaggcatctgcctccatgcctggctaatttttttgtatttttagtagagacgggggttcaccatgttggccaggctggtctcgaactcctgacctcaggcgatctgcccgcctcgcctcccaaagtgctgggattacaggtgtgagccaccgcaggcagcctctccttttctttacatttttttttaatgctaaaaaagaccttttctcactacgatactgtgataaatgttcttctgtgatccctttctagttcccttaatgtttaattttttagacacttagcgtttaatatagttgatatttctttactatatgaggtagagatcaaacttaattttcttccagctactcaatggagtatttcaatatcatatccccattgatttggtatgatccctatattatcttccttaagaaattgtgtgttaaaatcagcttctggcctctgtattctagtccactgctgtttccctgttcttgtagtagagcacactgttttaattacttttactttgtgttcattgtactaacgtgtactgaggtggggatgtggaacattcagtgataagtaagataggacagttcaagtctgcatttataaatgtatatcagtatttagttgtgtaagttgtataagctggctgatttttcttttaaatttttctttactcatctttcccaattttttttgcaatgaattttgaaatcattctgccaagttccaatattctgctaagggtttgtttgcaattttattattataattataatttattattatattaaagatttaaaattggtagatgattggctgatttgtagtatttgagcttcatgtttcaggaatgtggcatttttctaagcttgtttattttttaatacccctctgtacttttttaaaaagtttttttttgcatacagactacaacattttgtccctcgttaagagcatgtgtcagtgtgtttgtcatgagttgtaatacccagttcaactctataggtcttgtaaatagtaagtcatgatgtttcagcatatggttggttggcagtcttaaatttcaattttatgaactcatcttttcctgagtcaccttagtttaatggcagattggaagatggggaatcatggcaggttagtcagatgccatctcaggaggcactgctccctggagtgtcttttaccctttgtgaagtatcgcacaagaaggaatactcaagacttggttccttttagtagtaacggctctaagaatccagaggaatagatctgaatataaatggcgagtttgggaatgtacaaaacaagaaacaagaagtaggaaaaagaagaaactagtagaagatagcaaaatgttgtacgttaaggtaataagtaactgttctgcccccagacgagaggtgtttttactctttttattttttttattagggaacaagtatggacttacgtagacacctgattgggacctttatttgggaccctaagggacaagttttgcccaatcttttatataaataagtagaagtgaaattatatatatgtatatacacacacatatatatgtatatatagtatagcatcctttccatacccatgctactcaaagcgtgatctgtagattgctgctggtctacacactgctgagtcaggaaaaaaaattgagagtatcatttagaaacttaatagcaatttgatattgtcatgaccttatatatcttacaaaagtactggtttaggatgcattggaaacttttaaaaaagttttcttcacaatcatgaagatcatggtgttcctcacttagagtgaatacttacatattgatttgttttatgcagggtgtggctgggaatcctatggtgaagtctgtgcttgataagacaaaacattcagtagaaagcatgattacaacgctggaccctggcatggctccctatatcagtatgtacataagttagaccggtatctgccattttttttttaagggtatgtccacatcagccactaattgtaattctctgttcgtttccactgattgtgtaatcagtggaaattcttattatattcttgcattaatttaattgtcagtcttattttttggtgttactaattcatcttttttaaaagtcattaaataaattttgaaaatcccacagaatgatcctagaaggagtaaaaaccatgaattattggtatacttgctgattttaattttaaatataggttagcattgctttatatgaattttactttattcactactgacatttgaagtgatgtttgtttcatacttttttttttttttacatttctcctgttatctattttaattaaatgtttgtgtgtaattgagggataatatttttggaggaagcaaatctagttaataatatctaatgactgggtatattgggaaagctatttttaaccacctctgaacactaatcatccagaatcatccagacagttgatagatactgtctgctatttaatttttatgtacatatccaatatgtgaaaaaatatcacaaggcttagtgaccaattattagtaattctgtaaaagataacttttaagtcaaaattgtgcagcaggtacctgaacagcgatttcagtggcaataaaaagccaatagctttcacaagtctgactatgttggtagtttactgtctagtaaatatcaaaagataaggcctagcaattgttaagtgtctttattgaatgcttctgccaggcactttctcataagagctctgcaaggtaggtattttcctcaagttttggacgaggaatctaggtttggagggatgtaagttatcaccctagatcacacaacttggtggagctgtattgaactcatgctcaatttttttacacttagccactttgcttcccttgtagtagaaaattgaatcaagcattaaatcaactgagttgttctttgtgtttgtaactgtccaaagaattcaaaattggagtccaccatatatgttcttttctttgcaagtacatattttgaatgaaggaaaaaaaggaattaatatttttggagcttttgctgttttaatggctgtactatgttagactatgaaagcaattaccttatttaatccttagagcaaaccctatgaggtgccaggtgtttttattcttcttcttctttttttttttttttttttttttgagacagagtctcactctgtcactcagactggagtgcagtggcgtgatctcagctcactacaacctctgcctcctgggttcaagttattcttatgtctcagtcttctgagtagctgggactacagccgtgtgccaccacgcccagctaatttttggtagagacggggtttctccatgttggccaggctggatagcaggcatttttctacaaagaaacaagctcagtgacttccacaaggtaaagaagctagtaaatgataaaggtagagccatcaagaaaaatgtgtaacaccgaaggggaaaaaagaaaggtacagaaatgaaatttctattattagcaaatgtcataactttatcagctttaaaaagtaataaaatcgaatttaagaaagctgacatctttactgacagcaaagcatcaccattctgatctaacaaaacaactcaaagtaaatcttaaggtttttttttttgttgttttttttttgaggtggagtctcactctaccgccaggctggagtgcagtggtgcaatctcagctcactgcaacctctgcctcctgagttcaagcgattctcctacctcagcctcctgagtagctggacctacaggtgcacgccaccatgcccagctaatttttgtatttttagtagagatggggtttcaccatgttggccaggatgatctcgatctcttgactttttgatcctcccgcctaggcctcccaaagtgctgggattacaggcgtgaaccaccgcgcccggccatcttaaggtatttttacacaaatattctagaaatcatttgatgtaacaatttcgtatgtgtcaagaaactcaaaaagtattagaaatggcaggactactcatcacaagctgaaaagccattttgagctgaagcttaatggagcagtacttagctaaggtcgagagatgtgtcccatgtggaggaaaaaagtgaaaaaaaaagtatattcttcttctcttttatgtcctagtaacttctgaagtatccagtacagatgtgatctgtgagacattatgtcagtcaggaaaaagggatccattatttttaaaacccaaatatttgaaaatatctttccctgttccacatgatatttattagggaaaaacaaccttgtttctagggcaaaatgttttacattataaacaattttcatgaaaaatctcttttgccggtgataactattaatgccaaatatcaaaatgtgctgtgtttagaacaagggctttgaattcattatatcacagaaatgtttggttaagatttttaaaaataatgaaacatttggtcaaattgatctgtctagaaatagtagtacttaggttgtttaagtaattgaaaaattaaaaatatttgaaaatatttttatttcgtattactcttaatattttaaattttaagttttatgtgttatttcaatttcatatatgcttgcatatttatattagggcagtagtacatgtataattgataaatatctatttgtggtgtatgctcagaacattgtggggatatttaataaaaagcttgatgaccccatatttaaactattttctaggttaaaaagtatatttcatggtagtgcttgtttagtacataacttctctgcaactcattgacaaatcacttactatcagtaagtctttattttaattttccgtggagtatactaaatatgtaacttacacttcacaagccagatatgtgatttctggcttgtgatatgtaatgtcagttttgagtcctgacattagtgctaagtagatacgttaccttgggcaaaactttgttggcctcagttttctcaagcatataaaaaagataatgatctatatcttgcatggttttatgaaactggtaataattatgtatattagatgttagcacctggtatggtagtaattatgagaatttcattattttaatttgaaagttaaattttcctctggtctttttagaatctggaggtgaactggatattgtagtgacctcaaataaagaagtaaaagttgctgctgtccgagatgccttccaggaggtctttggcttagctgtggttgtaggggaagctggacagtccaatattgccccacaaccagtgggctatgcagctggattaaaagtgagtaacagaacaccattttcaggacatggaaactggcatttaattttttcacaattctgataatctgttgtctctatggagctaatagacttttacatactgaaataacaatgaactttgcttttagtagacagccctatcgtattatgaagatatagtggagttttaatttaaagaaatttaagataggttttgattattgtgggagggaaagaaacattgagagagcacaaaaggaatagttagtcctaaaagagatcttcttaatccagcattaacattcaaatcaattactgagatgataatatcccttgaatcccataagcttttattatccctattgataatgcttaaaaatatgtaagttccaggaattccgtcctctctttcatactttattttcctctctttgtgttattaccagcatacagtcatgcaagaacaaattaacagttcattggcatacaaacatctttctcaccttgaaaaaaaaagaaaaaaccaaaggaaaccccaacaaattctttgacctcccttcctctataacttaatgacctattttgcttccttttgcagctaaactccaaggagttggcagcacttttctcatatccttttcacattcagttaagtctacctcagttaggctttgatgtccagcactctactgatagtgctttcaggctcgtgctaatgttctccatcttattggacttaccagaggcttttgagacagttgatcatgcacttctctttaatgcttttttcacttgatttctaggattccacactttagtttttccctccttcatgtattgctcactccttctgtacttcctttgctgattcctcctcttctctccagtcttctgacggtcaccttctcatcaattcactctcagactatcccatggctttaaatactgtctctgtgctaacagttccaaatttatatctccacctgagaccttcctgtagactcttgatttatatataagttgcctttttgacaagtttacttgaatatctcaaacttaatatgtctagaactaaacttctttcctccacacttgctccctctagccttcttcaccttaattgatggcagttctagccttccgttttctcaggcaagaaaccttggagtcagccctgacttctctcattacccacttctaatccatcaagaaatcttatttgtaagacagacagttcttgtttttcaacataattgtgttccataaagttgctacagactgaatttgtgaatactgagccattgctcccaggggagatacgatggttaggatactgtgggcctctggtcacattttgccaacctgtcaatacataactttgttttatgcctctttctgtttaaatacatttttatacacatacatgcacatatttttgattcattaatattgaactctcacagtcaacagtactgtaactcatgcttgaatgcagcttatttaacacactcgttttctcattaaggcacatcattgtcttcttgtgcttaggaacactacagcactccagcactacacttgggggccatttgaaaacagcagttaacatcaacaaacacaaagatgcaaaaaagaggtgctaaatagatcccaaaaaggatacctgtttacattgtgtcagctgaaagaagaagtcagggcactgccttgttcagcctcagctaggagtgtatgcatcaggcaactcaaatttctcatagctctgtgcatgtccgattttgagattataaataaatttcatgtgtagtcaatggaatccacaaaactaataggatcgatcaactgtatttatgtttaaggagaaacacattttcatatatgacattctgttgttttatttgaaggagcttataatagcctgcattttttgagaacatcccctgagccaggcacatagaccctttacctgcattcatttgatgtgtgtaaagcattagaatgaggtaattgacatatgcatatttcattgggaaaaagtctgttgcattaattataattagtcactaaacacaaacccacactgacactagattatttttaattctactaggtagtgctacataagtttgaggtgttctttgagttgtatttagtactttatttaaatagaatatgaagcccttttcttttacacatatgcatactcacataccacaaaccacttttctatattaggggctattaggcagtagttataccctatctaaatgtaatgcattatatataatatgaattaaattacatgttttctgccttttcacttttcacagtggtctgtccttacacacagagcaaagctgccaaaagcacatgcactttgaaatgcttcttttctctagtaggtttctcttgaatttgagccctagtatacattgccaataagagtttctttggtggtaggtgtttggacttaataaaatttagcaaaggtaactgacggctgtagggtttgaatttaatctagaaatgaaaaaaaaaatacagcaaatgggtaaaataagtatgtatacatgataattgtacattaaactagttgtatatatataagataaaccataagcattcatacgggcgatttttacttgaaaaactggaacaagtcacatacttagattgagaatgtatttgaagatttcccaagaggttttgcaagttggagagagtttataggtctgagaaagaagacttttcaagatttagttgcagagagtaaactgaggaaaatcctaagtagaaatgattattagacaaaatggtgagtacatttcactgaaattagagactaaaacaagggatttctgtaaattgtgaagcattgtataaatgtgatatggaagttggtaaccttatttgatggaaattattgtagttgcatttatctttttataatagcatttgacagattatttttgctgctgatttttatccttcaaatttacaaatatgaattcattttccacaattttcagttcaagctcaaaactaaaattcattgaaactaatatataagaaagtgatttgtaaatttgtcggctttttattttttttcagaaacagtagagggagctaatgagaagaaaaataatgtagagtcttagagtataaaatggtaacctgtttttgttctccccaatcagattttatttgaagtaaatgggttttctgaactaaacttacgttaccttttaaaaataggaaattatttaaggaagtaaatcagttcagccaaaattaaagttaggaagcttctagaacttttatgccaagtattaactttattgaaaagccagttgtagttatgactactgttttatatagttttatattcaacaaatataatatctataagcatttatgaaaatattataaaattttaactattcactgaaccaagttgcttagtataagctcttagagtacaatattgttcttcagttctgaaatgattattttaatatggtctctaaactacctaattcttgatctcttatattgctaaaaaataaaatctccttctcaaaacattggtagggactaatattaaaatgtctgtatttgtaactccaaaagaggccacatttaattaatgtagtggtcagaggaaaaagaaaggccagatataaccccattttcattttcttatggattttataaacaaaaaagaaatttgtctacctagcttattatcctgtttcttgcaggaactaattaattttaattaaatgttttgtgaatcctgtgaaatataaagctctgtgctgtaggatagtgaaaaatgaacaaacttagtctctgttccctggaagcataaaatctaggaatattttgttgtagtgcatagctgagatatcacctgcaaagagttaggggatgaatctctgtacatcttactaatcccttaatagtttttacggaatgaatgtttacttaagctttttaaaaatcaaactttagccataactgcttcctgggaggagtgaattaggcaaatttgtaacatctggtataaataactaagttcatcttatctgttaatactgctttcaaaatcaacaggtgcctctttaagtgttattagatttggtgatgccatatttacactatttgtattcttaacattgaccacataggccttcagaagcatttatttttttctttgttcagttttttatgtggtaagttcttattgaacacctattaagttaggcactgtgctggaaactagagatagaagagtgagcaaaaatatacaatcttggttttattgtactttaaatcctatcatcttcatctttacaagctagtatcttaaattgtcttacacgttctcgcacagttgtcactttctctttttcacttcagttgtctctgaaataaattgagttttctcgagatgtgtcctagccttcttaattttcatttggataagaatttaccatttaatctgatattgtctgtttacctctgctgtccttataaaaattatccatggctacttctgttcagacttcttatcttgcgttttgaacacatattcatcacattgttcatggtcaccttttatgaaaggattcagataaaagcaataaacagaaaccttttccctcagtcatccagcttttagttttctattacatataatcagttcatgtcttcaatggtaattattttgttgaataagctgtggtgtaatgtatacatttgcagctttttattttaagtaactggtcattttggtgcatgtatatttaaaaggaatcagaagaaagagaaaaacatatttattattgatatgattgcctacctgaaaaattcaagagagaattaactgcaaaactgccagaactgataaaaactttgtatgtagtaagatggtctcttgccagatcaacattaaaaaatacagttttcttaaattatttaacagtaacaatcaatgagaaaatgtaatataaaaataatccacaatagcaaccaacatcataatgcatatggaataatttggaaggtgtaccccaaactgttgatactacggaaatgtaattgtattttgtcattttttactctacatttttgtattgtttgaacgtttacagtgagtatatatatgtgtttgcatataaatgtatgcatgtattgtgtaatcataaattagtatatttaatatgtaataatttgaaatggtctctaacctctgccattgttgtttagggtgctcaggaacggatagatagcttgcgtcgaactggggtgatccatgaaaaacagacagctgtgtcagtagaaaacttcattgcagaattgctgcctgacaagtaagtgtattatgtttctcttggaagcaaaatataattgggtctgggagttgacactgaatacttagcaaaaagtgtctcctgttttataaccagagagaaaagtatattttgatgctggctatatcacttaactagctgtgtgtcctgcatggcttagctggcatttctatccttgtgtctcttttttaattataaaatggagatggtcatgcctgctttctgagatcatgctaataattaataaaatggcactaagtataagatgatagatttggtgtggatataattgaccatgagtagcaaacacaattattctcatagttattcaaagtcgtggaatatatgggcaagaaggcctgatggcattctctaggtttgagtttctagtgagcagtatctctcctgtactcataatagtttagaaaaacctccagacagcataatttatcattgtttttcaggtggctttttatgggaaaaatttttaatttgcttaattgatttatattagaataacttccctttgttgaaatctaccttcttttgtatttgcattatggttttgttgtttttattttttatttgtttgttcagtgttgaataacaatgggcatagcattttgtggcttgtaatatgcaaaatatatcctccaactttgaggcatattataggccagtgggaaagaagatatatgtagtacacagatgagcagttttaagtaattgtaaaaaggaaacataattttttgctgacaggaaatatataaaatttcagtggaggtaactctgtggagatagtgtcaggtgaaattcatgaataattagggcttgaactggattttgaagaagaggtgaaacttggccaaatggaacaaaggaagtaggatgttctgggtggagaaaaagtttgaaggtaattgaaatgtattcttgggtcagtgattatatcaacttggctgaaggtttgttggatgggaaatcaagaggtgacgggacaaattgtgaagagctctgaattctaggttgataagtttcaactttctatgtaagcactgagaaaccgtccagtgattgttgtgtcatttttttttattaacctgttactgttcatttaataattaacattagaaattacaatatgcctttttgatataacaaaaattataacttgtgataatactagtactacttttaatactattcactcccttttcaccttttgcggtatcattgttaagtattttaattctgcatatattttaagctcttaagacataactggtaatgttctttgcagtcagtatttgtttattctctgaattctttcttgcatttctgtttttctgtctggggtcatttttcttcgaaaggaagcctaaagtacttcctttgataatacattatagttcagagctgctcactaccaattctctcagcttttgtttatctgaaagtgctttaattcacctttatttttgctggatgtagaagtctaggttggcagtttcttttctttcagcactttaaaaatgtcatggtactgttttctggcttccgtcatttctgttaaaaagtcatctctccataaatgttttcttttgagaagtgtctgttcatgtccttcgcccactttttgatggggttgtttgtttttttcttgtaaatttgtttgagttcattgtgattctggatattagccctttgttagatgaatatgttgcgaaaattttctcccattttgtaggttgcctgttcactctgatggtaataggagtggtgagagagggcatccctgtcctgtgccagttttcaaagggaatgcttccagtttttgcccattcagtatgatattggctgtgggtttgtcatagatagctcttattattttgagatacgtcccatcagtacctaatttattgaaagtttttagcatgaagagttgttgaattttgtcaaaggccttttctgcatctattgagataatcatgtagtttttgtctttggttctgtttatatgctggattacatttattgattttgtgtatattgaaccagcctttcttcccagggatgaagcccacttgatcatggtggataagctctttgatgtgctgctggattcagtttgccagtattttattgaggattcttgcatccatgttcatcaaggatattggtctaaaattctctttttttgttgtgtctctgcctggctttggtatcaggatgatgctggcctcataaaatgagttagggaggattccctctttttctattgattggaatagtttcagaaggaatggtaccagttcctccttgtacctctggtagaattcggctgtgaatccatctggtcctgtactctttttggttggtaagctattgattattgccacaatttgagatcctgttattggtctattcagagattcaacttcttcctggtttagtcttgggagagtgtatgtatcgaggaatttatccatttcttctagattttctagtttatttgcgtagagttgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctactttctcttgtgggcatttagtgctataaatttccctctacacactgctttgaatgtgtctgagattctggtatgttgtgtctttgttctcgttggtttcaaagaacatctttatttctgccttcattttgttatgtacccagtagtcattcaggagcaggttgttcagtttccacgtagttgagcagttttgagtgagtttcttaatcctgagttctagtttgattgcactgtggtctgagagacagtttgttataatttctgttcttttacatgtgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaatttctgggtatccttgttaactttctgtctcgttgatctgtctaatgttgacagtggggtgttaaaatctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccacttacatttaaagttaatattgttatgtgtgaatttgatcccatcattatgatgttagctggttatttttctcattagttgatgcagtttcttcctagttttgatggtctttacattttggcatgattttgcagcagctggtaccagttgttcctttccatgtttagtgcttccttcagcagcttttagggcaggcctggtggtgacaaaatctctcagcatttgcttgtctgtaaagtattttatttctccttcacttacaaaacttagtttggctggatatgaaattctgggttgaaaattcttttctttaagaatgttgaatattggcccccactctcttctggcttgtagagtttctgccgagagatctgctgttagtctcatgggcttccctttgtgggtaacccgacctttctctctggctgcccttaacattttttccttcatttcaactttggtgaatctgataattatgtgtcttggagttgctcttcttgaggagtatctttgtggcattctctgtatttcctgaatctgaatgttggcctgccttgctagattggggaagttctcctggataatatcctgcagagtgttttccaacttggttccattctccccgtcgctttcaggtacaccagtcagacgtagatttggtcttttcacatagtcccatatttcttggaggctttgttcgtttctttttattcttttttctctaaacttcccttctcgcttcatttcattcatttcatcttccatcactgataccctttcttccagttgatcgcgtcggctcctgaggcttctgcattcttcatgtagttctcgagccttggctttcagcttcatcagctcctttaagcacttctctgtattggttattctagttatacattcgtctaaatttttttcaaagttttcaacttctttgcctttggtttgaatttccttctgtagctcggagtagtttgatcatctgaagccttcttctctcaactcgtcaaagtcattctctgtccagctttgttccgttgctggtgaggaactgcgttcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcatctgcaggtctgttggagtttgctagaggtccactccagaccctgtttgcctgggtatcagcagcagtgtctgcagaaccgcggattttcgtgaaccgcgaatgctgctgtctgatcgttcctctggaagttttgtctcagaggagtacccggccagccgtgtgaggtgtcagtctgaccttactggggggtgcctcccagttaggctgctcgggggtcaggggtcaggggcccacttgaggaggcagtctgcccgttctcagatctccagctgcgtgctgggagaaccactgctctcttcaaagctgtcagacagggacatttaagtctgcagaggttactgctttgtttttgtttgtctgtgccctgcccccagaggtggagcctacagaggcaggcagccctccttgagctgtggtgggctccacccagttcgagcttcccggctgttttgtttacctaagcaagtctgggcaatggcgggcgcccctcccgcagcctcgctgccgccttgcagtttgatctcaggctgctgtgccagcaatcagcgggactccgtgggcataggaccctctgaaccaggtgcgggatataatctcctggtgcgctgttttttaagcctgttggaaaagcacagtatttgggtgggagtgacccgattttccaggttccgtctgtcacccctttctttgactaggaaagggaactccctgaccccttgcgcttcccgagtgaggcaatgcctcaccctgcttcggctcgagcatggtgcgctgcacccactgtcctgggcccactgtctggcactccctagtgagatgaacctggtacctcagatggaaatgcagaaatcacccgtcttctgcgtcgctcacgctgggagctgtagacaggagctgttcctattcggccatcttggctcctcccacagtagctcaccatcactggccatcagagaaatgcacatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcggcactattcccaatagcaaagacttggaaccaatccaaatgtccaacaatgatagactggattaagaaaatgtggtacatatacaccatggaatactatgcagccataaaaatgatgagttcatgtcctttgtaaggacatggatgaaattggaaatcatcattctcagtaaactatcacaaggacaaaaaaccaaacatcacatgttctcactcataggtgggaattgaacaatgagaacacatggacacaggaaggggaacagcacactctggggactgtgtggggtggggggagggatagcattaggagatatacctaatgctaaatgatgaattaatgggtgcagcacaccagtatggcacatgtatacatatgtaactaacctgcacattgtgcacatgtaccctaaaacttaaagtataatttaaaaaaaaaaagtcatctctccatcttcttgtgtattgtctctgtgaagataatatgttgttttctctggctgcttttaggattttctctgtcgttttattttttgcggttttagaatggtatgattatatgtatttgcttgcttgcttgctctcataattattttttgtggattcgctgagcttcttgattctgtggattaatatcttcagttttggaaattctttacaattatgtcttcaaaacttgcttctggcccatttctctcccttctctttgtaggaccttaattacatgcccattcacctttgacagtgtctcacattgtcaggttttttcccccactctttttttcctctctgttccttagttttgacattttctattcacctgtcttcaggttcactaatcctgccttctgctgtgtccagcctgttgttaaactcttacatagagttcttaccttttaaaatgcaggttcaatttatcttttgaatgcctgtatctttaaatgtagttgaactgtctttacctctcttttcttgactatatgaaccatagttaacttttaaatcctcatctactgattccaatatcacggtcacttgtggtctgtgttagtctcctttttccttttggtttgaatatatggtgctgtctctctgaatgcatagtaatctttgaaaaccattgtttagaaaacaaaactctagagtctttaagtgatcttgagaaggttcatcctttcctctataataatatacacaattgtaggggtgtgaggaaggggagggtaatgtagtgtacttcagtcacagtctgagctgagtcaagtctaggtcggtgttctaaggtatattcactggcatcatagaaaaaactttcctcataccttcagtaacactttttaggatgtccacacctgaaagcttggttagtatgttattcaccatagagattattgtctgcaaattatgcaaaataaggcaaaataaaatttagctaagctcgactttatggaggcttcacaaatacattatcttgattgagaaagttgtagtaaaatacaaaatatctattagtctaccaaataaaataaatgtcattatttaatgtttttaattttaaagttttaggatatgaacactatagacattataaagtgccattttagtattcagcaaagttatttatgttactgtatattttactttgttgtttttttgaatgtgtaaataaaagtctcctaatccattttatatttcattgcattttattagatttacattaaaaaataggcattaaacattttcctgcttcatatccttttattgtttaaattcatttttgagggtatctggctgtttcatgatttgggttagctaaaatttgggtggtactacagttgttttcaataaagtcatttttaaaatttatcattttgtatgatatataagtctctttaaatgaagagaagtttcctggatttcatgaggctgttttcaaagactgactcattgtgaataattcagaaattgtgattagaaggatttattattaatgaagagagtatttgttattatttcctctgagcttattttttaatttgttagtaacttagttgagtacatattcatgatagagtttgtattataaaatttcccatattttagcaagtgacaattgaaaaatattactcataagctgtttgcatattcaatgtatgtaaatttacctgttgcatatttgagtacccttactttgattattctcccttcccatggagaggaagctttccatgataagtatttttaaattttttttctttgtggttattgtcttttttcctcttagaattaatacagagtaattttatctgttgtttttatgaattgtccttttgcaagttggtaagaaaaagatttcctttttgaaatctgttctatctgaataatagtacttgttttttctttttgtctattcatgataagttttatttggcatataaaccatttgaaactcgtaattctgttgcagatggtttgacattggttgtttggtggttgaagatcctgtccatggcattcatctagaaacatttacacaagccacaccagtgcctttggaatttgtacagcaggttggttttctcctttgctttttcattatgctccagagaaacttacactattgttttcagaataaaaatttgttcggtttttttgttagaaatatgttcttgattttgtttcagtcatttttcttttagtatttttctttgctttttaatttcctgatccttccatgttgttttagtaccttcctcctttgttttccaggtgtctttgaaaggtaatacattacatggttaatcattatttctctcatttttttcttgtttttactctgagttctggaaaagatttaccttttctagtgttttatgtccgcctttcgtttgctttcccttttatctcacatttcatttccactgttatctccatttcccttttccttgattgattgtcctcctgttcatctttagtgaaatcaacattagaaaccttataggcacgtgtctttaggtttttggctgaaaaatggacctaatagtgtacctatccacacagtttccaggagaatgtaagtataaatgataatccttattcctctttttttttttttttggtgtgttttctctaatcctttcatgaacaaaatggaatataaatatatacttgcattggaatctctgtgctcttaagtggtattctattgacttttttctgtcaatttcataaaatttttgttacagttgtagtttgtacattgttaaatatcatttcaaaactgcctttcaaacttatttgggacatgaagacatttgagaatctaagaaaactattgggctgtctcccaagaaaaatgcgtgtatgtgtactttcatagaactttggcatatgtgttcacataatccctaaaagtaacctctggcctacttattacagtttagaaagggggctaagaattgatgcttggaatttgaaattttactgaaacttttatttataccgtaatttcttttcataagttcaagaaaacctttttatagatattaacattacactcatttcaatatgaaggtgattaaaagactgtaagtgaatactatgcatactgttatgccaataaattagaaaaattaggtgaaagagtggattttctaggaaaatagaagttttgccatagttaagagtattaggttgaaccaaatgacgttgttgcctttgatggtcagaaatagttatatattgtcagtttcatatgattcagcttaattgaagcattaaaatggaagaactttatgtaactaaaaaaaaaaaaatcactgagtaccaatggtgttacaagtgagttctacaaaatgttcagagatgatttgctgtatgaggtatcaaaaatagaggtagagagttttccagttcattctgtgagactagcctcttttaactttaaatgaaattatagtccaaagaactaaatgtcaaaaccattggtaaaattaataaataaaattcagaaatgtattagatgaacattgtatcctgaccatgaaaaatttgtcccaagaacagcagaatggttcaacaatagtaaatttatgtaattcagtacatgaacatctgcattgaaaggagaaaaaagattttgataagagttgaaggtatttgctagaaataatcatactaatagctcttagtattagacgggtatgtgtgtactacaaaatcaaagcaaacttcagatctaataaataaaacactgaaaacgttataattatgaggatgctcctgtcactgccactgttaacattgctgtagatctggggtcagcaaacagtggctcacagccaaatctggcctgtcatctttttgtaattaagtttattggaacacacccatgccagtttgcttacttattgtttatagctgcttttgtactatagcagcagaaatgaatagttgcaacagagaatgtctggcccacaaagcctaaaatatttaccatctggctcttttcagaaaaagtttgctgacccctgtgttagatatctgaccattgcaaaggacaatttttatgttgtttttaggaatatatactggaaagaagtagacatgaaagaatgaagtggaactcgtgtgtaccagtaccaaaagatagctattacatattgctgagtaaaagtcaaaaacagcacatctagtatgatcccatttactagcaggcgtgtgtatgtgtgtgctttaaaattttaataagaatagggaaaaaggcctggaaagataacacagcaaactgttaatagtggttaattctgaataatggtatttaaagggtgttatttgctttttactttgctttttattctgtttgttttattttgtgtcatttggttttaaaatttagaagatacaaaactgtgtgcattgaaatgtcttctttttatcctcagctattcagctctcctccctgtttctttttattcattctaaaatgttttatgcttttttattgttggaattttttaatttaaggtaatggaaatcagcccttcaggtaattagaattatcagtatatattagtaaaaatctggaaataaatttcatacaatttgtacttgttaaacttaaatataaatgattcctcacccccataaaaaaccccagctgttctggatttttgccaataatatagaataccttgtttctaaaaagtgtggtccttggcttaacatcataagcagcacctagaaatttgttaaaatgcagattctcgggtcctaacacaggactagtgaatcaggagctgcattttaacaagatattcaggggattcataggcatgccataatttgagaagcacagtgttactggtgtctctgaggacgttagtagtatatctgctgtttctctttgaaatatagtgaaatactgatactgtagtatacacattggaagagagtacttagagcaggggttcccaagtgctggactgtttgcatcagattgacttggaagctattttacgtacgtaatactgtactgtttctcttggaaccagctgtagagtttccaattcagttatcttggtgtctcagttatcttagtgggatgtgagaaactggatatcgttaaaaaagaaaaaagaaacaagagctcctcaggtgattgtaatacatggcacatttggtagtcatgtataactgtatagatccgttctagatgtggctatacttctctggactatacctaacaccctaaaacagaaaaaccacatcagtcttggatatcaagcaatgagtttattcttctgtcattcctttgtagatgaataaatgatttgaataggagcaaatatgagttgggtcaattaggaatgttgcatcagtggttgatgttgtccaggactggatattacttgatacatattaacatgtgaatcacatttccagagagaatttccataattgagcaattcttttctgaatggatttaagccttaattttcagttttcctctttctggttgaaattttactactataaaagataactttagcactgattttagtaccaatcttattattaacctgaagtgacacttaatttagaactagaactcaaaccttccgactgttagcctcgttaatggggatattttttaaaaaatagatgtgtgtaatgttacattgattgtgttctagccttgtaagttgatatagttggcagcctagctgtatttctcagagtttgtcataatctatatttaaaataacatgaaacactttgaaatgtcacttatagctagttccaatgatatttttaaatgtattataagtaatatcaatttcatctttccacaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcgggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaatatacaaatctatttacagcacaatttaatataccagatttataaggtggaaattcatgtgcagagacatttaacttaatgccatgtacttgattattttgttctttaaagaagacattattaaagaacatgttggttgaatgtttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgttttcagtaatatgggccaaaataatggaattgattattttcctttttggccatcacgtacacatgtaatctggaaaatcatacctttgtcaattttaaacataacttttggcatttcccagatttatactatgaacattggggtaatacattttattttttcattgctatatgacagctaaggggcaaatgattcaagtatattttaaatcagaagtattcaaattatttttgtataatactgttcagtacttccaagaataagctctgacaacagccattgtttctgcttccactcatattctctacacattttaatacagaaatttttgagagggggttactttattgcttgtgggttagtatgtctcttacttcaattaaggttacttatttggtttgccttaagcattacttttttaactttgtgccatttggtctttactttttatggatgttttcaaagaaactattttatattcaatctagtttatttagtctactgtatttctatttcgtggaagccttttcccctcaaataatatattatatcatttttggacttatataaatgataattaaataaatttttttcttaatactgttggactttgtatatacaagttcaaataactttttcgaagatagtttcttatataaatgtaatttaatttttttactcttctatacagttctttagatgtaaaagaattagcacaatctctggcagttttataaaagctgttgaagctcttgtcctgcactgtctttaggtatcataggtatcaggtttgctttgtgttaatgccacttcaagtcattatttggtttctgctatttttttacctgaggataagaagaatgaatattaaatttgaatattaaatatatgttactttccaagcactgtataatgactgttcagtgaatatcagacttccgtgtcattaaaagtcatgagagacagcacagagaggttataggttgccttggtgtacttttgtccaggagtaacagggacagaatactttctttctttccttcaagtacaagaaggctttctctaccatttgcgtctacactttattttaaaagctatccttttctagtagtattttatcatggcaatggcatgatgacaacaacagtctttcattacagactgaagggaagcatgtccttacttaaaatagttctgctactttccctcctattataaggaaatcttacagattctaaaaataccttaatttttctttgatttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagagaaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctatttgcttttgttctccctctgtcttaggaaaagccatctttaatatagttcttcaccactgttggggttgttttgtgattttttttttcttccgaagaactcctggttgttattggattttgtattttaatacaaattattgaattttataagcttgtacacaatatttaattagtgtgaaaggaaacaaagaatgcaggaaaaataatttaatatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatacatccattcaaaattatgcaagttagtaattactcagggttaactaaattactttaatatgctgttgaatctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttatttccaaa

SEQ ID NO: 12109 - DNA, 3825 bp, Homo sapiens
ttgatacatattaacatgtgaatcacatttccagagagaatttccataattgagcaattcttttctgaatggatttaagccttaattttcagttttcctctttctggttgaaattttactactataaaagataactttagcactgattttagtaccaatcttattattaacctgaagtgacacttaatttagaactagaactcaaaccttccgactgttagcctcgttaatggggatattttttaaaaaatagatgtgtgtaatgttacattgattgtgttctagccttgtaagttgatatagttggcagcctagctgtatttctcagagtttgtcataatctatatttaaaataacatgaaacactttgaaatgtcacttatagctagttccaatgatatttttaaatgtattataagtaatatcaatttcatctttccacaggctcaaagtctaactccccaggactataatctgaggtggtcaggccttttggtgacagtgggtgaagtcctggaaaagagtttactgaatgtcagccggactgattggcacatggcatttactgggatgtcccgtcggcagatgatctacagtgcagccagagcgatagcaggcatgtataaacagcgcctgccacccaggacagtgtgagaggagacctacctgggagactgagactttcccccacttttagcttgatgttaaagaagtggttgtaccttcctaaatcgaatagtctaaatgaatccagtagtttttatcattttcctgtagcctgcaatttttctttctctagaaaggcatcatgtcattccaggagacaaaaagaaacaaatcctttttatagtcataccatttcacctatcatagtactcaaaaaagaaaatatacaaatctatttacagcacaatttaatataccagatttataaggtggaaattcatgtgcagagacatttaacttaatgccatgtacttgattattttgttctttaaagaagagattattaaagaacatgttggttgaatgtttataaaagcatgatttgctttggcttcatctcttttctgtcagtctttgactacttttgtatgtgcacacgatctcagggctggtgctgagcagcctgctcaacagtcactataagacacctacttgtcgggagatgttccacatttctgtgcatgttttcagtaatatgggccaaaataatggaattgattattttcctttttggccatcacgtacacatgtaatctggaaaatcatacctttgtcaattttaaacataacttttggcatttcccagatttatactatgaacattggggtaatacattttattttttcattgctatatgacagctaaggggcaaatgattcaagtatattttaaatcagaagtattcaagttatttttgtataatactgttcagtacttccaagaataagctctgacaacagccattgtttctgcttccactcatattctctacacattttaatacagaaatttttgagagggggttactttattgcttgtgggttagtatgtctcttacttcaattaaggttacttatttggtttgccttaagcattacttttttaactttgtgccatttggtctttactttttatggatgttttcaaggaaactattttatattcaatctagtttatttagtctactgtatttctatttagtggaagccttttcccctcaaataatatattttatcatttttggacttatataaatcataattaaataaatttttttcttaatactgttggactttgtatatacaagttcagataactttttcgaagatagtttcttatataaatgtaatttaatttttttactcttctatacagttctttagatgtaaaggaattagcacaatctctggcagttttataaaagctgttgaagctcttgtcctgcactgtctttaggtatcataggtatcaggtttgctttgtgttaatgccacttcaagtcattatttggtttctgctatttttttacctgaggataagaagaatgaatattaaatttgaatattaaatatatgttactttccaagcactgtataatgactgttcagtgaatatcagacttccgtgtcattaaaagtcatgagagacagcacagagaggttataggttgccttggtgtacttttgtccaggagtaacagggacagaatactttctttccttccttcaagtacaagaaggctttctctaccatttgcgtctacactttattttaaaagctatccttttctagtagtattttatcatggcaatggcatgatgacaacaacagtctttcattacagactgaagggaagcatgtccttacttaaaatagttctgctactttccctcctattataaggaaattttacagattctaaaaataccttaatttttctttgatttttattttaccaagtcacaaatgtctttttgatgttttgagaattgttctcatagaatcacaaatactgacatttcattagatgattattttcctagaatccccaaagagcagtggcagtccatggcttggttgaagctagaaattttcctgcccctggtgacctggtaagcctcctgctcggaaccgtgtgagtgggtgaggaagatgagagatggtcagatggaagagaggaatacatgaactgctctggcctctctggttctgttcttggcccagagtttttgaaaagcagcggagcatgactgacttcacatgctcagctttctcagccttttgtttattttgttgtccttagatttccctgttgtaaaaggggcaagaaaagtaactcatcatctctaacacaccatggcagcttagccaggtagtcttagtggtggtgtttaggcataagatatgctgatcatcagtctcaggccacagtttccttcactaatcgtccagcttgagtgttctgttctcttcctgcccatttccttgaacctcctgctctagccttggcggagggagagtgctgtttgcttttgttctccctctgtcttaggaaaagccatctttaatatagttcttcaccaccgttggggttgttttgtgattttttttttcttccgaagaactcctggttgttattggattttgtattttaatacaaattattgaattttataagcttgtacacaatatttaattagtgtgaaaggaaacaaagaatgcaggaaaaataatttaatcaacctcagttgacaaggtgctcagattattcaattcgggatcctccttttgttaggtttttgagacaaccctagacctaaactgtgtcacagacttctgaatgtttaggcagtgctagtaatttcctcgtaatgattctgttattactttcctattctttattcctctttcttctgaagattaatgaagttgaaaattgaggtggataaatacaaaaaggtagtgtgatagtataagtatctaagtgcagatgaaagtgtgttatatatatccattcaaaattatgcaagttagtaattactcagggttaactaaattactttaatatgctgttgaacctactctgttccttggctagaaaaaattataaacaggactttgtagtttgggaagccaaattgataatattctatgttctaaaagttgggctatacataaattattaagaaatatggatttttattcccaggatatggtgttcattttatgatattacgcaggatgatgtattgagtaaaatcagttttgtaaatatgtaaatatgtcataaataaacaatgctttgacttatttccaaa

SEQ ID NO: 12110 - DNA, 2168 bp, Homo sapiens
tgattccatgttcttggccatgttagccataatatcctgtgcagtatgtttttcctgtgcagaggcaaaaacatattgggcatatgttcccaagcccccagcagtatgacccatactttggagtgacactcctcctaagatttatcatgattaaggagcatgggctccaggacccctaactccacctgacatagaacagttagactctcagaataatgtcattaattataccgctccattggaaggacttcctttgtgtgtcaccacaaagacatcactcagccatagctgtcttacagttcaagctcacacatggttgagtcactatgggaaaatcatgtacttattaagtcttggttatattaatgtaaccggtgtgctaaccaaccattcctggcccagtcgccttcattgtgctgactatacagaatggattcccttcaatagttcctacccccctccatagacccagtgtcttagcccactggctagaaaacaatctatgttaactggagacattgtggattggggacctaaaggccaattagatggaaaagaagaaaatcagaaatcatggcacaaactttgctggcattggtggcaagcttttaatgcttcttctttatataacactgggatccaatcccagtcggccgcccagattgcttggcatggagcaggctttagcccgcctcttcctcagtggcattatctagggaggaaaggaccaattcaaaagatgatatggaaggcagcattcccatttatgaatggcaacatctgggttgtaatactatccaataatagcaatagtaagcaacacagtcttaatgttacatttgtaaagaatatcaccactcaatttacagtttgtgtttttaatccttatgtgtttttggcagctaagaaggaccagctccaggtaaacaatacccaattgacctgtaaatcttgccagttatatcactgcattaatcatagcacattgcaaacacataatatctctactttgatgattttaggttgcatccctgggctatggattcctgttaatctgtctgatccatgggctgccacaattgctttacattttgtgaaacttcttctaactcagtttactcattgtgtccgtagaggcttaggcatgataatttttgctattgtttacttggtcacactaataatttctgttgtgatgtcctctgtagctttgcatagttctattcaaacagctcagtatgtggagaactggacacgcacagtcaaccaagggtggctacttgagaataaaattaacactgagttacaaactgaagtggcagtgttataatccacgattctatggttaggggaacaagtacaaagcttgcaattgcagcagtaattgtgttgtcattttaatcacactcatatttgtgtaaccaacttagaatataaccaaagtgagtatccatgggatctcttgtgaaagcccatttgcagggagctttcacatccgacatcacctttgatattggtgaattacaaaacaaaattcttgatttaaataaacaaattccagagtttcagccttctttagaagactggactgaattccagcaaggcctggagagcgtcaacccttggacctatctaaagcaccacattaacatcttatatatagttcttggaataatgttgttttgtctctgtcttctgttcatagtctgtaaaatcggatggactgccaatcggagaatgaaagctacccagcctggccttacattctttcacttaatacataaacaagaagggggaaatgttgggagccaaaaaggccaaagggatggtgaccaactcagcattccactggaggctacatgatcaaacagcaaactgtttatcatgaatacagaatgtgggcaaactcgcttctgtgcctgcccagaaggtttgctgagggccatcgctccctggccccggctccttgaggttatctactgggacatctagagcctattgtttgaggaatgcagtcttgcaagcctactctggaccgagcagctgacctcttcttccacaccccttctcactatctcttttgcctaataaatatggagggctgtgtaaagctcagggcccttgtccactagatggcaaggtgtcccctgacccttcttccaaacata

SEQ ID NO: 12111 - DNA, 2170 bp, Homo sapiens
cctgattccgtgttcttggccatgttagccataatatcctgtgcagtatgtttttcctgtgcagaggcaaaaacatattgggcatatgttcccaagcccccagcagtatgacccatactttggagtgacactcctcctaagatttatcatgattaaggagcatgggctccaggacccctaactccacctgacatagaacagttagactctcagaataatgtcattaattataccgctccattggaaggacttcctttgtgtgtcaccacaaagacatcactcagccatagctgtcttacagttcaagctcacacatggttgagtcactatgggaaaatcatgtacttattaagtcttggttatattaatgtaaccggtgtgctaaccaaccattcctggcccaatcgccttcattgtgctgactatacagaatggattcccttcaatagttcctacccccctccatagacccagtgtcttggcccactggctagaaaacaatctatgttaactggagacattgtggattggggacctaaaggccaattagatggaaaagaagaaaatcagaaatcgtggcacaaactttgctggcattggtggcaagcttttaatgcttcttctttatataacactgggatccaatcccagtcggccgcccagattgcttggcatggagcaggctttagcccgcctcttcctcagtggcattatctagggaggaaaggaccaattcaaaagatgatatggaaggcagcattcccatttatgaatggcaacatctgggttgccataatactatccaataatagcaatagtaagcaacacagtcttaatgttacatttgtaaagaatatcaccactcaatttacagtttgtgtttttaatccttatgtgtttttggcagctaagaaggaccagctccaggtaaacaatacccaattgacctgtaaatcttgccagttatatcactgcattaatcatagcacattgcaaacacataatatctctactttgatgattttaggttgcatccctgggctatggattcctgttaatctgtctgagccatgggctgccacaattgctttacattttgtgaaacttcttctaactcagtttactcattgtgtccgtagaggcttaggcatgataatttttgctattgtttacttggtcacactaataatttctgttgtgatgtcctctgtagctttgcatagttctattcaaacagctcagtatgtggagaactggacacgcacagtcaaccaagggtggctacttgagaataaaattaacactgagttacaaactgaagtggcagtgttataatccacgattctatggttaggggaacaagtacaaagcttgcaattgcagcagtaattgtgttgtcattttaatcacactcatatttgtgtaaccaacttagaatacaaccaaagtgagtatccatgggatcttgtgaaagcccatttgcagggagctttcacatccgacatcacctttgatattggtgaattacaaaacaaaattcttgatttaaataaacaaattccagagtttcagccttctttagaagactggactgaattccagcaaggcctggagagcgtcaacccttggacctatctaaagcaccacattaacatcttatatatagttcttggaataatgttgttttgtctctgtcttctgttcatagtctgtaaaatcggatggactgccaatcggagaatgaaagctacccagcctggccttacattctttcacttaatacataaacaagaagggggaaatgttgggagccaaaaaggccaaagggatggtgaccaactcagcattccactggaggctacatgatcaaacagcaaactgtttatcatgaatacagaatgtgggcaaactcgcttctgtgcctgcccagaaggtttgctgagggccatcgctccctggccccggctccttgaggttatctactgggacatctagagcctattgttcgaggaatgcagtcttgcaagcctactctggaccgagcagctgacctcttcttccacaccccttctcactatctcttttgcctaataaatatggagggctgtgtaaagctcagggcccttgtccactagaggcaaggtgtcccctgacccttcttccaaacata

SEQ ID NO: 12112 - DNA, 2169 bp, Homo sapiens
cctgattccatgttcttggccatgttagccataatatcctgtgcagtatgtttttcctgtgcagaggcaaaaacatattgggcatatgttcccaagcccccagcagtatgacccatactttggagtgacactcctcctaagatttatcatgattaaggagcatgggctccaggacccctaactccacctgacatagaacagttagactctcagaataatgtcattaattataccgctccattggaaggacttcctttgtgtgtcaccacaaagacatcactcagccatagctgtcttacagttcaagctcacacatggttgagtcactatgggaaaatcatgtacttattaagtcttggttatattaatgtaaccggtgtgctaaccaaccattcctggcccagtcgccttcattgtgctgactatacagaatggattcccttcaatagttcctacccccctccatagacccagtgtcttagcccactggctagaaaacaatctatgttaactggagacattgtggattggggacctaaaggccaattagatggaaaagaagaaaatcagaaatcatggcacaaactttgctggcattggtggcaagcttttaatgcttcttctttatataacactgggatccaatcccagtcggccgcccagattgcttggcatggagcaggctttagcccgcctcttcctcagtggcattatctagggaggaaaggaccaattcaaaagatgatatggaaggcagcattcccatttatgaatggcaacatctgggttgtaatactatccaataatagcaatagtaagcaacacagtcttaatgttacatttgtaaagaatatcaccactcaatttacagtttgtgtttttaatccttatgtgtttttggcagctaagaaggaccagctccaggtaaacaatacccaattgacctgtaaatcttgccagttatatcactgcattaatcatagcacattgcaaacacataatatctctactttgatgattttaggttgcatccctgggctatggattcctgttaatctgtctgatccatgggctgccacaattgctttacattttgtgaaacttcttctaactcagtttactcattgtgtccgtagaggcttaggcatgataatttttgctattgtttacttggtcacactaataatttctgttgtgatgtcctctgtagctttgcatagttctattcaaacagctcagtatgtggagaactggacacgcacagtcaaccaagggtggctacttgagaataaaattaacactgagttacaaactgaagtggcagtgttataatccacgattctatggttaggggaacaagtacaaagcttgcaattgcagcagtaattgtgttgtcattttaatcacactcatatttgtgtaaccaacttagaatataaccaaagtgagtatccatgggatctcttgtgaaagcccatttgcagggagctttcacatccgacatcacctttgatattggtgaattacaaaacaaaattcttgatttaaataaacaaattccagagtttcagccttctttagaagactggactgaattccagcaaggcctggagagcgtcaacccttggacctatctaaagcaccacattaacatcttatatatagttcttggaataatgttgttttgtctctgtcttctgttcatagtctgtaaaatcggatggactgccaatcggagaatgaaagctacccagcctggccttacattctttcacttaatacataaacaagaagggggaaatgttgggagccaaaaaggccaaagggatggtgaccaactcagcattccactggaggctacatgatcaaacagcaaactgtttatcatgaatacagaatgtgggcaaactcgcttctgtgcctgcccagaaggtttgctgagggccatcgctccctggccccggctccttgactggttatctactgggacatctagagcctattgtttgaggaatgcagtcttgcaagcctactctggaccgagcagctgacctcttcttccacaccccttctcactatctcttttgcctaataaatatggagggctgtgtaaagctcagggcccttgtccactagaggcaggtgtccctgacccttcttccaaacata

SEQ ID NO: 12113 - DNA, 6181 bp, Homo sapiens
gggagatggacggccgccgtgttttgggccggttctggagtggctggcggcggggcctgggtgtccgcccagtgcccgaggacgcaggctttggcaccgaagcccggtgattaagtaccccctctctcatgcgggacggaggctagggcagggggaaggcacgtgcgggatctggatcaggtagatgttacccgaaaacagccccgttggcctctctgagcctcggtgccctccgctgtagaatgggaccggtcgtacctgaattttcgaggtcagcccagacattgtgaggcatttgtcagaggccgcaggatttgggaagaggcgtccggagataggaatgggtggcacctcgggatggaatgactcccattgcttctccctccttgtccaggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggtgaggggtgagaggcacggccgcacaaggaccgggaggggactgcctcggcgtgcagttgggctctccattgaagccacgggatcagccctgcttctgcctcccactagcagcatgagctgggacaagccacctaatttgcaccctctccccgcttttaaccctactgccatgatgcagtagggttaagagtggggagaagatgcaaataactaccgagccttgcacatagccggcgctcagttacgggagttgctatactagattattgtttattggccgcggtggctcacgcctgtaatcccggcactttagggtgctgacgcgggcggatcacctgaggtcaggagttcgagactagcctggccaacatggtgaaaccccgtctctactaaaaacacaaaaattagccaggtgtggcggcgtccgcctgtaatcccagctactcgggaggctgaggcaggagagtcacttgaacccggatagcagaggttgcagtgagccgacatcgtgctactgcgctccagcctgggatgacagagcaagactcagtctaaataaataaataaataaataatgattatttatcgacggacaaaacacaggctttggagtcagacatacctaggctctgtgatcagcttgctgtgcggctttaggaaaataactgaatttctctgaaccccactctctattcagtgatttattccttttctcaactatttcttgaacatatgctatgttccaggcactgttctaggcaggctatacagtgctgaaaaagatagatatggtttctgctctcaggggagaaatggatttctctctaacgggagaaatggatgtcagaaaataaatgaacaagttactagtggtaagtgctatgcataaactaaaacagggtgttatgatggtgaggaactgcaggaggaaggcagacattagattggagattcagacctctccgtgatgtgacatttgagccaagatgatagggagccagacctgggaaatttggggacaggaaacagcaagtgccgaggctctgaggtggcagaggaacagaaagaagttgaatttggtgtggggtagttaactcatgtctgagagtcatgatggggacatgtgctaagatgcgtgagaaagtgctctggaaactctttagtgctgcataaagggttaccgttgcttttgctgatgttcgtgtgatgtatgtttcaggacctctagtgacgttgaacaagccacagggtctaccagtgacaggtatgggccggggatgtgggaagggaatgcagcggaagggggtttcgtgactgagggagggaaaagtgaaggcatgaagctttggcctcttgtaatttttctttcttactttccaggaaaaccaggagagctgacgttgttctcagtgctgccagagctgagccagtccctagggctcagggagcaggagcttcaggttgtccgagcatctgggaagtaagtggtaggggtgacaggaagctaggagtacaggcatccatctgtggtggggaaacagctgcttggggataagctgagacattttccatgggaaggtttgagatcatagaggtggatacaagtactgtgaagaagaggaagccgatggctctgggttcaaatcctcaagtacaaatggtgtgataccaggcaaagcatgacacctccctgacgctgggcacagtgactcacacctgtaatcccaacacttctggaggccaaggcaagaggatcacttgagcccaggagttcgagaccagcctgggcaaaatagaccccatctctggaaaaacaacaacaaaactttccgcgtggtggctcatgcctataatcaataggactttgggaggccgaggtgggaggattgcttgagtccagaagttcaagaccagcctgggcaacatggcaaaaccctatctttacttaaaaaacaaaataaaacacacacacacacacacacaaaaacctagctgggcagagcagcacatgcctgtagtgctcgggtggctgagatgggagaatcacctgagctcagaagatggcagctgcaataagctgagatcccgccactgtacgcaagcctaaacaacctgaatgagaccccgtctcaaaaaaacaaaacaaaacaaataccctccctgagcttcagttcccctaatggtaaaatagagaaaataatacctatgctcagtgtgcagtcatttctccatgacggtactcgtggcaggcattgctagtcgatccatgatactctttcctctaactgccatcaattaaagatggtacttgagatgaaatatttctgcagttccacaaactcatgagcttttttgtagagaacttatttaagagctaatatgtacagaatttctagtagaattctggcacatggtagacaatcgttacgacatttggctctgagttccctgggggccggggcaaaatgagaaacacattaagctacatagtcttgttatcaaagaaggggaaaccttacttgtttctcaggagttggtctaggttatagtcctggtgttagtgtttggcctgaagcaggtcagtgttcctaagagtttcctttttagtgggcgagttcaagggactttaacttgtgtgatttgtctgcttattccagagaaagctctgggcttgtactcctctccagctgtccccagacagctagtcgcctccagaagtacttcacccatgcacggagagcccaaaggcccacagccacctactggtgagaggtgctgggaggttcctagagtggtggggaggtcccagcaagccaccctgtgacctcctcctgcccctttctcagtgctgtcactgatgggatcccagctgcttctgaggggaagcttcaggctgccctgaaactggaacacattgatggggtcaatctcgtgagtccgggtctgggaagaggaggggtgcttctagatatagtacccctacagagaggagtcaggggtatggatttgggatggctggctctcctgtcccctaaaacaggcaagtgaccactgcctatactgtggccctgcccggagtctattgggagcagggagggtctgggtatagctcccagacctgtgtaaggcttgttcactcttggctggcaccacagacagttccagtgaaggccccatcccgaaaggacatcctggaaggtgtcaagaagactctcagtcactttcgtgtggtagccacaggctctggctgtgccctggtccagctgcagccactgacaggtaggtctggcaccctagccagcctttaaaactgcacttgatttgggaggctgaggcaggtggatcacgaggtcaggagttcaagaccagtctggccaagatggtgaaaccctgtttcaactaaaaactacaaaaattagctgggcacggtggcaggcgcctgtaaaaccagctactcgggaggctgaggcaggagaatcgcttgaacctgggaggcagaagttgcaatgagccaagatcatgccactgcactccagtctaggtgatagaggagacttcatctaaaaaaaaaaaaaactgcacttgagccaggcgcggtggctcacgcctgtaatcccagcactttgggaggccaaggcggatggatcacttgaggtcaggagttcgaaaccagccaggctaacatggtgaaaccctgtctctactaaaaatacaaaaattagctggagttggtggcacgcacctgtaatcctagctacttgggaggctgaggcgggagaatcgcttgaacctgggagacagaggttgcagtgagcgaagatcacaccattgcactccagcctgggagacagagtgaaacgctggctaaaaaaaaaaaaaactgcacttggcttagggaggcaaggagctggggagacagtggtatcagcagcagcctggggagcatttgatggcccccagaggtgtatgtgaccaggcccagctagaggaggcagcttcaggctagcaccccaacaggaaagaacagtccttaggcccggtggcttcagcaattaaatcagggttgcatctcatcatgagtggatcccacagccaggcagattgatagctgtgatcgtcctgacgtgttatgtgtccctctctggatgcaggggccatagtactgacctcactgaaacatatgatctgagaaagggggtggtgtttccccaaaggaaaaggggaggagtgatactgggtggcacagaacgagtagctgcccactgtctctcctggctttcctgttgcccagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtactccagcccacctgcctgctgctttctgaggggtggagggagaggtgagcatgggcagcatctccagaccttatctgtgcagcttgggactactgggaggcagcccttttggctcccaaggctgtatccgtacccacatcttggtgtgtggccttgggcaagtaacactcactctcttgggcttcattctgtccatgtgttcaataagggagttgatgtggctaatttctaaagccctcttaagtctgccattctttgagtctggtacaaagggtcaaaggcatgcgtgtattaggacaccagatgcctctacctgctctaacacactaagcccagactaccagagtcttcacacaagaactgtgccctcatgttaaggtcaaataatgggagtgggctctgcttcaagcactaagtactcagggacccaggctgttgatacccagccagatgaggggagacagtgtaggttcaagtggataaggtttttctgggccaggtgtggaagtggcatacatactgccacccacattcactcagctagagctcactcacgtctcaccaagctgtgagagggctgggaaatggagttgaggtgtgtgcctaggaggaaactgattgggtgaccccctagccagtctctgctgcagtgtgagtgcctgtgtgaatgtgcacatctgtgtgcaaagaggaaatgattaacagttgcagaacagtggggaatggaggaagcgcccgccttactcccatttcccttagagctgggtactcagctgcttggaaaatgtggggctgaacacaacgtacctctcccgctccaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctcatgttatggttttgaggatttgctaagaaagtaaa

SEQ ID NO: 12114 - DNA, 6195 bp, Homo sapiens
cgggagatggacggccgccgtgttttgggccggttctggagtggctggcggcggggcctgggtgtccgcccagtgcccgaggacgcaggctttggcaccgaagcccggtgattaagtaccccctctctcatgcgggacggaggctagggcagggggaaggcacgtgcgggatctggatcaggtagatgttacccgaaaacagccccgttggcctctctgagcctcggtgccctccgctgtagaatgggaccggtcgtacctgaattttcgaggtcagcccagacattgtgaggcatttgtcagaggccgcaggatttgggaagaggcgtccggagataggaatgggtggcacctcgggatggaatgactcccattgcttctccctccttgtccaggcatcagaggcaaccccgcggctcctgccaacggtcggggcccctcggggaccagcccttcgcggggctgctgccaaaaaacctcagtcgggaggagctggttgatgcgctgcgggcagccgtggtggaccggaaaggtgaggggtgagaggcacggccgcacaaggaccgggaggggactgcctcggcgtgcagttgggctctccattgaagccacgggatcagccctgcttctgcctcccactagcagcatgagctgggacaagccacctaatttgcaccctctccccgcttttaaccctactgccatgatgcagtagggttaagagtggggagaagatgcaaataactaccgagccttgcacatagccggcgctcagttacgggagttgctatactagattattgtttattggccgcggtggctcacgcctgtaatcccggcactttagggtgctgacgcgggcggatcacctgaggtcaggagttcgagactagcctggccaacatggtgaaaccccgtctctactaaaaacacaaaaattagccaggtgtggcggcgtccgcctgtaatcccagctactcgggaggctgaggcaggagagtcacttgaacccggatagcagaggttgcagtgagccgacatcgtgctactgcgctccagcctgggatgacagagcaagactcagtctaaataaataaataaataaataatgattatttatcgacggacaaaacacaggctttggagtcagacatacctaggctctgtgatcagcttgctgtgcggctttaggaaaataactgaatttctctgaaccccactctctattcagtgatttattccttttctcaactatttcttgaacatatgctatgttccaggcactgttctaggcaggctatacagtgctgaaaaagatagatatggtttctgctctcaggggagaaatggatttctctctaacgggagaaatggatgtcagaaaataaatgaacaagttactagtggtaagtgctatgcataaactaaaacagggtgttatgatggtgaggaactgcaggaggaaggcagacattagattggagattcagacctctccgtgatgtgacatttgagccaagatgatagggagccagacctgggaaatttggggacaggaaacagcaagtgccgaggctctgaggtggcagaggaacagaaagaagttgaatttggtgtggggtagttaactcatgtctgagagtcatgatggggacatgtgctaagatgcgtgagaaagtgctctggaaactctttagtgctgcataaagggttaccgttgcttttgctgatgttcgtgtgatgtatgtttcaggacctctagtgacgttgaacaagccacagggtctaccagtgacaggtatgggccggggatgtgggaagggaatgcagcggaagggggtttcgtgactgagggagggaaaagtgaaggcatgaagctttggcctcttgtaatttttctttcttactttccaggaaaaccaggagagctgacgttgttctcagtgctgccagagctgagccagtccctagggctcagggagcaggagcttcaggttgtccgagcatctgggaagtaagtggtaggggtgacaggaagctaggagtacaggcatccatctgtggtggggaaacagctgcttggggataagctgagacattttccatgggaaggtttgagatcatagaggtggatacaagtactgtgaagaagaggaagccgatggctctgggttcaaatcctcaagtacaaatggtgtgataccaggcaaagcatgacacctccctgacgctgggcacagtgactcacacctgtaatcccaacacttctggaggccaaggcaagaggatcacttgagcccaggagttcgagaccagcctgggcaaaatagaccccatctctggaaaaacaacaacaaaactttccgcgtggtggctcatgcctataatcaataggactttgggaggccgaggaaggaggagtccttgagcccataagttcaagaccagcctgggcaacatggcaaaaccctatctttacttaaaaaacaaaataaaacacacacacacacacacacaaaaacctagctgggcatagcagcacatgcctgtagtgctcgggtggctgagatgggagaatcacctgagctcagaagatggcagctgcaataagctgagatcccgccactgtacgcaagcctaaacaacctgaatgagaccccgtctcaaaaaaacaaaacaaaacaaataccctccctgagcttcagttcccctaatggtaaaatagagaaaataatacctatgctcagtgtgcagtcatttctccatgacggtactcgtggcaggcattgctagtcgatccatgatactctttcctctaactgccatcaattaaagatggtacttgagatgaaatatttctgcagttccacaaactcatgagcttttttgtagagaacttatttaagagctaatatgtacagaatttctagtagaattctggcacatggtagacaatcgttacgacatttggctctgagttccctgggggccggggcaaaatgagaaacacattaagctacatagtcttgttatcaaagaaggggaaaccttacttgtttctcaggagttggtctaggttatagtcctggtgttagtgtttggcctgaagcaggtcagtgttcctaagagtttcctttttagtgggcgagttcaagggactttaacttgtgtgatttgtctgcttattccagagaaagctctgggcttgtactcctctccagctgtccccagacagctagtcgcctccagaagtacttcacccatgcacggagagcccaaaggcccacagccacctactggtgagaggtgctgggaggttcctagagtggtggggaggtcccagcaagccaccctgtgacctcctcctgcccctttctcagtgctgtcactgatgggatcccagctgcttctgaggggaagatccaggctgccctgaaactggaacacattgatggggtcaatctcgtgagtccgggtctgggaagaggaggggtgcttctagatatagtacccctacagagaggagtcaggggtatggatttgggatggctggctctcctgtcccctaaaacaggcaagtgaccactgcctatactgtggccctgcccggagtctattgggagcagggagggtctgggtatagctcccagacctgtgtaaggcttgttcactcttggctggcaccacagacagttccagtgaaggccccatcccgaaaggacatcctggaaggtgtcaagaagactctcagtcactttcgtgtggtagccacaggctctggctgtgccctggtccagctgcagccactgacaggtaggtctggcaccctagccagcctttaaaactgcacttgatttgggaggctgaggcaggtggatcacgaggtcaggagttcaagaccagtctggccaagatggtgaaaccctgtttcaactaaaaactacaaaaattagctgggcacggtggcaggcgcctgtaaaaccagctactcgggaggctgaggcaggagaatcgcttgaacctgggaggcagaagttgcaatgagccaagatcatgccactgcactccagtctaggtgatagaggagacttcatctaaaaaaaaaaaaaactgcacttgagccaggcgcggtggctcacgcctgtaatcccagcactttgggaggccaaggcggatggatcacttgaggtcaggagttcgaaaccagccaggctaacatggtgaaaccctgtctctactaaaaatacaaaaattagctggagttggtggcacgcacctgtaatcctagctacttgggaggctgaggcgggagaatcgcttgaacctgggagacagaggttgcagtgagcgaagatcacaccattgcactccagcctgggagacagagtgaaacgctggctaaaaaaaaaaaaaactgcacttggcttagggaggcaaggagctggggagacagtggtatcagcagcagcctggggagcatttgatggcccccagaggtgtatgtgaccaggcccagctagaggaggcagcttcaggctagcaccccaacaggaaagaacagtccttaggcccggtggcttcagcaattaaatcagggttgcatctcatcatgagtggatcccacagccaggcagattgatagctgtgatcgtcctgacgtgttatgtgtccctctctggatgcaggggccatagtactgacctcactgaaacatatgatctgagaaagggggtggtgtttccccaaaggaaaaggggaggagtgatactgggtggcacagaacgagtagctgcccactgtctctcctggctttcctgttgcccagtgttctccagtcaactacaggtgcacatggtactacagctctgccctgtgcttggggaccacatgtactctgcccgtgtgggcactgtcctgggccagcgatttctgctgccagctgagaacaacaagccccaaagacaggtactccagcccacctgcctgctgctttctgaggggtggagggagaggtgagcatgggcagcatctccagaccttatctgtgcagcttgggactactgggaggcagcccttttggctcccaaggctgtatccgtacccacatcttggtgtgtggccttgggcaagtaacactcactctcttgggcttcattctgtccatgtgttcaataagggagttgatgtggctaatttctaaagccctcttaagtctgccattctttgagtctggtacaaagggtcaaaggcatgcgtgtattaggacaccagatgcctctacctgctctaacacactaagcccagactaccagagtcttcacacaagaactgtgccctcatgttaaggtcaaataatgggagtgggctctgcttcaagcactaagtactcagggacccaggctgttgatacccagccagatgaggggagacagtgtaggttcaagtggataaggtttttctgggccaggtgtggaagtggcatacatactgccacccacattcactcagctagagctcactcacgtctcaccaagctgtgagagggctgggaaatggagttgaggtgtgtgcctaggaggaaactgattgggtgaccccctagccagtctctgctgcagtgtgagtgcctgtgtgaatgtgcacatctgtgtgcaaagaggaaatgattaacagttgcagaacagtggggaatggaggaagcgcccgccttactcccatttcccttagagctgggtactcagctgcttggaaaatgtggggctgaacacaacgtacctctcccgctccaggtcctggatgaagccctcctcagacgcctccacctgaccccctcccaggctgcccagctgcccttgcacctccacctacatcggctccttctcccaggcaccagggccagggacacccctgttgagctcctggcaccactgcccccttatttctccaggaccctacagtgcctggggctccgcttacaatagtcctccctctgttcctgaccccctcacacacactggaaagtgagggtgggggctctgcagtcagacaaacctaagatcacatcctggacaggccacttgcttgctgtgtggcattgggcaagtaactttacctctctggacttgtgataataaaagttcctacctcatgttatggttttgaggatttgctaagaaagtaaatgtttattacgga

SEQ ID NO: 12115 - DNA, 130 bp, Homo sapiens
ttttttttttgagacggagtctcgctcgtcgcccaggctggagtgcagtggcacgatctcggctcactgcaaactccgcctcccgggttcacgccattctcctgcctcagcctcccgagtagctgggact

SEQ ID NO: 12116 - DNA, 10468 bp, Homo sapiens
ttgggattatctcatttaagatcttaaatttatttacatctgcaaagacctttttttttttttttgatttagggtttcactctgtctcccaggctcagagcgcagtggcgtgatcacagctcaccacagttttgatcttcccaggctcaggtaatcctcccacctaggcctcccgagtagctaggactacaggtgtgtgccaccacacccagctaattttctgtagaaacggtttcaccatgttgcccagactggtcttgaacttgcgggctcaagcgatctcctgccttggcctctcaaagtgctgggataacaggtgtgagccaccatacccagctacaaagactcttttcccacataaggtcacattcacagggtccaagtagacatctcttttcaggggaccacagttcaacccactacaactaagcagtgccacacttttcttcaggtgggtgtggcttattggatgtttcatttttaggtgaccttggccccttgctgaagaagggatagacccatgccctctgcagaagggctgaggtttaggcaaggccaattccttcccctgtctcatggcattaacgttcctatgcccggtaggtgtcattctgctagcttggcttgttctctggggttggggggctcccagtgctcggcagttctggcaatatgtccctgcgtcgactcactgccacgtgatcttgggtaagccatgcctcctctttcagactcagtttcttcatctgtaaagtgaaggctcacgctccccacccctggatcggagatgctgggggagtccctaaataggaagccccatgtctgtccttaggtgggaattctgggcctcgctgcacggaggagctgctgatggcctcaggctcttgctgtggaccctggggtacacggcctcgccccatccactcttgaccctccaacagcaatggagtcaagccccaaatacttcacttgtttctttttatttggtgttggatccaggacaagggcagtggggaatcgaagcaggggcttccctagcttcatatcccccaggcccctgcgcctctggaatgtaccaacaaggggcaggggtttcagggggctcagcctcttcatggggcaggcctcagccctgggtttgtcacagtctggccttgaatttgcctttggccttgaccttccgacaggtgctaggaattgttccgacttcaaagggcagaggcaacaaggcacttccagctgggggcctcggaggcacaggagagcaggagcctcggtgtgaaaggaggggagaagagggagatgatcagaagtctgtggaggaaggggcttctgagggagaccagctcttcccttggggtgccagccagcctgggagctgccctctgcctgtgccctccagccctgaccccgtgctcagcactgtccactgggtgtgagtcacaggtcgaggcccacctttcttggcttcaggatgctgggtgccaccttgaaatcaaggttcggtgggagggaaatgaagaccttagccgtgggtagagtcctcaaggccttgcctgtggtcgacagggccttagtgcccaccagcttgctgtgctgtcgtctgaggacctggccctggtgtcggagtacatggggagaaggcagctgggccttggtgtggaggctggggaagtggtgacgggctgtgggagcaagagaagctgtgaggccctggggtggggcccaaggtggcctagctgccctaacaggtacgtgtggaggatggggggatatggagggaatggggtgaaggccgacggagccctcccggttcctcctccagaggcagtgagaagaaaacagggtagagtccaacagacctgggtctgcatcccagctgtgccccttctgagctgtgcaaccttgggcaacttccttaaacttcctgatacctcggctggaaaatggggataatagcacctaccttgctaggttggtgtaaacactaaaggagctgggcaggtagcggtatggggcaaactgttaagtgctggacatgtgttagttctttccccgagaggtgactgcttgaaggcaaaggcagaatactgcagtgggaaaagcgtgggcgctggagagagcaacctgggcttaagtcctggcatctttgaaatcaggtcatctttgaaataagtcactctgtgaggcagagtgactactttggaggagacaatactcatttggctgggttttttttttttttttttttttgagacagagttttgctcttgttgcccaggctggagtgcaatggtgcaatctcggctcactgcaacctccgcttcctgggttcaagcgattctcgtgcctcagtctcccaagtagctgggattataggcacctgcccctacactcggctaatttttgtattttttagtacagatggggtttcaccatgttggccaggctggtctcgaactcctgacctcaagtgatctgcccgcctcggcctcccaaagtgctttttttgtgtctttgtttttaagacagcatctcgctctgtctcccaggctggagtgcagaggtgcgatcataactcactgcagccttaacctcccgggctcaagcgatcctcattagcctcgcgagtagcctggaccacaggctcacaccaccgtgcccagctaatttggctgtgtatttttaaacaatactttgtgagtagtggcttttacttgctactggtggctctttggtggggtggctgatccaggtggttgggaggggcctggagagcaggaataaatcgccttggaacactcgggtgttttgggggaatggtcttacccagggcccgggggttcttcggactcagtggcaatctgttcaagtggtggggttgcctgtccccactagaaaaggtcatggtgaaaatgcagcccatcctggtgctgggggcatcccactcccagagattggggcagaccagggctgtggcccttttcgccttgcctttcttcccctttccgggggctgaagtggtggcagtggagactggcttctcactgtgccccaggctcctggccccagtgcctttcctagaagctgacctgtgggtaggggtccccgagtccttgccttccccagagcctcgctgggtcagcagagggactgctgggcggacccccatccgccgatgacacatcgccatgggcttcttgatggtgaagccctctaccaggagccggatgcccacatattgaggcacctccacagcaggctgtgggcaagaagaggagacaaggcccactcagtcagtggtactggaatccttggcccagcgggacccagagtagagatgggtggaattactttctgaggcacctggtcaaagaggcgtttctgagctgagaaatggaaagcccacctctgagtcagtacctagagtcacagagctccaggaattgctagcccagaggaagggggaatcctagccatgtcccaccagcacccctcagccacatttccctcctaagctgcccccagcccctgctggaatgcgtgtggctccactgcacaggccactgctggtggacagcttcctgagctgagccaatcagattctctgcacagagaatttgagttacgccacccaacaagtaagaggtttggagcctgcctagagcctcgtgtgaatccaggttatggggtagcagaaactaagaaccttaaagaagacagtctgtggagagaatgaagtaacgaatatgcagaggaaggcagagagaagggtccaggagagggactcccttacaactctcagttcctatcaggccaagctgtatgtcctgccctcagctgggctccaggagagctccctgtgccttgctagcaacctggagccagttggaggtatcttctgtgccactgaaggatcctgatcagaatctatctaaacatcagaattacttggagcttgttaaaaatacagctattggccgggcatggtggtcacacctgtaatcccagagctttgggaggctaaggttggcagatcacttgaggtcaagagttcgagatcagcctggccaacataaccaaaccctgtctctactaaaaatacaaaaaaattagcaggtcatggtggcaggcacctgtaatcccagctactcgggaggtcgaggcaggagaattgcttgaacccaggagacagaagttgcagtgagccgagatcgcaccattgtactccagcctgggtgaaaagagcgaaactccgtctcaaaaaaaaaaaaaaaaaaaaaatgcagctattgccgggcgcggtggctctctgggaggccaagacaggcggatcagctgaggtcaggaattggagaccagcctggccaacatggcgaaaccccatctctactaaaaacacaaaaattagccggccatggtgggcgcctgtaatcccagctactcgggatctgaggagaatcacttgaatccgggaggcggaggttgcagtgagccgagctagcaccactgcactccagcctgggtggcagagtgagactctgtctaaaaaaaaaaaaaaaaaaaaatcaaataaaaatgtagctatcagcactcccaagtagccccagatgatgagggaaagttcatctttacagaagaatctcagctaataaatgcagaaggaacaacagaattagacatttgccattttgcaactctaataaaataggcaataatcaaaactggtatcaaaacaattagatgaaaggatgacaggaaaatgtgtaatctggacagagccaacacagcaccttacagaaaaattaattgcaaaggggagatgtagcttataatggagagaatctggtagccaccactgtaacccacagtcaaactcagcagcactaactgtgagacactctcacaggatgtgccttgtgatgccacatgaggtacgcggcatcacctctgaagtgctcttgggaaaaatgtttaacctcatcaaactatttgacctaacttctagttcctgagacaatcagctaacagaagaccaaggtaaatcacaccataaggaaacaatcagataaatccagaatgtgggacagttctacaaaacaacccgcctggcccctcaaaagatcaaaactatggggtcaaaaggcactggggctggcctagatgaaaagagacaaaaaaaaacagtgcaaggtataagcctttactatgtgctggcctaaaaacaaaaacaagaacaaatcagcaataaaagacatttagagggcttggcgcggtggctcatgccagtaatcctagcattttgggaggccgaggcgggcaaatcacgaggtcaggagatcgagaccatcctggctaacatggtgaaaccccatctctactaaaatacaaaaaattagccgggcatggtggcaggcacctgtagtcccagctactcagggggcggaggcaggaaaagcgcttgaacccgggaggcgcagcttgcagtgagccgagatggtgccactgcactccagcctaggcaacagagcaagaccccgtctcaaaaaaaaaagatatttggggggcatttgaaaaatgcagatatacatagtctcctccccaagctagacattttgggtcaatctctgggggtggagcctcctcacatccatacctttagaagctttcagatgcttctggcctgggcactggcattgggagcactgcactacaatggcaccttttccctcagcttgctcatattttcctgcccatgtatttccccgtttacattttttgaaaccaaaacgccaatatattaatttaagaaatgatcaataacaactgtaacaaaggcgaggtcacttaggtcatgtgatcagtacgttctcttcctgtaaccaaaccttgacagaaaccggaggctaatcagaagccacttaaactgccacaagaaattctatccagaactcagaaagccttgcaatcaattttctgactgattttttaaaatgctgttctattttacaagtagactccaatctctttttggagcaagacgagtgaaataattataatactactaataatagtagctaccagtaattgcctattactatacattcaggcactttacaggttatacatgatgaaactcctaaccttattaggtaataataacattagctaaaacttagtagcatttactacgtgccaggcactattctaaagtactttactggctgggcacggtggcttctgcctgtaatcccagcactttgggaggccgaggtgggcggatcacctgaggtcaggagctcgagaccagcctggccaacatggcaaaaccctgtatctactaaaaatacaaaaattagccaggcgtggtggtaggcacctgtaatcccaactacttgggaggctgaggcaggagaatcgcttgaacccaggaggtagaggttgcagtgagccaagatcatgccactgcactccagcctgggcaacagagcgagactctgtctcaaaaataaataaatgaagtactttacttatcaactcatttaattctcacaactcatagtacctaactttgtgagttaggtactatttttattcttacggacaaggagacctaggggttaggaacttgtccaaagtcacatagcttgttgtcactgaacaggaatttgaacccaaggagattccagaatctctgctcttatggctatgctatatgcctctctagaaatattatcctcatacatgaattcattttattctcccattcccatgagaaagatggtaataatatccccatttcaaagatcaggaaactgaggctcaaggaagtgaggtcaccttagcaggaccaggacttgaatctgggtcttaaactgggtctgactgcagagtcctatgctccactgcagggctgcctggaagagggtgcagactctctggggtcctgcctgggcccaacctcctcacctgcttatagatgagctcaaaggctcctgtgtcacagttgcggtccagcatccggtcaatgaccacgcgcagggtgtcagcttgcacgccagcacagagccgggcagtgactgctgtggagggtgccatcgtggggctggcgttgatctcaatcagccagggctggaagtcctccccgaacacgaagtcagcgccatagagctcaaagctggccttccgacactgcacggtgtcctgggaggtctgaagtgcgtggatcacagcatccttcatgccaggcacgatgatggtggaccaagcatttggggcacccatctcctgcaggtgggcctggaacctctggctagaccacatgttgtctggcggaagcagtggatgccgatggcatgagttctccaggtgcttctggatggagttgttgcacaggtgcactgagctggggcagagaacagaaaactgaggtccaggcccttgtgtctctcccatccaaactcagggaggacaggcaagtcctggaagcagccctgggccaccctgcactattcaacttgagatggggccctactgggaaggacaaaaaggacagaggcctgggccccaccacattcttctagggccagaaccactcttatctctcagggctgctctgagggcgctagttacgggggccgcagtagtaagtgctttgtgcatagtctcagttaaccatcccagtgtctggaagataagagggtgggtaagggtatggccccgtcatcgccaggacgtgttcaagcgccatctccacactagttgtgagaccttagggaagtcatctaacctgtgtgctcttcacatctgcaaaatgggggtagtaacagtacccacttcactgttttttatatttttcttcagacctggtgaacaagaagtatgcactgggttcttattaagaatgagatcatgtatacaaagtgctcagcactatcacatatgaagcactcaataattgatagctatgaatttcatactactgcctccattcttcagatgtggaaaccaaggcttaaataggttttcacatgaccagattcaaacaacttggaagctgcagagacagaattggaattcaggctttaacaaggctttctctcaccctagaagttaacacgacatcttagttttcaaaactcctgacctcctttcccctgctctacatttgcttccctttttcccccaacgacaaatataatctttttttttttttttttttttgagacagatccttgatctgtcacccaggctggagtgcaatggcacgatctcagttcactgcaacctccacctcccaggttcaagcaattctcctgtcacggcctcccgagtagctgggactactggcgcccgccaacacgcccggctaatttttatatttttagtagagacggggtttcgctatattggtcaggctggtctcgaactcctgacctcaggtgatccacccacctcggcctcccaaagtgcttggattacaggcatgagccactgggcccagcccaaataatcttttaacctgttagataatttcacttgtgttcttgcttgcctgtttctccctgctagaatgtaagcccttgagagctgggatcttgttttgttcactgctataccccaagtgcccagaacagtgcatggcacaaggtacacactcggtcaaatctgttggaggggccaggcatagtgtaatcccagcactttgggaagccaaggtgggatgatcgcttgagcccaggagtttgagaccaacctgggcaacatagtgagaccccatgtctacattaaaaaacttaaaaatcagctgtggtacatgcctgtggtctcagacacttgggaggctgaggaggaaggattgcttgagcacaggaagtcaaggctacagtgagccgtgaccatgccactgcactccagcctaggtaacagagtgagaccgccccctgtctgttaaaaaaaaatctgttggatgcaaggacagctggcaggatgagggcctgcctgcctgcagtctgtgtgtggagcctagcgctgctgcgcgagtcccctgcactgtaatcgcctgtttgcttgccagctccccaactaggcagggagctcgtgggaggcgagcagaggggctcacttgtccaggttcttcagggagaagggctgcgtggaaaagcggatatagctgtcgcggtagaaccacacggtaagtgggttccagtcagttaccaggaaccactgtctgaggtcaaacttggtgccaaagatgaggaggggccgctcaatatacttctgcaccacccacttgccgtccttcatcaccacggggttgccgttcaccagcttcagcatctcctccaggtggtccatgcacatgatgcctacgggggaagagggcagtcagggattggaaggtcaggcgtgggccaggagaagggccagcttgtcatgagctcttgtcccctcggagctgatagggctgagtgggtaaggctgtctccctcaatcagaacccagttccctttgggaaagccaggaatttgctaaggattttaaatttttcctaattaaccagttttgtttgattaaacaggaatacatacatggatacaaatttaaagtgctggactttttttttttttttttttttttgagacagccctgtcacctaggctggagtgcagtggcacgagctcagctcactgcaacctccgcctcccgggttcaagtgattctcctgcctcagcctcccgagtagctgggattatgggtgcctgccaccacacgtggccaatttttgtatttttagtagagacagggtttcaccatgttggccaggctggtctccaactcctgacctcaagtgatccacccgcctcggcctcccagactgctgggattacaagcatgagccactgtacctggccagtgttgggggcttttttaaagtatgtgcacctattacgttcctaccaataataaatagactataaaacaaaacaaaaattaggcagtacgaaagggcatacaataaaaaatgtatctccttgtctagaggcagccaactgctgcttccaggaccttatggatatccttctggatcatgtgaaagcctacacgtgcctccgtttcccaggattgcataaattgaagcacgttgaggatttggaatagtgctttagctgcatgactgcatttaatcctcacctcacaggaggtattatcatcctcctcatgtcacagatgagggaactgaggttcagggaggcgctaaaacctgctcaaggtcacgaagcacattagtagcagagctaggactcaaacccaggcaatttggcttcaatagacctgcactattaacttccttggcctctactggtagatgcaggtggtgaggtgccagtgcaggaagcaggagctgacccccacctcgtccgcgggacttggctcctggcttcacgatccagatgttgcgatcccc

SEQ ID NO: 12117 - DNA, 710 bp, Homo sapiens
cctgagctcaggagttcgagaccagcctgggcgacatggtgaaaccccgtcactaaaatacaaaaaattagccgggtgtggtggcgggcaccgcacctgtaattccagctactcaggaggcaaaggcaggggaatcgcttgaacccgggaggtggaagttgcagtgagtcgagatcgggccactgcagtatagcctgggtgacagagcgagactctgtctccaaaaaaccaaaaccgaaacacattaggaaaatgttcacaacaaactcaaagtggagactggggagggagtgaaaactggaagcacgcagtaaaggggaatttacttttatccctttcatttcttaaacaagaaaaacaggaaacctatacatatatatattgtttcacaatgactaattctgatggtaggaatgtgggcagtcattatattattcttttttttctgtgttcttctactttctttttcttttttcttttttttttttttttgagacggagtctcgctcgtcgcccaggctggagtgcagtggcacgatctcggctcactgcaaactccgcctcccgggttcacgccattctcctgcctcagcctcccgagtagctgggactacaggcgcccgccaccacgcccggctaatttttttgtatttttggtggagacgtggtttcaccgtgttagccaggatggtctcgatctcctgacttcg

SEQ ID NO: 12118 - DNA, 1148 bp, Homo sapiens
gcaattccttctggcttcctgtgacctcacgcaagaaaaagttgtgtactaaatgaatctgctttaacttgctctccttcctcggggatcacacctttttaagaaagcctgtcccttaccttgaagcacaaacatattctcatttttattctcccaataccttgaaggttttcttctgcacatgtatttgtttgatctgccttttgtgcgtggggtgggagttaggtaggaatcttaaagtggagagccagtttcttcccaaattactgacctaacccatccttaacccccagttcaaggccacctttgtgatagtgaagcttccacatgctcactcagccccttctgctctctcttcttctctactgtgcatgtcggcttgtacttttgccagtttctctaaagacacaaccagaggtggggtggctgtgtgtgcacaacttcaactttacatgtggggctgagtccctatgttgtatatccttgtgcaaaagcacaatatgttaattgctatagcttttaaaaaaataattaatagtttttcataatcaaattttcttgcttttttgttttttcaaaaaagcatacttttattgaagaataaaccccttatatatgtacacttatttataactatgaaccatgaactaggatagaaatgcattgtgtatattacaaaacataacaaaaataataggggtagggaggtgcagatgttggtcaaaggatataaacctgcagttctatgatgaataagttctggacatctggaatacagcatggtgactatacttagtaatactatattgtacacttgaagcttactgaaagagtaaatctcaagtgttctcaccacacaaacccaaaggtaactatgttctcaccacacaaacccaaagggaactatgtattaattagcttgattgtggtaaccatttcacaatgtatacatttgccaaaacattatgttgtatacctggaatatataattttatttatcaattatacctcaataaagctgaaagaggggattactaattcccacaaaatacagatttaacaaaaacttttattcaacaaacagtgctatgaagttgtaaattggaaacaaaagaaataaaatttcatccacagtcttctcatcaaaa

SEQ ID NO: 12119 - DNA, 2131 bp, Homo sapiens
tgcagcagaattcattccatgtcccctctggatattagactgataatttggatcaggtctcagcatgggccattgaggaacactacagccctgctgagagataaaaaggattatccactcaaggagttcacacctccgggccgacatggagaacgtgcctagaagcagacttggagggtgctcagtggtgggttgtggaatgtaagcctgaagaagcagagtttaattctacgggggtgctttcataatttagtaccctgacagggctcctggtgttggtccttagacactcctgggatggctccctggaaacatggaggaaaccttggtcgcatgacatgatacggagatgttggagctgcctggacacagttacagagggaggcattaaaaggcttcgagaggtaggcatgctagagtggactttcccactaaacctgagaactcactggataactgtattccctgcgagagcccagagaaccctctgaattaggaaagaagggcatgttctgaaatgggaggaatcagcgttcttgagagtcttggtggaagctgtgccctgtggggcagggttgactataggagacgctgttaaggaattagctcccaagggtcaatggagatgatgtaatttcaaaataagagtccaaatgggcagaattagtgtgagaagacataaagccagaaaagcagccaaggagccctgctctacagaaatctggggtgacagctaataaaccacagtgttcctaggggtaaggaaattgggctaccacagtggtattccacatatgtattccatatatacatatatatctctcccatatatatatatatatatatgagatatatatatgagatatatatgggagagatatatatgatatatatgagatatatatgagatatatatgatatatatatgagatatatatgagatatagatatgtatatctctctcatatatacataatacatatctctctcatatatatatatatatatatatatatatatatatgtaattggaacgtattaagagaagatgaatgaaagaatgatgtcagctcctcctgttctccaactcagagtcctttgaatgaaggggaaggcagattgccttgagggagaaccttgtaatgttctagcaagtatatatggcagtgattctccgagccttttcccccaaaagatcgaagactagttacctgagaaatttgtacacctagggaaggggaataactaggtctttcaaggctgttggagacggcatctgagctaactttgataccaagaaatgcatactgtcaacgtggtcccccattagagtgaggacacatagaagctccccctctaatgctagttttaaaggcccaagtctatctaaaagggcagtcccataggtggatggactgactgtggtctctaccctgtgtctgaggatatcagagtggatatgatgaatggacataaaataaggaggctgcccccctacccccggatagtccaggcagccttcattcctttatttcatttggaacccatatggcttattctctttcactgactggagctcacagtctggctattgtaacctgtcttaaatctttttctctttaaaatatcttgactttgaggcaggtcttagaaaatgactcttcctgtctcaaaatgcagtccttcattctgattgatgaattggaagcacatggctggtgtaaagaataagaaactaattataagccaggaaacagcaggagaagaaagcagagaagcaacgcttaccctgaagaattaatttccgtttagaaaatatcacagctgatgtgtcaaaggccccggtatgcaggaatgagattaaacaaatgtggtcatgaggaagaggtttctgaataatgatagagaagcttgagtctacaagaaatccagagtccagaatactgcaggggagcagtgctgggttcatgtttatctggtctcttgtctattggatcctctttcttccagaaccctaaaccttgaatcagccttatagtcctggctcctagaagagtgtttctcaaagtgtactccacggaccacctggataagaagcacgtgaggcttttaattaaaaaaaaaaaaaaaa

SEQ ID NO: 12120 - DNA, 6321 bp, Homo sapiens
aggcagaggttgaaaagataattgcagttgcctgggacatttttcagccccttctttttggactaattggagcagaggtatctattgcatctctcagaccagaaactgtaggtaagaatttcaaaatgtgcttttgttaaaattcactttttttggtcagcctactcaccaataaagtctactttttatattcattgaaatatctccagcaggtatgtgtacagtggttactattgtcacaattatataaaaagttaattatgatgtaagttttttagagtagttggttagaaaataatgcttgttcatctaagatggtatattttacacatttaatattgttccttgtatatgaaagtgacactgctgaccactacccagaaaattcaggccttaacaattctttttccaagggtaagaatattcatctagccttgtcctgaacaagagcgagaattttaaagacaactagttagttctatagtttgtacccatgggatagaaatgccttgttgttcattaattattttatttattcctacattcaaaagccatcatattaaaactctgttgattcaaaacactgcacttaaaaattaatttgtatatatgtactcattatttccttctttccttccatcacagtattcttccatccatactaggaatcccatctcccgctactccttctgaatcttgcatatggattctttccttttctcatacatcttaaatatccatgtcgcaattttcttctcttcagaatttagtctccaatctctcttatcttaaaaaaaaatgcttctcttctgacacatgctgcaacatggatgaaccttgagaacattatgctaagcgaaataagccagtcagaaaaagactaaccctgtatgattccacttacatgaggtatccagagtagtcagactcataaatggtacttgccaggggctgggagtaaagggaaattgttgtttaatgggtatagagtttaaattctgtgagatgaaaaaattctggagattggttgcataatagtgtgaatatacttaatgatactaactatacacataaaaatggttaagatggtaaatgttatgtgtattttactacaattaaaataatgtatattaaaataatatgttaaaattatatatatataaaattcctctatttcacttccccccgtctctaccatgctacctctcttgtcttcttttcggacttttcaaaagaggtcactacattcccctttccacttcagttcccatttcctccttctatacattttagcccagcttctgcctatcacacaacctgccaacctctcacacaacctgccagcctctcaccaaggtaatattgctaaatccagtctttgctttacttgatctgtcagcagcatttgctgcttttgaccctctaacactcctttatattaagttcttaaacttcctatttcccagtgctgtttgagcctttccttacaccatatgtagcttaaatgctgccctttatcaaattgctttctaactttgtgcctctggctctatataacttctctaaccttatctatactagtgacatcaactataaactgtataattccaaactatttatctctaaatcaatatatccaattgttgattggacagcaccacttgtatgtcctgttaacgttcaaactcaactaaaacttccttctcatcctcttctcaaactttcaatgtttccttctgggaatgatatcaactctttatcttgtacttcaggctacagatatttttgaatactttccaaccttgaagaaatacctttcaacaaagaaccacaaaactttcccataaaaaagccatatggcagatttacaatagatcctcccgctatgtctgtctgatgttttacccgccctttgaatttgagaaaactacttatcctttctgagcttctggttttttcaactataaaataatacttactccacgggttgtaaggactaagtaaaataatacatttaaagcttagtacagcatttggcacagagtaaacactcaacaaatgttactttttaaaaaatcaccctaatactcaggagtcaccttagctgtatcattcttaggtccagtagcatgtagcagcactactcacaatcccttgtttggcaaatgatgatgaacttgtctttatcagcaaagaattctacaggactaaatggagtagctgtgtatgttaaccagggataattgggaccagtacgaccagtacacatcagtatggtgaaacagtggtagactgccagtgtctattctgattggtcagtgcccagccagctctgattggctaattccctccatactggctcataaatattttagctatcacttctggtcttataccctgtaaagaattattgactttttgggttaaaatattgtttttccctcttttatgcccttagtttgtttatacctcacttactgtatagtctatgaattggttgtttatgtgtctttctctgactttgaggcaaagtctatacattgtacatttatgtgtacacagtacttagtttaaagcttattacttatcatttaatcatatcatttaataaattcttcttacacacatgaacaagcatggttcttgctataaagcataagacatatataacattcaaatctctacataagaattcaaatatgcttaatttctggttttaatctacagaaacaccttattttaaacaaatagcctgattgatccttaatattgattgtttttatatattcttcctaaacatttttgtatttgtaatttttaatgctttaaaaattatttctgttgatggttattttgaattagtaaccatgagatgcagtttctctcctagtattttattatttctaaaaattgaatatttcttacaggcctttgtgttgccaccgtaggcattgcagtattgatacgaattttgactacatttctgatggtgtgttttgctggttttaacttaaaagaaaagatatttatttcttttgcatggcttccaaaggccacagttcaggtatgatggataggatggcttagcattttaactgctatttctgcatgacaccttgaaatattgaataagagggcttgtttaaatttagtgaaaataaataattgaagtggatttatgaaaagagtttatcctaatctattctttaaaacctgtatttttggtatattcattccttaaatgtgatagctcattaaatttccttagatcaccagggtataagtaaaaatccagtaaatccctattctactagaaagcagtagtaacaggagagaagagttttcatcagtcggcactctgtaagtcacccaaggaaagagttcttaactcttttcatgttaatagcttccaagaagagagtaaaatagaaataacatggttcccttaatgtttggagatattttaatgttaatatgattgatgatcagttgagcttgaccagagtctttgtatgtaatggagaaaagatttattgaaaaacaactcagaaagcactttattgatttcctagattattagttggtattaattattcaaaactcactgaacttcctggcaaatgtctcaatcacttaaccgaaaatttgtgcattctaataaacgtgataaataaagctattatagataggtgcttgaatttgttgaccatgcatttgttagaatatctatgattgctaattaagttagaactgtatagattatgatttgttgcaaatgtgatgtatctttggttgtatattttcagactaattacatcaaacaacatttaactgttttgccccagattattttataattaaatattccaatttctgttattaaggaattaaaatcaagtgtttttcatttaggaggctttgggggatgtgtatgctcagcagttatattccagatttcaattatgctctttgcatttgggcattactccagaattcccctcacccctatcagactttcaaaaatgtctaaaacataatggctaagagttctataaaaaggtctctggacagcaatgtgaccagccaaactccaggagttctattatagaagggaaaggggtcattcatgtttttgtgagcaactagtagtttctgccattgtttctgatgcacatttttctttttcattgtcttagaggcttacattgttctctgtggaataagggataaccagattaattaatacatttttcccatctgcactgataatattgcattttgcctctaaaagaaactgagaattttcataatgttttccaacagatgcattccaaataaaacatttcaccaaattctgtggcaaggagttgaccaaatacctaataagatcaacttcaagttgtcaaggtgtccactattttcatgtttcatgacgtttgacaatgagtttaagctctaaagtaatatatatttatttaaaatttaacagttttcagtaggtatcactgcatgtttttcatcttattttttagttccacattcctaaagataaaaggagatgaccagtaatttccatctttattcaggaaaaatttagtacatagaactttatgttatatttaattaatattgtgattctggatttgctttgtgttttgaaatgtattttactgatatttatgtaaccctaccttacacagataagtacaaatgagtcatcagtatgttcccatgcaagggcagagtttttagatcatcagaaccagctgggctgggcacagtgacttacacctgtaatcccagcacttgggaggctaaggagggaggatcacttgaggccaggagttcaagaccagtctgggcaacacagcgagaccctgtctctaaaaaagtaaaaaaacaaaacaaaacaaaacctgcaatacactttgaaagaatactaaaacaactttctttttttttattttattattattacactttaagttttagggtacatgtgcacaacgtgcaggtttgttatatatgtatacatgtgccatgttggtgtgctgcacccattaactcgtcatttagcattaggtatatctcctgatgcttacaactttcttagttgagcaaaagaacaagcaatttgcttttgcaaacaataaaaaactcactttttttatatgtgcttatctcatcatgattccatttttacccttaaacttttataggctgcaataggatctgtggctttggacacagcaaggtcacatggagagaaacaattagaagactatggaatggatgtgttgacagtggcatttttgtccatcctcatcacagccccaattggaagtctgcttattggtttactgggccccaggcttctgcagaaagttgaacatcaaaataaagatgaagaagttcaaggagagacttctgtgcaagtttagaggtgaaaagagagagtgctgaacataatgtttagaaagctgctacttttttcaagatgcatattgaaatatgtaatgtttaagcttaaaatgtaatagaaccaaaagtgtagctgtttctttaaacagcatttttagcccttgctctttccatgtgggtggtaatgatctatatcaccaaccttaatctctctgccttttttttcaaacaccccttcatcatccatcttaatttgcataaggacatatctactttaatgtactaccacagtttacagttaatgtgggaaagaccagcttcagtatcctcttcagctaggattgccctaacttttaactttcacagtttcctgattcatatttgcccaggctctgatgccttgaattggttttggctctcttttttggatctgtttttgttgttaaacatcataatgcagtctctcattaatttttaccatcatttaccctgataatctgcctcttctccatttctccttcccttactacctttctttgaattactgtaactgattggtcccaccaaaattttaaagtacatgaagtatcttcattggttcatcctcttgccccctccagatgtcaaaaaactttatcctgccccctagctgaccacccaggttcctttatttcagtggcccatgtgagtctaccttcccctaaggagtgccctaatccagccctttttttgtttcttatgacccatatctttaggctcttcccatttctaggtgggagataggtaagtttcaaatctatgccagtcttatgaatattacattagggtaatgtgctataatgaagaaataaaaaatacagtgcttaaaagaaaataaaattctatttctgtctaatgaaa

SEQ ID NO: 12121 - DNA, 410 bp, Homo sapiens
ctcagagtcccatgtctttctgtcctgaagctctgccattccctagcttaggacatggcttaacctatttatgccagaggttgcaaaaattttttgtgaaaaatcagaccttggcaatgaccttgagcagtgggatataaataactcccacaggcttagcattctaataatggaacactaggcataaatgggttaaaaatggatctctaccatatctccattctatctctcaaggaaaatgcaagtatagcaatttatttttgaggaagtgatgtggaagttggacacatctcttttcctacatttattgggattgatcatatccggctgtgaggcagctaagtgttgtctctagctaagcattcacactcctaggaggaacggaacatcagattttcggggccagagct

SEQ ID NO: 12122 - DNA, 11150 bp, Homo sapiens
  misc_feature (3131)..(3131): n equals a,t,g, or c
acttatgaatgtttaggaaacaacatgaaagctgaaaatttatttcactaatatacataagaagttcacaacaatgaacagacagaaaatagcagtatatacagaatttcactacttacagtacattacaatagagaaagcattttataaacagttcagtattggattaaaatcttttaaggatggctaattctattcagcaggaatctaacttctagacacccagcaaacccattcctatcagggtgagagagggcttttgctgttgctatagtgtactgtaaaaatatttgttccttataaatgaagtggaccacagcaacttctaaatgaacattatattcagtgtaagtctcatattattaaatttcagatttttgactttttagatcgcaattgtttttaaaaagcaatttaaatgtaacagtgtttactttgaccatagatgaagttttataataaaagtaaaacttttttttttctgtttgcaaaagtatgaagcattaagaagcatggtgctatatatctctttatctacatttaccctggcccctctagttctgcatctaaacagaacctgtaatgtagaagttatgattatttgaacactttttgttttccttcagcattatacaatataatttaataagatacaaatgcatatttaatgtttgttaatgaagaaagttgtgtgagggtgggcatatatctaggaaaacactactggttactggcttctcatcaataactacaaagtaccacatacctttgtttcagaaaccacccattctacattaaaatctaattcctttatcatctatggctctttgttattatagaatgtctacataggtatttatttgcctttcttcctatcaatcagatttatttattttaaaagcccttgataagtagtaaaatatttaactgcttttcttaaccatacaagtcagaattagattttaaaattctatgaaaaattttaggataacaaatctaactagagacttaatgatttgtgttaggattctgtgagccatacttcagcttattattgttctcagcaatccccagatttgattgtctgttctaccagagtaagcttaaccagttttattatctaaaatgcttaataagtgccccctccccgccaagtgatgatggaattgaggatttattctttaaaaatacctataactccaagtttctttgactagcctccttaagttcatactactactttcagcgtacttggaaaaatcacaggaagaactaatctcttagaaaacatataacaagtgactgttaacacagagccagatatgtttacaagaattctaggatgtgtgtggctggggcagcggagacccaagcagaggctgggaggttggactagccctttccagtgctgctactctgtaaaatgtatgtctcaatcagactcacaggcccccatcccaaatactcaagacatcttaaccatttatcttgtaagatttcaagtttgatagttacttaacagtaattactaaattttagccagttaaattcttgtttggatgtgctcttttagctcaaaaaacagatttgtttttctttttatatccctgaaggacatactcctcaactttgcatgattactatagttggcttcttaaggggaagtgaagaaacaaacttctgtatcacaatgacttactatgaataataattgtgatccatgacagatacccataattacactgtatggctacattctaaaaatataccacaataaatacttggtatttgtagagctcaaagcactcttttacagagttttggttagtttggttttttctttttttttttttttcgagacagggtcttgctatattgcccagaatggcctcaaactcctgggctcaagcgatcctcctccagcctcccgagtagctatagtttggttttaatcagtaaatatttatttagcacttggactgctctaggcactatagggtacaaaattagttgtattttatcctctcatcccagctgtgaggtaggtttgctaaagctgtaataccactaagcagttttttcaatactgttcccaaggacagataatattagcaaatcccagaagcatttctaaacacttgtaggaaaaataaagtcggacttaaaatttttagtatctttgcctttttttttttttttttttacataagttttacaagataatacatttttacagtgacctgatgtggatacaactttgcaacttggcaaaaagcaaatcttaacttacattataattaatttgctgcattttacacatctctgattctcaattttggcaagtacaacaggttaagggttctatttagtgtccccttctgatgaatatgatgatcttgaacccattcttcctcctcaagcacggtcatcctcctctgatggcaacagcagaacctctgggaaaggaacctttcggtatccagaactcccaggtggcagcccagtgtgggatttggagcatgacaacaaaggcattttctcaacatttagtaaaggagagtggggtgttctatacgctactgatggggactgtacatgaacacatttaaattgaattacaacaacattttagataggaaatatagaatcttataagaacataatctaaattataaccaattttaaatagcaaagtttaacaataaagctacttaagtgtttgaattagaaataaacagtaaaacatctgtattaattataacagagttgacatttgtttatattttatcttcagtattaaccaaaggagtggaatttagccagggttgcactttttaaaagttgtatatacttttatttattttacaaaaggaaaaaaaaagacatacttttcccataaaattccaggtcttactatgtaaaataaccatgcactacttcatgttataatcataattttagactatttccagtaggtaagtgtcataaagaaggaagagatatggcttccacagcttcaatgaggtgtaaggctagaccatattgcccatgtttttctggtaaaagctcaattactttatttactagtttagctgttgttgcaattggcacttcaggtgttttgaaggtcntgggggtcctgcaaatgggacacaaaaataacctattatagacaactaaacaataattgttattgacttaagagttattacataaaaatgcttttctttgtaactaggtgaattaaacttgtcaaattttcttcataactgttattaagcaggcactcaagaaaacatccaatgaccttttgcctgatctcgttctattgtactgaccattgctttcagccaagtacacagtgtgggtggaagtctggcaagcagctccattccttcttttgtctgggtgtggagaagcgcatgagccagcctttgccccgtgagcaccagcagctgagaggcaaggacctctttgtcatgaacctgtagaatggcctgaagataggaacatggagaaataatacagtcagagtgagcagatttgtttattctataggaaaggggttgccagtgaagagattctagttgatttttgaactgtggccatttatcttttgattgtatacaaccaaagataaatccaaatcaaacttagcatttaaacccaaatttctgttccttggttaatttttttttctctcatcacctaatctttcaattcaatgtggctactcagtgtgctgttttcaaacttttggcaaataaaaggagtttcatgtcatgtctatttgaaaccctctaatggcttttttttgttgttttttgagatggagtctcactctgccacccaagctggagtgcagtggtgcaatctcagcttactgcagcctccacctcctgggttcaagcgattctcctgcttcagcctcccaagtagctgggattacaggcacatgccaccacgcccagctaattttttgtattttcagtagagacagggtttcaccatgttgcccaggctggtcttgaactcctgacctcaagtgatccacccaccttggcctcccaaagtgctaggattacaggcgtgagccaccacgcccagcccctctaatggcttctgaatacacttagaataaccatgggctccgagacctaggatagggccatggcccgggccagcctccctgcctcatgccatacttctttattccttgcttactatgtttggtcagccatactggcctttctagtcctggacctagtcattctagtccccacctcagggcctttgtaattcttgtctcaagcactgttcccccagtttctgagtagctggctgctgcttctccttgggggctcggttcaaatgtcaccttctctgaccactctactgtagtggctcctgtttattcatatgatcctgtttctttctttttcaatttaaaaataaatatttttttcctttttagagacggggtctcgctatattgcccagattggtctcgagcttctgggctcaagtgatgtgccacctgagccttccaaagtgctgggattacacgtgtgagccacgacacccggccctctttattttcttcatagcacctatcattcaatgcaaaatttagcatgcttttctgctcctaccagcagactatcaagtccatgatgaaggaaccttgtctgttttgtttactgctatatccctgtgcgtagggcaggcctggcacactgtaggaattatttgattataattttatgttttaaaaaatattctattgttctatttttatacctagatgttctaataaaaggaagagcaaaaggcttcattggaaacttaactgattctttattccaactatcaattttataacttgagcccaattaacattcaaagggtcatgattacctcttctcctaagtggtcaactccatagttgtatagttcccccacataatgccttctaacaacatcttcactaacttgaaggtgatgggctaaatccacagctagagctggccaatcttggtctttcccaaaaggagtgggtgtggcctcttctgtgggatctttgacctttgtggctgaatgttgggcctggacagctgcactgacaactttcaataagaacttgaaaatggagaaagagatagagcaatgcattgttactgtttcattttaaaatacctaaaccaagtattgttagcttttctgtcacttatagtggcttttccattaaattgtttagttatcaaaaaaggaacacatcatttaaacaactagctctcaagaatactttgaaattggtcttttttaaatattattattattttttattattatactttaagttctagggtacatgtgcacaacgtgtaggtttgttacatatgtatacatgtgccatgttggtgtgctgcaccccttaagtcatcatttacattaggtatatctcctaatgctatccctcccccttccccccaccccacgacaggccctggtgtgtgatgttccccaccctgtgtccaagtgttctcattgttcaactcccacctatgagtgagaacatgtgctgtttggttttctgtccttgcgatagaaagtagtcattcttttcaaaagccagctagatttttcccttatgtttttttttccaagaaacaaaaacaaaatccaatagctataatttacctgttgtcgtacagaaataaaatttggatccatttccccactaggtaataactgaattgaagttaggtctttgaaaaatgcattttttccctaaaaagaaagagagcaagaaaactgatgagtgtggattattaaggggggagagggagaaagatttgtttaaaacttaataataacttatggttgatttttatttctccttgaacagtaagattttagaataatttttataacaattatctagtatatagtagacagcctttaagatgaaacccagtgatcccctcctcctggtattcgtgtttcctatagtctcctctccttgcatggaggctgatgacttgcttctagcaacagaagcaggtagaggtgatacatgttacttccaagaccacgttccaaaagactgcttcttctgccttgaggcactcatattcactctcacttgttctgcaggaagccaggttccgtgttgtgagctgctgtatggagaggcacatgtggcataactgaatcttgccaacaattgtgcttagaagtgaatcaccctgtccccatcccagttgagctttcagatgcagcaccttaactacagcctcatgagagactaagccagaggcacctagataaggagaacacagattactgacccacaacaactgtgagataataaatatttgttattttcagccaagttttgggatgatttactccgcagtaatagctaagtaatacatatatgtaccctgaatcctttttttttttttttttgagacagagtctcactctgttgcctaggctggagtacagtggtgtgatctcagctcactgcagcctccaccttcctggttcaagcgattctcccacctcagcctcccaagtagctgggactacaggcgtgtactaccacgccaaggctaatttttttgtatttttagtagagacggggttttcaccatattggccaggcaggtctcaaactcctgacctcaggtgatctgcccgcctcagcctcccaaagtgctgggattacaggcatgagccaccgcgcccagcctctgaatccttttaaaaacacttgttgaattgtttaaaaacaccttatttaaaagaacagatgtgtgtctaaagagtaaaaacagaatatcaggaaacaggattttagaagttccttggaaggaaatgtaatacagagcaaagaacattggcctttaagttgaaagacctgggtctagtccaaggctcaccacttccatccaggttgccttgggtaaatgacccacaatcttgggttaccgtttcttcttctgcaagcaggtcatcctaggtatcttccaatgtgccttccatacctaatcatctgtgattctaggtcatctgttgtgactgccaagtagattaaagctactcatcctttagtgataagaaaaaccggacttacagggcaacccatgacattttggacatcactgagagaagtatttaaagatttagcatacactcacaatctgttactcgatagttcccacctggtggtcctagctatagcatctataatagcaccacttattatttactacattccagatgctgctaagtacttcatgttgaatacaaggaacccttacaacaaccatgaggctggcactgctactttctgaatgagaaaactgagagtaagaaaatctaaataattctagttagcaaatggtagcaccgggattgttttcactagccactcaaccatactagctctctgcagatgagtgtcacccagctgtctcaggtagtcttggcatgacatgggttgaaactaaacattattgtgctaatccaattctggatgtgttctggtttcacaaaggccttttctgatgggaatactgagctaggcactttattttggtatttctttctcttttttaacttttaagtactcttatcgcttatattctcaaagatatactaactcattcaaaatctatacttttttttttttttgagacagagtctcactctgtggcccaggctgaagtgcagtggtgtgatcttggctcactgcaacctctgcctcccaggttcaagcgattatcctgcctcagcctcccaagtagctgggagtacaggcacacaccaccatgcctggctagtttttgtgtttttactagtgacagggtttcaccatgttggccaggctggtctcaaactcctgacctcaagtgatctgcccaccttgtcttcccaaagtgctgggattacaggtgtgagccaccatgactgtccgggagtctctcatttaagggtgaaataataaacccactttcccacaagcctaagctgtgttctctaacccagcttctatcagtaaaaagctaagtaataatgttgacgtttttgtctccaacagtttgtcctgtctctcaaaatttgacacctgcgtggggaaggaaaggattttactatccactgcagctaaactgtgaaggttacaatagaatatgtaaaaacatattctactcacaaatttggacttgatcctgcagaggagccaaaaaaaatcttaggtatagaactaatacaattaaacctgtctcttaggaagacagctcttgcagcatgggactggagagagagaaactggaggcagcgtgattaagaaagggctgttgtaatagccgagggaaagatgattatgcctgaactagggttatagtcatggagagaaacggacaggcatgatctatggcagaatttacaagaatgaatttacaatgaagaaaattggcttgaagtaaggaattggtgagataacttcaaagtttctagtttttgccagggcaaaaatgatgacatcgttaataaaataaccaagtcagggaattcagaaggaacagcaaatttaggttaggggcaggatgtgggtattggtttgcagatatattttagatatgaggtgtctgaagtcctataagacactcaaagagagaagttcaaaagaaatgaatgcctcaaactctagggattggtcaggcctagagatatataagagggagaaaatgagtctgtccaggaataatatggagaatgagaagagcagacagctgagagggcaaaactccaaggggagcagtacagaaggtaaataaaaagaacggaatcaagcagggaatgagggagttggaacctcacaccaaattataccagtcacaaaagtactggacagcttctattaaatatgaaaatccatgtgtctgctaagcctgcaactccaaaatagctctgaaatcctgtgaggtacttaccttactgtcaaaaagtgaaagtggcttcacggtcttcagagaaaacctcatgactgcatacaagatggagcacaggatggagtggtgctccaccagtgggtagtggatgtgcttctgttcaagggccagttccactatggagattggtccttccacggagagccacgcatcctcagtatccagcacaggcacctgtatttcatccctgctaacatctgcctaagggttttgagaatggaggactgtgttcagtaatggaaaaataatagcttacaaatatcccaatgagtttattagcagcaaagtgcaaattcatattgcacactgtcccaaattgtaataaaaaaacacaaagtctaatttcaataagaatttaataagaaaacatcactaccttctgggctcaagtcaaaatttagaaatgaatgaatgaaaaacaacctcattaaaatagtcatttattaaatgcaatggtttgcagaatatgtaatatcttaggagcagttcagaatgaaaaatacacctcttttacctccattaagatctgaagaagatccaaacaggagccgaggaaagatgtcattgctgtgtcactcattcccacatcctgttttttaaaaaggaacgtaattaggccctgcaggaaaactgctatagttactgtcagccaaacaagaaccaggatacaatacactggttcagctgactttccacactgaatagacaggcaagaatttgaaagtcaaggcattagcatatttaagttccttcttttagatttactgtcaaccaattttaaagtcaagctttacaaagtggtataaatattgacttttaaaaagtagtgttctttgtgtattgtaaagaaacagcctcattagttactatagatggtggcacttctgagctcactgttcagcttgctaaggcatctggtagccaaataatcgtggtagatggaagatacacacatgagaatctaacctgaaaagctccaagaaaacagcctggtctgctttcagagcgtcttttagagactgaacccaaccctctgagcaaaactagaatcctcaagcttgagaactaaataccagattgatgctgtgagcaacagacgattctcaatgactcctttaaagggcttgtccaagggaccactgcatttgtgtataatctttttttttttttgagacagagtttcattcttgttgcccaggctggagtacagtggcacgatctcggctcactgcaacctccacctcccaggttcaagcgattatcctgcctcagcctcctgagtagctgggattacaggcgcccaccaccatgcctggctagtttttctatttttagtagagatggggtttcaccttgttggtcaggctggtctcaaactcctgacctcaggtgatccaccagcctcgcctttccaaagtgctaggattacaggcgtgagccaccgcgccctgccatataatctttttaaaaccaacaatctataatttcctcacatccccaaagcaaataattcagtgtttgtgggtacatgcacacacacatgcatgcacacacacgtacacactctagtcatacaaccattctcaagaacacatcagaaaaagtcttcaacaatggaagctagtactattaatttcttgggtcaaatacaagtcccatatccatggattagaatattagttaagactaatgttgtatttgtatacttatgttattatatatatcatatatataggtagatcaaattaactacttcatttgaacctgcttcaatttgatgttggatgcttccattataaatgtctaatcggaatatgcagcaatggtagcatgttaacctgttcacagttcaaagctgaacaacatcttataaaaacctagtttaatatgctatctaacaatctggaaaagtaaattaaaattggccatagttcatgaccagtttccttaatgcagtattctcttttcatttttcttatctccttctgatacgtcatcacaatgataaaaggcaaagttcacctatacagttaataaagtactacataaaagtgtggaattaacaaccataattctagctatgggagattcacttacccttcggcataacctatcttttggtgattttcc

SEQ ID NO: 12123 - DNA, 560 bp, Homo sapiens
tttataggtggtgatattcgtgaagagtcttcctataaagtaattgtcatgccgactacgaaagaaaaatgcccccgttgttggaagtatacagcggagtcttcagatacactgtgtcctcgatgtgcagaagttgtcagtggaaaatagtattaacagctcactcgagcaagaaccctcctgacagtactggctagaagtttggatggattatttacaatataggaaagaaagccaagatttaggtaatgagtggatgagtaaatggtggaggatgggagtcaaaatcagaattatagaagaagtatttcctgtaactatagaaagaattatgtatatatacatgcagaaatatatatgtgtgtgtgtatctgtggatggatatatgtatatctcttcctatatatatccatagtggacttattcagaacatagatatgtattcagcttgtcttcaaatacggccaagcagaaaatgttttatattttataaatcatcttttgactctgtatttaaattctatgatactgaaaataaaggcattctggaaaaatactga

SEQ ID NO: 12124 - DNA, 2832 bp, Homo sapiens
ataatatataaaaagtaataaatataataataaagttttttaactttaaaaataaaacacgctttaaaagcaactgctacctcccctcccccccactaataaaattctagtatgataaaaatgaataccctgctttcattggaaatttctagcttacactttctctctcactccgtttctccttttctgtctctctctactccttctccctccctccctccctctctctctctgtctatatcaattttgctttaagaggaaactgggaattaaacaaactgggatcaatgatgtaatgtatctttagtactttggattttctaaacaatttcctgtagtttctgagagttgtattttaatcacattcatagaaactcagtcagtctggccaatggaggagaatagtatagtcctgctctttcaaattatgttaagcaaaatggctttcttctctgggaatgcactgtactcaaagatataaggtattagactagaggctcccttaagttacggctagttctaacgttctaaagctctaacacagaatctttcttctgttggattgttagttctttgaaactagacagtgtgttctaaatactaaccctcataataccctgaataatacagttagtatgttaaaaattaattaaaagaatggtcatcacaactttgaattccatggtacactttccacaaatgcttctgtttgtaccatgttgattagtaatgtgaccctttctttcccatgtttagtgatttagaatctagaagagaagtaaaaaaagaagaaggtgaagcttttgcacgagaacatggactcatcttcatggaaacgtctgctaagactgcttccaatgtagaagaggtaaataagaggccctttaaaatcttcatctttatacttaatagaaatgttttatatatcttcattttacttattatttaagtttttagtcggatggtctttgaacatcataaagtaggaaagtttcttccctttgaaatcccttgtaacattcaccttctgtcagactcttaaatcatattgagccttctaaagcctgaatgttttcttacatttttgtacgtattttcactccctccctttttctaaacaatttcctatagtttctgagagttatattttaatcacattcatagaaagtcagtctggccaatggaggagaatagtgtagtcctattctttcaaattatgttgagcaaaatggcttctctgggaacccactgtactcaaagatataaggtattggacttcttcgtgttgcatggtagggaaatcttttttgtgttgcatgggagggaaacaaggaaccacactaatgaaatttggaaatgtttcaagacagcagaacgtttgtagctatttatatccacttctgcttatttttttaattttatttatttttttaactgtcaatatattaccacatcaccacttctgcttaaagtattctattattgctgtgtaacattttacaaagcatgagaattctgtttcatctattgatgaaatttgtattatttcagttatttccattgatgaacctgaactattggaacttttctgaacacagtgtattcttttatgctctatgtgtttgtgtttggaggtagtatgtatatacatattataaatagatgattacgtagttgatcctttctaaggtaaatgtattactatactgttattttataaaaagaggtaatgaagctaagaaaagtagtagtttatccaaagtaatacttagttcccgatttctagataagaacagcttataagagcaactacagaaagtagttctaaaaaacaaatgagttaagaatcactgccgtaaggataacagaggtcagggtcctgggcaacagctagcatgtgccttcaatgtagtaagcagtcagtaaatatttattaagaatgatacttggagctcttctgattaacccttgaacctaaaaattgactacagtaattctacagcattggtattttcaccgaagaattctttcttaggtaaaatattatacagtcatgtgttgcttgacaaaggagatacattctgagaaatatgtcaccaggtgatttcatcgtcacgtgaccatcatagagtgtacttacataagcctagatggcatagcctactactgcacctactacacacttcccttagtagaccttggtgccagaggaatgacacagtgatgatttcccttggttttctttttgccacatacccgagactgggtgctagagaaacaggcaacctagaaaggtcaacaggcacagaaaaagaaagtcttctagccagagaaccaggaaataggcaggtcagaacagtgttcgcaagccagaacactcttagaaagtaaccattctactgtagccaaacatcacagaaaaaattgtggctctgcttccacaatccccaggcagtaatgaagtagcaccctaccaccaccatttcccttgttggagtggagtgagaggaagccaactaaacagtggtttaaataagacccagagtctcataacatagtatctaaaatacccatgtttcaatagaaaatcattcatcatacctagaaccaggaagatcttaaattgaatgaaaaaaagataataggtgccaacagtgaaatgacagtggtgtttgaattatcttacaaagattttaatgcagcaatcattaaaatgcctcaacaaacaaggaacatgcttgaaacagaagagtcttagcaaacaaacaatctgagcaaaagaaatgcaagataaaaaaaagaaccaaataggaattttaaaataaaaaaaaa

SEQ ID NO: 12125 - DNA, 120 bp, Homo sapiens
ttattatactttaagttctaggttacatgtgcacaacgagcaggtttgttacctaggtatatatgtgccatgttggtttgctgcacccaccaagtaatcatttacattgggtatttctcc

SEQ ID NO: 12126 - DNA, 51402 bp, Homo sapiens
cagttccttgttcaaaatgccaagaacctggatgactcatagtcaagaccctccaccagtaacatatattggcgagccagccaggaggtaagcccaaagtttgggatttatttttcttctcttgatttcccttttcctctctgctccttacaggggaactcttttctctgtctctttttccctttccagcttggaaccctcggtggacagtgcctaagcacagaggcaaccacaggtttctaacagggccactctctggtgaaactgaaaggtttctgtgtgaaagtgcctgaccaccactgcccaattcaggtgagggacctgagtccttttccttttttcagtctttcagtggccgtttcctagtagcttcttggtaattgagggaaactggccgggaccactctctactgttacctgaaggccaaggagtgaacctgggatagctctcctgcccagaaggcggaaggactcttttgtatctttttgagttatagtccctgatccctacctgtgatgcaattggcagcagaagctcgtccagggtgaactcacacacatttcaggcgacttaaaccctctttcttaagctaaattctcccataaagttggcctgtaaggacaaaagataatatctcttagatattttgacctcccttctcctactgaatctattgactggctgaggacctttgggacccacaagctttagaacacattctacatcttggacctccacttaagggagcttggtggtcattgctttggcatcagtttgcttgccctgaaccccgtagaaattctatatatcttttatatacccaatataaacccaatcttttatataacctctgcaccatttcttcatggggaatatcccactagccttggtaccgttaactctgcagtgttcgggaacctccttagtcttgcaaggaatgcaggaagatatggcctatctaaattggtaggaagctagaagctgagaccttcatccagggacaagagaaaagctcatattaggccattgcctctggagggaaaacatacaaagcaacactggtgcccacctaaggtcagagatgtctgacacttttagactggacctcaaagggggatgcctaggggatccaactccagacctcagcctctccaaaggggatgccctaggcaaaggttctcaggtctagtactaaggcctccttagaattgtctctctcttgcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcaggatgacgttgcatgtatccaggctttggtgctgctgtcctaagaagggtcaggcctagtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaaggtaaaagctattggatcttcgtttgtgtgtgtgtatacatgtctagatgtgtttatttgtatgtacacttattgttatatgttgtgtcaaccaaatcagcttataaataaaaaagcactcataaattaaataaataagtccaagcaattttcaagttcatgtgacttaagtaaatcttcattaaatagctggctttaaaattattggtaaaatgaaaatagaaatatcttcagaattgtcagcatacatttttgtctgggttttatatttgtctttgctagaaatgttgaagtgtcagcatttggcatagaagattataaagctattaacccagccaaaacaaaatggccttagtttatgtggcttctttgacaaatgagactaatttaatattgttagctaaatcttctgggttattggcaaaaacacctatgtatttaactgtgaggttcttatttaggtgaacacataatgttcattggctattaaaaatggttaacaaataaataactaactttaaatgatggtgtctaatatctcagttttcagaagtaatctagataaactgttaaaaatgaaagacttaagtacatgtaaatgggatgaatgattaggtaaattttgtgtaatttaaaatcttaaaagtatttttgatgcccattggatatctcagtcatttccaattaagaaagggttatgatagggaggaatatgtttccaaaaattgtggaattattctcatctataaaatgctaatatctgatagtttaggattttttgcttcctaaggtttcactaaaatttaaggttactaagatgatatggtttggctttgcatccccacccaaatctcttcttataactcccataattaccgtgtgttgtggggagggatccagtgggtgagagatgattgaattatgctgttctcatgatagcgaatgggtctcatgagatctgatggttttgaaaatgggagttgccctgcacaagctctccttttgcctgctgccatccacataagatgtgatttgctcttccttgccttccaccatgattgtgaggccttcccagcatgtggaaatgtaagtccaataaacctctttcttttgtaaattgcccagtcttaagtatgtctttatcagcagcatgaaaacagactaatacataaggatatgaattatagttaatatataattctgtatacaaaatatgccaaaaaatgtgttattggtgagaaagaattattttgtgtagtttggaggttatctgaaagttaattcaaattatggactttaaaaaaaagagttatttatgaaacaaggtagtaaggaaccagtaagtaggggagagatgtgaagaaagttatatatatgaagatatgtttttgtgagggaagattgtagagatggtggctttgtaggagaaaagatcttgtacgataaattcttgtcctaacgtaaaatgactggttgtttaaaaagaaagatgtttaggaaaactcagaaagtccaagcattttgtagatggtctgggtaagttatgaaaagaattcatgtaagaaaaggataatgtacctttggtaaaaagcatgggaatgtggatttcttgcctaagtttagagggtgaaaggatggttttaagtgagataggaataatctaaaaggtttgaacaagttgtggaaggcttatgaaaaattaattgtaaaagagattctgtgtgtgaacatattggctaaagttaaaggggaagactggcaattagacttcacccatatgccagtgtgcaaagtatacaagtttttggtagtagtaatagatacttttactggctgggttgaagcttgctctatgagaacaaagaaggctcatgaagttgctaagcttcttttaaaggaaataaatcccctagtttgggttaccccaaagcctctaaagtgataaagacccatcttttagaactcaaggggctgctaaggctctcagaatcaaaaattatttacatgggaaagtagaaagggctaatcaagctcttaaaatgggtgttagctaagctatgttagaaaacatcagaaatttgggtcagcttattgcctgtagccctcttaagaacccttaattctcctagagcaaaaattaatatgagctcatatgaaatgttatacagaaggccatttttttttgagatggagttttgctcttgtcacccaggctggagtgcaatggcacagtcttggctcactgcaacctctgcctccctggttcaagcaattctcctgcctcagcctcctgagtagctgggattacaggcatgtgccaccatgcctgactagtttttgtatttttagtagagacagggtttcatcatgttggccaggctggtcttgacctcctgacctcaggtgattcgcctgcctcaacctcccaaaatgctgggattacaggcatgaaccaccgctcctggctggccatttttaaataatgatctaattactgatccagaaacagccagtttagtaacatgcgtaattaacctgggacaatttcagcaggctttacaaaagtttagaactcaaagactccccacaccaggaactaaccagcaacccaaaatcaggccaggagataaagtacttgttaaaacatggaaggagggatcacctgctgaacaattacaacccaaatggaagggactattttcagtggtactggccatgccttctccagtcaaagtactgggaatagttagttggatatgtctttccagggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcccgccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcagggtgagagttctgtaatccccagtaggtagggactgtgccccaagtcagcatgaagtagttatggaagaaagaccatgggtccctctgcctcccagaaagatttatggggatcacatctctcaggggaaaatgaggcaggagaatagggtctggagacagggaacctaaagctgatttgtgctgagtttctaggattgaatgaaaaggaaaaccccacctctccacacccaagtaacaaaaggatcagaggctactccctttgcactgcattgcagataaaaaatggaaagtacctcagattggtcccctcccacaaccaatcagactggccatgggctactccttcgtttacatagggtgtaaccaagtaaccaatgggaaacctctagcgggtatgtaaaccccagaaaattctgtaaccagtgctcttgagctgcttgctggagcctactcccactttgtgaagtgtactttcatttcaataaatttgtgctttcattgcttcattccttcgttgctttgtgtgttttgtccaattctttgttcaaaacaccaagaacctggatgactcatagtcaagatcctctaccagtaacacttgaactttctggtttgtcctgaacatccctctttcttaaacaaccagtcgttttattctaggccaaaattttaccatacaagaatatttctcatatacaattatcttccttctaacttttcttgccagaaataccttttataactttctttacattgcttttatttaacgattacttttaccttgtttcataagttttaaatagccttgaattagataaaaaattattttcctttaaataagaacacatttctttttttagaaaaatatttttctgtaattttttttttttcttgagacagagtcttgctctgtcacccaggctggagtgcagtggcacaatcttggctcactgcaagttctgcctcccgggttcacgccatcctcctgcctcagcctccagggtagctgggactagaggtgcacaccaccacgcctggctaattttttgtatttttagtagagacggggtttcactgtgttagccaggatgatctcgatctcctgactatgatctgtctgcctcagcctcccaaagtgctgggattacaggtgtgagccactgcacctggcctaatattttaaattggaaatgacccagatgtttaatgagtacctattatttaacttaatataattttagattctaaattatataacaagtttaatcacaagcatttattccattacatttacctaattaatttttttaatagtttactcagattacttttgaaaactgagagttatcattgaaagttatttcccagttaatcatttttatagactgcgaatttcaggttttcctaagtaagaaacttaaggttagataaatggtttctttttttttttttttgccaataacttaggatttagctgttttcattaactaaacaatattaaatgccttatttatgaaattttacatagagataattttcctttgggctgcattcattgttttataaccctcatgccaaattttggcatctagcagagataaatatgaaaccactgttccaataaatttaaacaatagtgtatgttgacaattctgaagccattctaattctaattttatttcatgactactttcaaaaccagcttatttattaaagatatacttaagtcacatgaacttgaaaagacatttggcttaaaatctctattttctctgatacagtatttgatttaaagcccctttttttctttaagccaattaattagagcacttttacatgtttctagtagtgaaacatcatatacatgacacataaatacatagatgtattatacatgcagatagaagtagagcttatcatttcacaagacctctttttttcctccagttctagacttctaatttcttgatcttattaccctaggcagttgtcagctaagataaccctaaatttgcatattaaaggaactcttagatgaaaaaaatcagatagtgaaatttacatctcaaggtacagagagaaagagtctggtgctagtgtttccagaatttattccttctggtgggttcttggtctctctgacttcaagaaagaagcctcggaccttgcagtgagtgttacagctcttaaaggtggcgtgtccagggttgtttgttccttctggtgggtttgtggtctcacttcaggaatgaagctgcagaccctcatggtgagtgttacagcaattaaaggtagtgtggacccaaagagtgagcagcagcaagatttattatgaagagcgaaagaacaaagcttccacagcatggaaagggacctgagcgggttgatgctgctggctgtggtgaccagcttttattcccttattcgtccccacccacgtcctggtgattggtccattttacagagcactgattggtccatttcacagagtgctgattggtgcattttacagagtgctgattggcgcatttacaatcctttagctagacacagagtgctgattggtgcatttttacagagtgctgattggtgcatttacaatcctttagccacagagtgctgattggtgcatttacaatcctttagctagacacagagcactgattggtgcattgttatagagtgctgcttggtgcatttacaatcctttagctagacacagagcactgattggtgcattgttatagagtgctgcttggtgcatttacaatcctttagctagacacagagcgctgattggtgcgtttttacagagtgctgattggtatatttacaatcctttagctagacacagagcactgattggtgtgtttataatcctctagctagacagaaaagttccccaagtccccactcgacccaggaagtccagctggtttcacctctcactagtaggaggagattaaaaacgaatgccaaatcaaacataaaattatagaaatctatcataggattatattagaagactgactttatttatataagtagttctaaatttagtctgccttttaactggatctctgagctctgggcagagcccacactgaattccgggtctccaaaaagagaattattatgaggctaagaccatgtgatggttttatgagtgcactctccttttttttttttttttaacaaaaatgtttctctaagtgtctgaactactctcttcctaactttaaacacccaacagtaacctctgttgttactctttgactaaaataattattttagttaaaaaaaaaaaaaaaagaagaaagaaagaaaccaggtaacactatacaaaaggaagcagtgtaagatctgagacgaaattttctcttttacactctttgagttccataaggagaaacagaggttgctccccaaaagggagtctagtgccttctctgttttctttaaggaatcccagggtgttagaaactattttagattcctcatgcagcacagggtagcaagagaaagaagaggcagcagaagtaaaatgaagaaaacagaatttggttgacggagaagaaaaaaacttttgctcaaaaagttgaaggagagaaataaaaaaggccttaactacacacacacacacacacacacacacacaccttggatgttagcttttatttaagcttttagccactaagctccttaaaaaaaataccttcaaatctcattactgtattttagctagtacaaactgctgatatttcaaaagtaatgcaaataccaaaccagaaagggcttgatttaggaaccaaacttaggcagtcatgatgaaaataaggacagaatcttagtttccaaactgcagtgctgggggacaaccattgctctttcagtttggcctggttagcaaaagatggccttgttatgtaaataaagcccctaaggtagtcaaaatcaaaaaaaatttttttttccttttgctagctgtttttttcttttttctttttcagttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacagttaagtgaaacaaacaaacaatcacacaatttatgtggtcactgagtgctctaatagtaaggagaaattaagaccagctggctgttagtcttaactctagccaagacaaaactccaattcagctacttacctagtaatgagtctcaggctgaagtctgctctctcccatcctagaagcaggaaaaaactgaaactcatcttccctgctggaaacgagctcaaactccagaaaggagttacctgccttccatcatcatggacgcaggaaaatttgccttccttgttggaagcaagtaaaactccaaaaaaggagttgcacagcaaaataaacttcagatctcaacaaatttggggagatcagggattctctgggggtggggtggctcccaggcctcagccaattgtcctattggtttcagccataaagacagctcaggctgctaccacgcactgataggagatttgtcaaagatcgaggcatcttcactcagaatccctctgtgattaccaattgtgaacacaaaatatctgatatgggtctcagtcaatttagaaagtttattttgccaaggttaaggacacatccatgacatagcctcaggaggttctgttgacgtgtgcaaggtggttggggcacagcttggttttacacattttagggagacatgagatatcaatcaatatatgttaagacatatatcaggtggtccaaaaaggtgggatgactggaaacagggagggggcttccaggtgataggtagataagagaaaaacagttgcattcttttgagtttctaataagcctttcactgaatacacaatttacaggactaatcacttaagccttagcctggctcagtgaaacaacagggcaaaggaagcaatcagctatgcatttgtctcacgtgagcagagggatgactttgagttctgtctagctatcttgtttaggaatataatgagaggcaggtttgcgtgcagtttccagattgacttttccctttggcttagtgactttgaggtcccaagatttattttcctttaacatttacaaggagaagtgaagaaataagtaaattagagagctagaaggatggaagtttacagttagagagagtgggatgttgaaggtaatactggttgcatatttcttatccaaaatgcttgggaccagaagtgtttcagatttcagatgttttcagattttggaatatttgcattatacaggttcagcacccctaatctgaaaacgtgaaatccaaaattctccaatgattgtttcctttgagcatcacaatggtgctcaaaaggttttggattttagagcatttcaaatttcagattttcagattagggataataaacctatatctcagaaacggtacatttctgaataatgacaaattgtcattatttgccatgagaattgtcattaatgtgggtggagatggggatgattgtaggtcaagagactgaagcaatagggtaggcttgggtgttagtacggcccttcatgggaatgtgttgatgtcatccagggtcacgggaggcttctgagtgggaaggaagctgagagcctatgattacggtcttcactgatgaaggcagacagtaggaggttggcagatggtgggcactgactagactggaagtgccaagaacttcagtggagcaaggttttacccaagacacagaggttgtggtctagagcagcccagggatgaaggatcacccattggagaggactgtggggaaagcagagtcctgggagatgaaccaagcatcagttgaggctggaacagttaaaatgtatacatcaaattctctccaaggacactgtacccttggctgaaaattccctccttagtctacttcccatcccaaattctacccatccacactgtggcatcctaggtctctctagcagctgaacaggcaggcctctgtaacaactgtttcagcgctgactgagtggttaagttaaatattaaaagttgaaagagccagtaaccttatacaaaggctggaatagaacaaaagcccaccacaagtttttgcctaagtctttcctgtgccttgaaccatgacaagaggaggaaggaattcttaaccagacccatttaggattaagtaagtttttattggctgggtacggtggctcacacctataatctcagcactttgggaggctgaggcaggcagatcacctgaggtcaggagtttgagaccagcctcctggccaacatggtgaaactctgtctctactaaaagtaccaaaatgagccaagcatggtggcgggagcctgtagtcccaactactcaggaggctggggcaggagaatcgcttgaacccagaaagcggaggttgcagtgacctgggatcacaccactgcacttcagcctgggcaacagagtgagactccatctcaaaaaaaaaaaaaaagaaaagaaaagtttttactgggggtctgaagacacaagttttattggaggtctaaatgaactcctcaaacctccgtgatttagcaggagatgtgataagggtaatcaccccagcacttggacccatctagattcaatacatttactgaggctccagaagaaggtcttcacaccttagttatggattagaagaagttaatcacttacgtctttagatgaatgcacacttacatgtagacatatggcttagaaggtatataaaccctggaaagctttgtaattttgagttagtctggtgatatattccaggccttctccctgtacccggttacaaaaataaacttccttccttcccagttcaactgcatcttgttattgggccgcgagaatcagcagcctgaccctcggcttggaccaggaacaacatggtctgagagagctcatcccatgttccaaagggagattaaatgacaaattaagataccccaataataaaatgccaacaataagatgccctacagtgtaatagaaacaatgtaccattatgaaattcccagtaggaaatgaaagctcaaagactaaattcacttgccatttcaagataaaaagaaaatttcaggtccaaacttttttcctgcctcaatttcatattctgatcaggctcagccagaggatgtctcagtatttagacagagtggaggttcctgcggcaccatcctggagaggtgtaacattctttgggtggaaaaggtgaactctgctctcatatgctatctacttaaagagtctggaattaatagggcaccaaagatgatcacagctctgtctccacatccaccaaatttagaaaccaaatctgataactaagtcatttatcagagactcagtggtacccaagtgaggaagggccactggagacaatcttgtttttttcaccggggctggagtgcagtggcgcgatctcggctcactgcaagccccgcctcccgggttcacgccattctcctgcctcagcctcccgagtagcccggactataggggcctgccaccatgtccagctaattttttgtatttttagtagagacgaggtttcaccgtgttagccaggatggtctcgatttcctgacttcatgatccacctgcctcggcctcccaaagtgctgggattacaggctttagctacggcgcccggccattcccctcccttttctgctaggctcactgaactattaacgagcaaaaagtaaacttcccttttctttgagttattatacatttggggtctatttgttagagcaatgcgcttgccctactatactctccctgggccttgtatgatgaaattggtaacagccacaaaaactgcatctgggacacagaaggtggtagaggggaaaataatctgactgacaaagattctgtttataggtgactttttaggattgtggagttaggcaaagctgggatcactcacacagcctgataggggattttcctacgtgggtgggctgacctggtggtcctggttacactgcccaccagccttctggtgtctctactaggagtaaggtgccttctctttctcctccaggaccccacacctccagaccctgctgagggagggccacccatttctagtcccagctcctactctaactatctgtgtgaccttaaacaaggcctttcccctctctggcctcagtatccgcctctgaataatggggctgggcctgccgaccttctggcccttttctgctctgtgagtttgtgaacttgtgatagggagacaggagtcctaggaaggaaatggaactggtgatagggagacaagagtcctaggaaggaaatggaacttgtgatagggagacaagagtcctaggaaatggaaggagagcacgtttcactctgtccagcagagggcagcagctacccacaaatcaacagctgagcaaggccagggctgtgtgggagctatgcacaggttctgcctccagaagccttcagtgcctgcctctgagccagagggttccaagcagaagaggtcccgcccccggagagggacctcagagaggtcctccaagcccctctcagctcttacttacggcatcccagatgccctattcctcttctgcagagagaaggtggttcagccactaaatggtgctgggacctcgcagtttggtgggaaggaggaagcttactcaagcaaggaatatgagacaggcaaaaacccacgcataagccaaaagcccctccaaagcgaggtgttgttccaggctgacaagtgtccagcagggtggacttcagactccctgttaggaactgaattgtgtcccccaaaaagagaaagtcaccccagggtatgacctaattcaggaaaggtcattgcagatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacggtgagtcggtgagtttctgtggtttaggccccccagttgtggttgtttcttacggcagccccaagaaaccaatacactcccccgtccactttccacggcagagtttgggcgtcactgaatcccacctccacagcaggttttgcttggactgcacagtatttattgatgctgctgttggttttaatttctaatgtgtgtgcctgtagctgtaccactcctcctgatgactcacctggctcctgcgggcatctgagatgtggtttctgctccacacttcctgggggagcagaggaactcctcagcctcctctcaaacttctctcaggttgtgctgttcactccctccccaggcttccggtccacacggacagctctgaccccgagaagattctttgtcttagacaaacatctgcctccctgtaacttcggttcaccgatacttgctctgcactccagggccatacagaacccctctgctccctctgcccttagccattggctcctaggagacactagcttgtccggccgtcgctttaaactgtctagttccaactccctcagaacttcctcagtgatgcagtttcctgacggtcatattgcctggataagctccagtatgttcaactccctctgtggttcagcaaccaggactaaacaggattcacctgatgcacattctaaccagagtcaagagggcagaagcatcgcctcctgcgttccaagctcaatatctcaattgtaatccccacatgtcaagggaggggcttggtgggaggtgattggatcatgggggtggtttgccccatgctgttctcataatagtgaggggtttctcacgagatctgatggttttataaggggctctttcccctttgtgcaccctctctctttcctgcttccttgtgaagaaggtacttgcttctctttctcctgccaaagcatgaccttataattgtaagtttccggaggcctccccagccatgcggaactgtgagtcaatgaaacctctttcttttataagtgacccagtcttgggtatttctttatagcagtgtgaaaatggactaacacagatatttggcaggcatccagtagtcttcgataaacacaaccaccatctagtggccagaacagccttatcggaccccactgtctgcaatgaaaagctgttcctttcctcatcctttacagggccaagcacccagcatcctgggacagtggccccgtgtgcccagctttgaggatgagctcatgcctggttgctctgggtggagagagggaagagttgaatcaacatccatatgtataaatctccttttgtgcatttagaatcacgtccttagaataaattgcgatcagtggcattactgaagcaaattgtatcaaaaatgcaaaaaagacccatttttccaaattgttttctaacaaggaagtcatattgtttgctttttgatactgttctttagaaaacgatgcatgagagttttacatttcatatagtgtgttctatttattttatactttgcaatttctgtaatttttaagcactgttcttcccatactagaggctctgctctaactattcaacttttgtttgtcctagttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacagtgagttttctggcaaatcaaataaatactaataagtctgtatgcacattatactttatacaaatcctatgagtgatgttccagaaataacaagttttgaaggcaaaataagtccttaaattggcaactttgacacataattccatgtagtagttaatcttgctagaagatcccaatgttgttattctaatacaatctgataatgttcactggcattttccactgttggcatctttactatagcctacagttgtttgtttgtttatttgagatggagtcttgctctgttgcctaggctagagtgcagtggcgtgatcttggctcactgcaacctccccctcccaggttcaagcagttctcctgcctcggcctccctagaagctgggattacaggcacgtgctaccacgcccagctaatttttgtatttttggtagagacgtggtttcatcatattggccaggctggtcttgaactcctgacctcaggtgatcagcctgtctcggcctcccacacacagtgctggggttacaggtgtgagccacgattcctggctgcctacagttctttgtaaagcagacaaaatagtttcattttttaaagaaatgaacatatatgaggcaacctgtacctaacttaggagttcagaaattccctggactgcctatacattttggtttctcattcctaattcccaaagattaaaatctgtcaggaatttggaaacattgaatcacaggccaaaataggaccatgtctccattcattcattcattcaacaattatttattgagcgcatgctatttttcaggcactgtgccacatattgagaatagagtagtgagtaagacaaagtcatcactttagggagtttatattttagaggagagaaagacaaatgaaagtgtttaggctgggcatggtggctcacacctgtaatcccagcactttgggaggtcaaggcaggtggatcacctgagctcaggagttcaagaccagcctgggcaacaatcccatctctaacaaaaacataaaaaattaaccaggtgtggtagcacatgcctgtggtctcagcaacttgggaggctgaggtggaaggatctcttgagcctgggaggcagaggttgcagtgagctgaggttgtgacactggacttcaacctgagtgacagatcccatctcaaaaacaaccctgggccgggtgtggtggctcacacctgtaatcccagcactttgggaggccgaggcaggaagatcttgaggtcaggagattgagaccatcctggctaacatggtgaaaccccgtctctactaaaaatacaaaaaattagctgggcatggtggcggttgcctatagtcccaactactcgggaggctgaggctggagaattgcttgaacccgggaggcagaagtagcagtgagccgagattgcaccgctgcactccagcctgggcaacagagtgagactccatctcaaaagaaaaaaaaaaaaaaaactcagaactatttaatacaatgtactggcaagcggtgatgagcactatggaaacgtgaagcaatgtttgagtgcagcgagtgaagcggtgctgttttgtttgtgattgtcatgaggacccctcagaagagcagagagctgaatgcagtgagcatagaaccttactgaggcctgggcaaggctcttccagacagcaaactgccctgaggcaggactgtgtttggcgtgtcctggaaacaggaaagaagccagggcctctggaatgtggtgaaggagagggaaaagtagtaaatgaggctggagagagaggcaggggccagaacatacagggctgtgtaagtcacattgagttctttagattttcctgtaagtgtggatgggaagcagttggagggttttgaggaggggtggtgtgatctgacccgcattttagaatcatcccgttggctgaagtgtggaggaaaaaagcagggggcagaagtagaggtgaggggcagccagttaggaggctacaggagtagcccagaccagacaggagggtggctcggccctcagagatcttggtggggcagattagagagtgatcaagttagagctaacaggacttttttttttagactgggtctcgcttgttgcccaggctgtagtgcactggtgcaatcatggctcactgcagccttgacctcctggatcaaggtatcctcccacctctcagcctcccaagcagctgggactatgggtgcatgccaccacacccagctaatttttgtatttatggagatatgggtctcaccatgttacccaggctggtcttgaacttctgggctcaagccttctgcctgccctggccttccaaagcattggaattacaggcctgagccactgtgctaggccagagccaacaggacttactgagaaattatctgagagagaggggtcaaggaagactccccctgttcaaccaagcaacgaggtgaatggtgctgctgcttcctgagatggggaagactgtagaggaaacaaaccaggaacgacaaatcagtaatttagctttgaatacattaggtttgagatggctagtctgtacccaaacagaccacactgtggcatctgggcagcaggatctgcagaatccagcaggatggatgctgatgccaagctgagtagacagttgggtctgtgagtctaaagctcagggaagacctcagggtctgggatacaaatctggagatcatcaccctgtccatgaaagccaagggaatgatggaagatactatgagaaaaagtgaagagaggaaagagaagaggtccatggaaggagacctgggagaatccaaccttcgattagatcaggaagaggagaagaatccagtaaaaaactctgagaagtctctgggaaggaagtcttccttccttcccctgtaccaggagaggtgctatcccagaaattagtaaagaaacagtttttgatggggagaacaggatcacctttgtcaactgctgctgcgagacttggaaaaataaggactgggaagagagcaatagaaactttgaaagccattggttatcttgataagagttgtttctgtgggggtggtgagaactggagcctgactggatgggttcaagagagaatggggagttctagccaagaaggctgatgaggatgagtcaaattaaaaatgttttctttttatgagtcctctcatatttactgatacaactgatatattgggtctccattctgccacattactttatattgatcatgtattgtatctgctatgcaattgtattgcatgtatctgcatggcaattgtattgccatgcaatgtatttttttttactttaaaaattatatttataaaggtttgtaattttattccagtggttattttatatgtacactttttaaaatgctcttaattttttttttaagacagggtcttgctctttgcccaggctggagtataatggcatgatcctggctcatcaaagccttggcctcctgggctcagtaagtcctcccacctcagccacctgagtagctgggactacagtcatgtgccaccacaacaagctaatttttttgtattttttgtagaaatggtgtctccctgtgttgcccaggatggtctcagtcaggcgatccagcgcacaagcaatcctctcacctcagcctcccttggctcttactcttattttcttgtttaagcttttactatctggtttataaatactgcagtattcttcatctcccatccattgctcatacaacaatctaggggcatattccgtttttctctatttcccttgtcccatttttgagttgcactatttccttatcatctcttatcagctgaagctcattctctagtataccgtcagaaaactttttattttttgcaaggggccagatagtaaatatgttcagttttgcaggcatgcaatctctgccacagctctaccattgtagagtataagcagccatagacaatatgtaaacaaatgggtatggctgtcttccaataaaactttatttgcaaaaacaggtggtgggccagatttggcctataggctaaagccctgtcttagagtagcagcagataaggagacagaaaaactgtacaggaggtgagagaaaactggcaggagagctagggggatattgacaaaagaggagccctttaaatcttccaggggtagaaaaaatgaaattctttgatgttactcaatagtttacctgctcggaaggaggaaaagtgtctcttccatctcagagttggctcagcatccatcctgctggattctgcagatcctgctggccagatgccacagtgtggtcagctgaaagtgatttgctcatcctgaaaacagcaggtatagaaagcgctctttcagcgccatggcaaccagatcgtgtttttctaaaaaaggatcagatcagcgggtgtgtccctccaggcattgatccattaatatgcactgagctcatttcagagccaggccctgggctgagtgcttggaatacaaagatgcaaaaggctaagtccttgtttttaaggagctcatagactggaggaggaggcagacatttacagtaaacagtgtaatcacacgtcatcaaaggaagggacacacaaagggctgggtggggagcatctcctcctctttgggagaaactgacctggagacctaaggttgagctgaattttggagaatcagtcagagttggtcaagaggacaaactgggatgggtcaaggaaaatggagaagcttgagagctgtggcagctccgtgaaatggcaagtatggccagaggatggcatctccagggtgccggagatggccatggagaggcaccgaggccaggccatgccgggcctctgctgcctctgctgtcaccaaggtcaaccacaacctagtgcccaagccagtggcattttccagcctacttttactcatcccttcttttagaaaatgctgccttgacagtctgattttcatggtatcatgatccgctatctcctgatgtgtcctctgtacatccagctgctctttctcactctcttatttgtgctctcacttccttaaattttaaccttcttctcgtgctgcactttctccaggtatatgagaaacctctccatttttcactttcatctgtattgctctttgcctgttggcctcaatttctcccaccacaagatgagcccctaaacgtatctaagaatgtggcctcaagaaccccagtgtggcaatcccagtgaaaagccttttcccagtactcatctttccatcctggggaaggcatgggattgcttttggttggttgtgtacctaccctggcacacagcactattatcagagtgatgggccaatacaatatatggtgagggaaatgaggttccatgattggccccatcagtcacaaggatggaaaggcagtttcctaagacagatgtatcaggcaggagagaggagctatacaatgtcaacagggaaagtgtaatataaataatcatgaactaataatagagggttagccactaagggataaaaagaagtctaaaggttacagaaacaggtgaatggataaacaaaatgaaatgttattctgccataaaatggaatgaaattctgatacatgctaccccatggataaaccttgaagacattatgcaaaatgaaataagccagactcaaaagggcaaatattatatggtgccacttatacaatgtaccatgaatagtcaatccataaagacagaaagcggaatggaggttttcaggagctggaggaaggggagaatgggaagttattgtttaatgggtgatacggtttggctctgggtccccacccaaatctcatctcaaattgtaatcccatgtcaagggagggacctggtgggagatgattggatcatggaggtgattcttgtgatagtgagtgagttctcatgagattcgatggtttaaaagtatgtggctcccttctgtctctctttttctctctctcctgccactttgtgaagagatctgccttgcttaccttcaccttccaccatgagagtgtttcccaaggcttccccaggcacacagaattgtgaatcaatcaaacctcttttcttcataaattacccagtctcaggtagtatctttatagcagcgtgagaacagactattacaatgggtatagagtttcaccttggactgatagaaaagttttggaaatagatagtggtgatggctgcaaaacattgtgaatgtatctaatgtcactgaattgtacacttaaaagtggttaaaatgataaatgttatgtatgttttaccacaaaaaaaaaaaaaatacaggccagcctggccaacatggtgaaaccctgtctctactaaaaatacaaaaatgagctgggtgtggtggcacatgcctgtgatcccagctactctggaggctgaggcaggaaaatcgcttgaacctgagaggtggaggttggagtgagccgagatcgtgccactgcaccccagcctgggcaatagagtgagattccatctcaaaaacaacaaacaaacaaacaaacaaagaaaaaacaggaatcgtggatataggggcaggcactaggtctagggctgaagcagagaacccaaggaaggaaccaacttggaaaaaggtctccgcaggaatgagactcagatgccattggagatggtgtggctagagcccgcaggatggcagagaagtttgttgtagtgcttgaggccgggctggcatgcaagaaacccatgcaccggtgggggcagcagggtgggggctgacaacactcactgagaagctgccctctgaggtgcaggcattcactaggacttcacccgtggtatgttactgaaactccggggagccaactgctggagcatttatgagacacactatgccaccatccggggcttcagcagcgtttggtgaaaacctgcctgtggggttgctgttgaatttgctggagagctgactgaggtgctagcagaactcctcaggaaatcaccaggaggagcatccctgggtgccccatgcaccagtcaagagcaggagcaagaggaaaggaaggtagcctcttcttcctgcagtgtctctccagagccctccattgacagcacttaatatcgtgctagcaggcaaagaaatgtttacaggattcatctccagtatcacaaaggaggataacgaagagtggatttggaattcagaggctctaaagtgataactgtcacagcccacccctttggctactcagtttccatatgcaccctcctacacatacctgaacttctatatgacaacgaacaaaatacagctatccttcttaccagggaaaatattcctaccctttctcccaaatgagaagatactcgtgccaacaacaattttatctatctctggctatattcattactcgaatttgatcacagtccctctaaatattctgttaccaaaagaccaaattgtaaagctaacctccaacaacttgtatataaactgataaagggaagaaggagagagagataaaatggatggcattttcccatcacccatctatcagtgggaaagaactctggggaagtgctcttgaggaagtatctttgggaagaatccctgattggccctacttgggtcatgtgtgttggaatctgtgaaagtcgggaattttgcccatcttacaagctagtaagcctgttatggtttcatggatgctggcagatgacatgagactggatcagagacaaaggactacactactcatggcagaacaagttgcacgaggtttgtgttagttagcattggttttccttgtccccaagtcccacaggggtgatgtggaggggcccaggtggttactgtacacgcagtgtgtttgtactgcagctaaggaacactgagcttgggaacatacaatttaatagtaagtggtgagcaagtctgccctttgtctggggcagggggatattgctttgtcaaggctgtctactgcaaacacaaccctgagaaatatcccaagcaaggaacagtcaggaccttgcattcttgtcatccccagcaagagcatgcagagacaatcagagcctgtggcaaattgcctgtcacaaaaatccaccacaaggcctgacagatccttggccaaattcacattttcccatgagtatgctacctcatcagctgctctgattagtctgaccaacagagggaccaaatctgtttaatttgattcctatcacatttaaaattaaggctgctattgacaggacttcaagcaatacagtgcagcaagtctgccatattgatctcacccatgtccccagggtcccgggctcaaccaactgtctaaaagttctgggggcaagggagaccagtcattcctatttcagatagctaggataaaatctaatatcagtctagtattcattatgacccactcatgggagtttagattcactgatatcattgccagtgactacaggaggcaatgtagggagcaaagaccctcatccctgatggaaggacattcatggcctctccctttcaaagagacaatccaaaggggagcaggtcactctagtttggaatttgttgttaaatttgatttgaatcatcattgcattggtttggttaggtaagatggttaaattttacgtgtcaacttggctgggtcatgagactaagatatttggtcaaacattactctggatgtttctgtgagggtgtttttggatgagattaacatttaaatcattggactttgagtaaagcagatgactctacctaatgtggatggtcctcaaccaatcaattggaggcctaaatagaacaaaagactgacctcttccaggcaagaaggaattctgccagcacatgaactttgcacttgaactgaaacagtggctctcctgggtctccagcctgccagcccccaccctgcagattttggacttgccagcctccataatcatggcagcccattccttaaaataaatctcactctctctcttcctctagaatatacatacatatatatatatatatacacacacacacgcacacacatataatattatatatattttatatgcacacacaaaataacagatagatagatatcgtattagttctgtttttttggagaaccctgactagtcctagttgcctttcttttctttttccacttttcttctgagctcatgttccaccttctgatatcttaacatcatttccctgagctcactttatccttttccttcttaaaggcgaccatttcattaagtttttaagtgcctggtaattgcttggttatgaccggtgtctgctccatggcagcctcttcctggtgagtattccacatctgccattggtttttcctatccctttcctacatttgcagagatcctgcatgtcttcctttttgatgactcatctttgaacaagtggaatttttttttttttttttttttgagacggagtctcactctgtcgccaggcaggagtgcagtggcgcaatcttggtgcactgcaacctccgcctcccgggttccagtgattctcctgcctcagcctcccaagtagctgggactacaggtgcccgccaccatgcccagctaattttttgtatttttagtagagacggggtttcaccatgttggccaggatggtcttgatctcttgacctcgtgatccacctgcctcagcctcccaaagtgctgggattacaggcgtgagccaccacacccggccaaacaagtggaatttttcctggaccagctctttgctggtcatgtgggaggagttggggctgtgttccaagtcagctggaatttttcttataacccaggattttacatgtgagcttgatcagcctttacttctcagcttaagcaggtctgggcatgtttggcaacctggcctgcataatgaagatttccataatttggtgttcatctatttattcagtttttgcccgaatgatgaaggaggaagtttacatcttgctccctggggacaggcagagacagtgtgtgcacttccatcctacagggaccagatctgaacagtctggagagaggagctgtggtggcagcagacagatctctgcttcaggggccaggtgtctaggtgagacgccacagcgcggcagagagaacagaggcttctctgcatgcctgccagggaattggcaccatgtcaacagaaatcttaggttacaggaacaggaaccagccctgactgacgtgtgcaagcccggagctttcctttctccttgcacttcccacatgttccccacataaccagcaaccacagagccaccccctgccacccaacaactccctcctgagctagaaacttgtaagactcagctaggagtctgaatggttggatatctaaagcaaagaataatctagtttgtaacatgggaccaaaggaagaactgaatatccacaatctgtgtaaaaagaggccactttggagatttctatgcctctcaggggctctatctcaggatggctcagctgtaattatctttggattcccatacagatccaacttccctggaaagagaaagtctcatgtttgttaataatatgaggaaagaattaaaatatatcagctgctatgggctaatgtcatttattttgacttttcttttgtagaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacaggtaaaaaacaatcatcctcttcattatgggtttcaattttaaatgtaatacatttttagaaatgcctatttccttttataatctctttatataatctaggttattctggctcttaggtcttcatttagctactgaaaagatttgatctcaaatcaatgatctaaccacccatgaccatctcccacctctctccccgtacaccccccagcatgaattctgggaactcaggtaaaatgctttctggaaacctgcctgtattagtctgttgtcaagctgctaataaacacatacccgaaactgggtagtttataaaggaaagaggtttcctttatagttccacatggcttgggaggcctcacaatcatggtggaaggcgaatgagaagcaaagtcacatcttgcatggcagcagggaagagagagtttgtgtaggggaacacccctttaaaaaaccatcagatcttgtgacactcattcactgtcacgagaacagcacgggaaagacccgcccccatgattcaattacctcccatgacacaagggaagtataggagctacaattcacaatgagatctgggtggggacacagacaaaccatgtcaccgcctaaaaccaactcaatagtctaaggaatttgactggggagaatctggagaggatttaattaatttggcaaaaggattagcaattgaatctaagtgagaaaagagaattcttggaggaaaaaaagatgtttagttacactgagaaattaaaacctgaagtaattgcctttgagatttttttcaggaaatgagtattgattgcctactgtgtgtcaaattatgtgtttcatgtcaaagactccaaagtagataagatataggcccagccttggggagctcattgagtcacagagaaagtttgaatgtttcagaggaatcatcaagaacaggggatcagcaatctattatattttaattgcgtcttttcatgattataaaagcaatgcatgcgtgctgaagagaatttggaaaaacaaagaagaaattaaaaatcgtctctgatcctgccaccagaaataaccactgttagcaattgtatcacttctgtaggtctacatggttatcataataagctctagtattgattacatgcatctcatgtaccagagattatgctagactctcatttaatctgtacattagccctatgaagtagggaccatcattctcctcattttacagatgaggaaacagaggcttggagaggttactctgcctaaagtctcatagctagcgagtggcagagattggactcacccaagctttgtcttattctcaagctctcaaccaacccggtggtgagaagagccagcagcaaagcctgtcatctttgtcttctttttttttctaacctcaaatcagggagaaaatgccctttgtcattagaagggcaaggcaattctgaagacagcccagttggcttgtctccgatttggctttcaggggcctgtctgatacctatggagagacgagggctgaacaagctgtactctcaaaacaaaacaaagcaaaacaaaactttagtctctttagggactctctgatagtaatgcagagggagaaaggctttctttgtctcactgggaggaaggttccctacggaaattgaaggcagtgcctgttgacatagcgctgccacctggtggaaataatggtgtaggacatcatgtccagcaccactagcgctgagacactccctgggaagagaaatgtttggagagaaatttgcaagaagttggaagtctcgcagtagcaggtaggaacaagaattataactgctactgtgaccccctaaggctcctcacatcctcttaaggcttggagaaactcacactatgtatattttcctgtatttttgaaaaatgttttcctttatgctttgttgtaatgaaattacctctgatggtcacataccttaaatatttagtatatatatgaatactaaatgtccattttcaggagttagtttacctgcatctaaaatcaggaataggtcacagagtaactgagcaaaaagtgctgttaggtttgtgcatttcaccctttgcctgggatgagaggacctcaatcatcttggtactaatgacaggaaaagtgccctcctatccatgtgtatcggctacgtgactcaagtctccttatttccttttctagcataacaaggggttgttactgttgttttacatctgtgttaatgagataaataagtttaaaataaaaagatgtgtaccaggcagatggaaaggtgaaccatgaagtttttgccatctggatcttctgtcaaagacagatgaaaaattctgcccagggtgtatgctgaagaacacaaatacttaatctggagttcaagtatgggcttcaaggagtctatacacccctgaaattttgggacagatggaatgtgtctgaagtatattcatttttctgggaggaagctccagagttttcatcagcttctgaaaatagtgcatgcccaaagagaaggttcaaaatcattgcctggggcctttcagagggtccttctaatcatggtgttccctaatgttaatcaacaccacaagcactattattattaaaagtaattgggtcaggtgtggtggctcatgcctataatcccagtactttggaaagctgagggaggtggattggttgagtccaggaattccagaccagcctggccaacattagctgggtgtgaaggcacacatctatagtcccagctactcaggaggctgaggtgggagtatcttctgagcccaggaggtggaggctgcagtgagttgagatcatgcctctggcactccagcctgggcaacagagcaggaccctgtttcaataatgataatagtaatcatcatcatcatcatcatgatgtcgcaagctgatttgaaataacttatttttatataagcacttggatttacataggcttgactgaggaattacactagtgattaagggttcaacctggacactggtaaggtagaccaagccacatgaacccctgccattggcaggccagcagccagtccatccttcctcctttggacccgtggactgtactcaaaatcagtagaggctctgtcagaaggtcctgggaaacaagacctgtccatggtttctttacctgaaagtaaaaatgtttgatgatataatttttaagttcctttgaatcattaaagctcactgatttaggagaatggcttttacaatttttcagctttaaactccctcctaagtttctgaagatcctcttgggccacttcatggatctgatttaaatctaaagtcctaggggtttcaaggagcacagtttggaatctaccatcccgggacattcattatattagtctgttttcatgctgctgataaagacatacccaagactgggcaatttacaaaagaaagagatttaattggacttacagtcccacgtgttgttccctttttgctgacattaccctgtctgaagtcctctacccagggaagccacaaggcactgttctgggtggaggtgggtgtggtgtccactgcgccatacccaccaggacctgaggtggaagctggccagacactggtgctctgctggcatttgggctgcagatttggggcaggtaatgggcatggagagaacagagccaaaagcagcacaggaagatgtggccattctggtctgagagaggcatgggaaatgacggttggtggcagaagcgttttctaaacttaggctcgtgaacagctttcaagtccagctcttgtccagatgttgtcttataccacatgctcatggcaaccagaccacctctgatttttttgcaaccaggtgcctaacacagcacatcagtcaggatctggcaggaagcaggtgacattcacacaaggtaactgacgaaagctgcttttgttttttgcttttggaggaagatgttgagaacacctccatttattaaattagctatagtaagtgtagtttacatattaaggagagattaatgataggatttatacagatgtgacaggtttagggaatgaccccactcagctgtccccctttctatgagaccatgcctctgccttctcccaactccattccagcccagatggccttcctttgtccttctgtggggtggagatgggaatggttctcagttccagctagaatcaattcaactggggaagcttcaaaatacgtcagtgcctgggccccgcccccagcatttctaatttaatggggctcaggtggggcctgggcagtggtgctgtgtaaaagctctcagttgattccaacacgcccagaccaattcattgacactctctggggtagagggcctgggcactggtactttttcaaatttctccagtgcagccagaaccaagaagctctgttttctttccaaatctattgtctgttggggtgatcagacccaacaccaggtcatgggggtgacaaagtctggtggagtcaaaggattgagaaataggtttgaaagagaaaggtgggacaccagggggccatcgccattgtggaggctgtgaaggccctgagctctgggagcccatgctatttattggcagtccaacaaagaaacatgtggtgagaatgtggaggtcaaaaggacatgttgcattaagcacatgatttacagctgtgatggtttagcgtttatatggaacatgttttgctacttgagataatgggagtaggagcctaggaaggctagaagcaaggagccagcaaggctagacacattccagaggacattatgtcagatatgcaagccctgcctcagtttctcccaacactcagctttttcctaacatgccccccttctcttttttgtaaaagagaaagtattattactagctatcattagcaaggtgattgcaggctgtgcagcccttaattgccggttggtgatccagcttcatttttcttagcccttattcaaaccggagtcactctggtttgagtgcttcccacatatctccgctttcccttttacaggacccttaatcctaggggttgcagaaggatgaaggtccatcttctgtaacttcttcatgctgaataggggtgatgatactcctgcctaactattagggtttctgtattcagggtagagaggagctcagccagaaagcattggtctgttaagcatcaagactccggtcggtcctcgttccatcttctcattcagattcagctggctcatggctcgtactggggaacccagtccatgcttaggatccatgggtccctccagtctcccattccatggtcgtacacgtcttgagggcatccacatggttcgttcatctcctgcaaaaacacaagcataccctcacccccacattagtaaatctactgaaacagaagcaaaaactgttgtggctgtagctgggaggccactgatattgagaaacaggcccttccaacagaaggcaccaggaaagcaaatcaaggcttaaaagcaatccttaaaccttcaatttgcactgtacaggtgggtccactagatgctgtggctcatgacagatcttcagatgtttggtgaggacccacacaggcacctgatcatcacctggagagacacaaacaaatcctcttcctcatattaaagaatggaattcttgtgcatcagcaaagaccacagacaccaatgcatctgccctttaagtttaaaggaccaaagagtcctattggagaaaaaagaaaaagcatttttatccttaccttcccccgctctattccttttatatttgccctttgagccatagctaatttccataattcagaatgttctcgtctgtccctgcaaatctctgctagtctttgctagcctctacttttgtacctctttagggcactgaccttatattgctagtctttgcttttgtacctctttagggcactgattttatattgctagtcttcatctatccctatctgtccctgtggtacctgtgagttcctgcaagtctctgtctctatctctatctctatttatctctatctatctatatctctatctatctctatctctatttatctctatatttatctcctttagctgtacttacttatctctacttagacttacttatctctacttacttacttgtctctacttatctctacttacttatctctgcatctttcctggaaaccttttctatgaccctgagtagagctcagaaatccaccctttaagcttcaccaagagaaaaacagggacactggaccctgcaccagattgaagggaacaggaagtgctctccccgccccaaagcaggaaaacaagagtttggcccttgcaaatttccactccacatcagcgtcatcctcaatttcctggaacattatagcaatgaatttgtggttatagctgatgaccactgatttcacttcagaaagtccaaatatagcccagaacagtgtcttaaaactctgttgtgaaggcttcattttgttttgcaccaatgtagtaggagtagacgttgaacattcccatcataaaggccacaaataccacaatgaacacattccttgtgtgctgattaaatcgtttttctgtagcagaggtaggttaaccatgaaactgaagcgtgatgacttcacttgccctatgcaaagcagcccatgatttattttttctggggactactgacaaccagtcctgtgtgtcaaccggtaagcatccaacagcaggtctactgtacaaataggtcttttgtcagacacttgattaacccaatatatagcctttcctgttggattagtgctaccaaagcctccagttcttttcactgtactgcttcccagctttatgtcaacaactgagcaattctttctcctagggaagcagaccacggagttgaagaactaataactaattgaatttctccagtataatcagaaccaatcattcccatatgcacagttacatctctaggtctttctttttattattattatactttaagttctagggtgcatgtgcacaacgtgcaggtttgttacgtatgtatacatgtgccatgtgggtgtgctgcacccattaactcgtcatttacattaggtatatctcctaatgctatctctctccgctcccgccaccccactacaggccccagtgtgtgatgttccacttcctgtgtccaagtgttctcattgttcaattcccacctatgagtgagaacatgcgtgtttggttttctgtccttgcgatagtttgctgagaatgatggtttccagcttcatccatgtccctacaaaggacataaacttatccctttttatggctgcatagtattccatggtgtatatgtgccacattttcttaatccagtctatcattgatggacatttgggttggttccaagtatttgctattgtgaatagtgccacaataaacataagtgtgcatgtgtctttacagcagcatgatttataatcccttggttatatacccagtaatgggatggctgggtcaaatggtatttctagctctagatccttgaggaattgccacactgtcttccacaatggttgaactagtttacagtcccaccaacagtgtaataaaagtgttcctatttctccacatcctctccagcacctgttgtttcctgactttttaatgatcgccattctaactggtgtgagatggtatctcattgtggtttggatttgcatttgtctgatggccagcgatgatgagcattttttcatgtgtctgttggctgcgtaaatgtcttcttttgagaggtgtccattcatatcctttgcccactttttgatggggttgtttgatttttttcttgtaaattttgtttaagttctttgtagattctggatattagccctttgtcagatgggtagattgtaaagattttctcccactctgtaggttacctgctcactctgatggcagtttcttttgctgtgctgaagctctttagtttaattagatcccatttgtcaattttggcttttgttgccattgcttttggtgttttagtcatgaagttcttgcccatgcctgtgtcctgaatggtattgtctaggttttcttctagagtttttatggttttaggtctaaaatttaagtctttaatccatcctgaattaatttttgtgtaaggtgtaaggaagggatcaagtttcagcattctacatatggctagccagttttcccagcaccatttattaaatagggaatcctttccccatttcttgtttttgtcaggtttgtcaaagatcagattgttgtagatgtgtggcattatttctgagggctctgttctgttccattggtccatgtctctgttttggtaccagtaccatgctgttttggttactgtagccttgtagcatagtttgaagtcaggtagcatgatgcctccagctttgttcttttggcttaggattgtcttggcaatgtgggttcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttccatttgtttgtgtcgtcttttatttcattgagcagtggtttgtagttctccttgaagaggtccttcacatcccttgcaagttgtattcctaggtattttatttgctttgaagccattgtgaatgggagttcactcaagatttggctctctgtctgttactggtatataggaatgcttgtgatttttgcacattgattttgtatcctgagactttgctgaagttgcttatcaacttaaggagattttgggctgagacgatggggttttctaaatatacaatcttgtcatctgcaaacagggacaatttgacttcctcttttcctaattgaataccctttatttctttctcctgcctgattgccctggccagaacttccaacactatgttgaataggaatggtgatagagggcatccctgtcttgtgccagttttcaaagggaatgcttccagtttttgcccattcagtatgatattgggtgtgggtttgtcataaatagcttttattattttgagatacgtcccatcaatacctagtttattgagagtttttagcatgaaggttgttgaattttgtcaaaggccttttctgcatctattgagataatcatgtggtttttgtctctggttctgcttatatgctggattacgtttattgatttgcatatgttgcaccagccttgaatcccagggatgaagccaacttgattgtggtggataagctttttgatgtgctgctggattcggtttgccagtattttattgaggatttttgcactgatgttcatcagggatgttggtctaaaattctctttttttgtttgtctctctgccagactttggtatcaggatgatgctgacctcataaaatgagttagagaggattcccactttttctattgattggaatagtttcagaaggaatggtaccagctcctctttgtacctctggtagaattcggctgtgaatccatctggtcctggactttttttggttggtaggctataaactattgcctcaatttcagagcctgttattggtctattcagggattcaacttcttcctggtttagtcttggcagggtgtatgtgttgaggaatttattcatttcttctagattttccagtttatttgcatagaggtgtttatagtattctctgatggtagtttgtatttctgtgggataggtggtgatatcccctttatcattttttattgtgcctatttgattcttctctcttttcttctttattagtcttgctagcagtctatcaattttgttgatcttttcaaaaaaccagctcctgaattcattgatttttttgaagggttttttatgtctctatctccttcagttctgctctaatcttagttacttcttgccttctgctagcttttgaatgtgtttgctcttgcttctctagttcttttaattgtaatattagggtgtcaattttagatctttcctcctttctcttgtggacatttagcgctataaacttccctctacacactgctttaaatatatcccagagattctggtatgttgtgtctttgttctcgttggtttcaaagaacatctttatttctgccttcatttcgttgtgtatccagtaattacgcaggagcaggttgttcagtttccatgtagttgagcggttttgagtgatttcttagtcctgagttccagtttgattgcactgtggtctgacagacagtttgttatataatttctcttcttttacatttgttgaggagtgctttacttccaaccatgtggttaattttggaataagtgtgacgcggtgatgacaagaatgtatattctgttgatttggggtacagagttctgtagatgtctattaggtccacttggtgcagaggtgagttcaattcctggatatccttgttaactttcggcctcatcgatctgtctaatgttgacagtggggtattaaagtctcccattattattgtgtgggagtctaagtctctttgtaggtctctatgggcttgctttatgaatctgggtgctcctgtattgggtgcatatatatttaggatagttagctcttcttgttgaattgatcccttttccattatgtaatggccttcttttctcttttgatctttgtttgtttaaagtctgttttatcacactaggattgcaacccctgctttttttgttttccatttacttggtagatctttctccaaacctttattttgagcctatgtgtgtctctgcacgtgagatcctgaatacagcacactgatgggtcttggctctttatccaatttgccagtttgtgtcttttaattggagcatttagtccatttacgttcaaggttaatattgttatgtgtgaatttgatcctgtcattatgatgttagctggttattttgcttattagttgatgcagtttcttcctagcatcgatggtctttacaattttgcatgtttttgcagtggctggtaccagttgttcctttccatgtttagtgcttccttcaggagctcttgtaaggcaggcctggtggtgacaaaatctctcagcatttgtttgtctgtaaaggactttatttctccttcatgtatgaagcttaatttggctggatatgaaattctgggttgaaaattcttttctttaagaatgttgaatattggccccctctctcttctggcttgtagagtttctgccaagagatccgctattagtttgatggacttccctttgtgggtatgccgacctttctctctggctgcccttaacattttttccttcatttcaactttggtgaatctgacaattatgtgttttggagttgctcttcttgaggagtatctttgtggcattctctgtatttcctgaatttgaatgttggcctgccttgctaggttggggaagttctcctggataatatcctgaacagtgttttccaacttggttccattcgccctgtcactttcaggtacaccaatcagacatagatttggtcttttcacatagtcccatatttcttggaggccttgttcatttctttttactcttttttttttttctaaactcttctcacttcatttcattcatttgatcttcaatcactgataccctttcttctgcttgattgaattggctactgaagcttgtgcatgcgtcacgtagttctcatgccatggttttcagctccatcaggtcatttaaggtcttctctacgctgcttattctagttatccattcatctaatcttttttcaaggtttttagcttctttgcgatgggtttgaacatcctcctttagctcagagaagtttgttattaccgatcatctgaaaccttcttctcccaattcgtcaaagtcattctctgtccagctttgttccattgctggtgaggagctgcattcctttggaggagaagaggtgctcagatttttagaattttcagcttttctgttctggtttctccccatctttgtggttttatctatctttggtctttggtgatggtgatgtacagatggggttttggtgtggatgtcctttctgtttgttagttttccttctaacagtcaggaccctcagctgcaggtctgttggagtttgctggaggtccactccagaccctttttgcctgggtattgccagcagagcctgcagaacagcaaatattgcagaagagcaaatgttgctgcctgatcctgcctctggaagcttcatctcagaggggcacccggctgcatgaggtgtcagttggcccctactgggaggtgtttcccagttaggctactcaggggtcagggacccacttgaggaggcagtctgtccgttctcagatctgaaactccatgctgggagaacccctactctcttcaaagctgtcagacagggatgtttaagtctgcagaagtttctgctgccttttgttcagctatgccctgcccccagaggtggagtctacagaggcaggcaggcctccttgagctgcagtgggctccacccagtttgagcttctggctgctttgtttacctactcaagcctcagcaatggtgggcacccctcccccagccttgctgctgccttgcagttcgatctcagactgctgtgctagcagagagagaggctccatgggcatgggaccctccaagccaggtgtgggatataatctcctggtgtgtcgtttgctaagaccattggaaaagtgcagtattagggtgggagtgtcccgattttccaggtaccatctgtcatggcttcccttggctaggaaagggaattccctgaccccttgcacttcccaggtgaggtgatgccctgccctgctccgtgggctgcacccactgtccaacaagccccagtgagatgaaaccggtacctccattggaaatgcagaaatcacccatcttctgtatcgctcacactgggagctgtaggttggagctgttcctatttggccatcttggaacctctctagatctttcaagtaatagactgttcctgagggcaagggtcccccaactcccatggggaccccctccggtgctccccaggaagcacagaaatggaaactgcactgcaaaggtccatggcagcactgcccaccaaggcggcagacaattgctgccatttgtaagggcactggctgtgccagatatgccttggtttattgaggtgctctctgaataaacaagcctcagattccactgggtcttagtgctaccaattgctccaggttttaatgttgcaactacaggaatggtaagttttgtagctaattcattttctcgcccattaaggaaagagagaagaggtggccattcacttaattcagcaggtggagccaatgggctagtaaaacatacttttttcattttccctttctttaatttcctgcgtttcctgttcctcacattcagaatctgaatttagttctttacactcgtcctcatcttcctcatctgaatctgcctcatcatctgtttgaaatggctcaagagttgcttttattagtgcccatattgaccaaaccaagactggaatttttgctccatctttatatgctttttaaaaaatctcggccaattctctcccattcctccaactctatagtcccttgttctgggaaccatgggcaaaactgctttactgcactgaagagtgagtgataacaaattctgaggactaactttcactctccatcttcataataaatgccttaagaaatttcgataagcagaatgtctgctttcactttgtctcattgttaccctggttcttccaagtgctcagctttcctactgagcttcttttagacatcctcaggtgtcctttgacgatgcatcctctgctttcacacactctagcgttccttcagtggggtctttgtcgccccacattgagcagccaggaatgttggggtgatcagacccaacaccaggtcttgggggtgacaaagtccgacggagtcaaaggattgagaagtagacagtttgagagagaaaggtgggataccagggggccatcaccattgtggaggctgtgaaggccctgagctctgggagcccatgctatttattggtaatccaacaaagaaacaagtggtgagaatgtggaggtggaaaggacacattgcattaagcacatgatttacagctgtaatggtttagcatttatatggaacatgttctgctacttgagataatgggagtaggagcctaggaaggctagaagcaaaaagccagcaagtctagatacattccagaggacatgtcagacatgcaagccctgcctcagtttctcccgacactcagctttttcccaacaattgtcttagcaaaaactcagagctctgttctcctcataccttcctttagttttgaaggtatatttcagaagtaaaataatataattacatttaaaaactgaacattgattatttttaccctaacaacactacctgaggtactgtcagaatctccatccagaggagggtcaagaacaagggaataaaagaaaagcaacacctctatttgatagcagcattcttcacaacagccaagaggtggaagcaacccagtgtccaccatggatgaatggataagcaaaacgtgtcatgtacatacagtggcatgttactcagccttaaaaaagaagaaaactctggggtgggcacagtggctcatgtctgtaatctcagcactttgggaggccaaggcgggtggatcacctgaggtcaggagctcgagaccagtctggccaacatggcaaaaccccatctctaataaaaatacaaaaattagactctacctcaaaaaaaaaaagaagaaaaagcagaagaagaggaagaacaggaagaagaaaactgtgagacatgatacatgctataccatgtaggaatgttgacatgatgctaagtgaaataagccagtcacaaaaagacaaatgctatgtgatttctcttatatgagatgtctatggtactcaaatttaccgagacaggaagcagaatggtcgttgccaaaagctgtggggagagaggcatggagagttgttgtttaatgggtaagagtttcagatttcttaagatgaaagtcctggagagggagggtggtcactgcattgtacagcaacgtgaatgtgctgaacgctactgacttgtacacttaagaatggttacaatcgtaaattttatgtgtattttaccccaattaaacaaaattgtagccaagcatggtggctcacatctgtaatcacagcactttgagaggccaaagcaggtggatcacttgagcccagaagtatgagacaagcctgggcaacatagtgatatcccatctctaccaaaaaaaaaaaaaaaattagccaggtgtgatggtgctcacctgtagtcccagctactcagggggctgaggcaggaggatcatttgagcctgggaagttaaggctaaaggaagccatgattgcatcactgctctctagcctgggtgacagagcaagaccctgtctaaagaaaaaagggagctgggtgcggtggctcacgcctgtaatcccagcactttgggaggctgagatgggtggatcacttgtggtcaatagttcgagaccagcctggtcaacatagtgaaacccccatctctaataaaaatacaaaaattagccaggcatggtggcacatgcctgtaatcccagctactcaggaggctgaggcaggacaatcacttgaacctgggaggtggagggtgcagtgagccgagatcgcaccactgcactccagcctgggtgacaagaaagaaaaagaaaaaaaagaaaagaaaaaggccaaaattttaaagcagcaatatttaaatatgtaagtattcaagcaatattcaagtcgtatcttcctacacaagtttgagtggaaaaactctccccaccccccactatcttcactcctacccattagggtttgctctggataaggggagagcaaatcttcatactctcactttcttcttaatccggacttgtgagaagacacagcagtgtttaagaatatgaactgcaaataaaaaccagctttccaagctcctcctcattctccgtgtggtcagcgaggcacaaggtgaggattaggtggtttggagggtgccaacaaggactccaaaatggtggacaggaagaccccaggcagggtcaggaagtggaggaagagcaaagtgcaagtaaaattctgcatagtgaggtacaggaaagaggatgattcttccaatcatgtgggaagagtgaggtttttttacggcaaaggaaccttatttccaattatgctactttaggaaaatgttcctctttgttgacacaggttcccgctgcaccatccctgagcgttgtttgtccatgtgagctctatgtgtgggcttctgcccaagggttatcctcgtgggactgggaggctgtctgcaaagagaagggctgtgacttcgctttgccttgtgtgggagagctgcaagggccccaccctggggtgcctgtgcccagcctggactcctctgttggagctcctcagtgacattattctaaattaaagtcccactctgggaaagggattcctgcacattgccaggctctgctgcactgttcagggtctagggagggaggccaggagaaggcccgcctgtcagggagagctgtgtgtttccctcacatggcccatggaatcgaagagggccaaattcgaaaaacccaaagtaaggctaaacttagttatgcccatcagagaaccttcaccaagtatttgacgtttttcctcctttgattctgggaacggtatctggcatccagtttaaaggtactttttctattgtggaaataaatgaagatgaaccaaatgaaatcaagcaaagcctatttattgagagcctgctctaacaagggagtcacatgcaatcacttgtattttggaagagatgcgaaagcaggcagaggagtgggaaagcttcctaacagaagaaaggggcatcttgaccagaccccagagccacagcttcttgcactaccctgcactgtcctctactgtctctgtcctcaggtcatctttgtatgagagctgaaacaagaagacgaagggtcaccttttttgaccttagcttgggacgtgtgcaaagagtgacagagttttcactactgtgtgtctatccaggagccaccttgaaagctccacaagtattaatttggggattacaaagacacttttagcaagtaagcaaatttgcaaatatgggattcgcaaataatgagggtcaactgtatttgtaagtgactgctagggcctgtttcatggtaatctctttccccaagaatgtagaatgtttctttagcttctttgatagtttatttattcattaatgtatttattaagtacttattataagccaggctctgctttaatctgtgatgaacaaactagagattaaggtcctgccccgtggattttatatttgagtaagaaagacagatagctaagtctggagctcagggggtgaggcccagattgaaattatagattcacttgaccaaggtgaaacctggtgtgccccctcctacttcacatccccagacatacttccagaacatttctgttctgttcttgtgtataaactcttccttttgagcctctctccattgacgcatatcaacctctacttgtcttttgttgattttgaggccacttgcccattttactggcaagatactgaagaagaatcatactgacctggttctgctacataccagctgagttactttggtcaagctcttggacttctgagcctgtttcctaatttcagaagtggtgatatgatgtgttaggccctggtgggttgcaaggaagaggcatacacacaccacctttggtggtgaaggctgaatgttaactttgatggaaagtcatccaagcagccatattgtctctggccctagtactttcaaaaccccacagaacattaatttagcagtatttaggataggatttgagctctgaagacctatagtgtggttatttgttcatatggctgttttccatactagaccatgagctcatgagggcagggtctacagtctcatctttctatccctaggcattcagttcagtgcctgatacatagtaatagaggcacaaatgtttcaaaagttgaggaattttcaactcttcctgaaagaacaggaagatataaaggcttctcagagaaggtattatttaaggttttttttttttttttttttaagatgacatctcgctctgtcacccagtctggagtgcaggggcatgatctcagctcactgcaacctctgcagttcaagcaattctcctgcctcagcctcccgggtggctgagattacaggcatctgccaccatgcccaactattttttgtatttttagtagagatggggtttcaccatgttgggcaggctagtcttgaactctgacctcaggtgatccacctgctttggcctcccaaagtgctgggattacaggcatgagccacaatgccaggcctatttaagctgattctttaaagatgagtagaaatgttttccaggtgaataaaaccttgagacattattccaagcagagaccagcaggtgcaaagacacagggatatagagatgttgaagtttaccaaacactgctagatttagaaaacaaaaaggaaacaatcaaaatcaaaaattaaaattaaaaatcaccaaaaaaaaaaaaaactatgaatgggcttggtgagaggtcacgtcacaattgagtcaactatgaccgtagacactcagtaatttatggaagttttagggaaaaaccataacattctcaggttgttggcagagtatctagaacaatttagaaatacaggtattgaattctgagaataattacactgtagtgaaatcatttccttctctgcgcatgaagcatgtatgtgtcacacattgatcaaggtgctgaaaatcagactcttctcaaggaactcatgagcaatcaagggagatggatgggtgagcaactgattatcatgtgacaagtgaggtaatagagatatgactacaatgctatctaaagaagaagaaaggaattattcgtaatatatggagtgctggggaaagatttctgaaatgaagccggccaggcatgatgtctcacacttgtaataccagcactttgggaggtggaagtaggaggatccaggatgatctaggagttcgagaccagcctggtcaacagagcaagaccctgccatctctatatttgaaaaataaataaataaatttttgttaatgaagttatatttgagcaccatacaataataatgaagtgatatggagcgccatacaaatataggacagactgaaggaatatatgcagcttaatttaacattttttgaaattttatattgcagaagttgtacatatttactgttgtgaaattagaaagaattgacaggcaaggagggtggtctacaaagcactccatagatccaccatactgagacaatgcttaatgctttgatggatttatttattttatactttctatgcatatgcatgtattgtataaatacgtatgcatggttaaatagaaatggttctccttggtgttctgtttatccatttattgttgtgaagtaaatccccaaagagtaggtttgctttgcctgaggagtcttttgctacatactgctgtacataatgaaaactaaaaaaggggctaacttttcagccttgtgaccttatggtgattcaaacagaggcttcatcaaaggcagattcagaaatgaacttggtgtgtgtaggtggttatgcttgtcattattgtttgtaatagtatgatagggatgatttcagtgtctgccaacagggaactggttgaggttaagtaaactgtggtacatccaaatgatgcatactgtgcagttgaaaagaagaatgagaaagacctctgtactcatgtagaagaactcagatatattgtgcgtgttttttaaaaagaagaaggaatggtatcctatgtatggtatgctactttttgtgttgagagagaagagtagagtaagaatatacatgtgtatttgcaaagataaattctgaaaagatatataagaagccaattaaaagtgtttggctgtggaaggagaataagactgtgaatgggattttgctgtatacttttatagttatatttaaaatttttctgaactatgtatttgtacacatgacccttttaaaaataagtgaatgaaggaatgaagtaggattatgagaaagagataagaaaaaaggatctaaggggctgcccatctttttagtacccagtgaatattaatacataacaatagcaggaaaaattggaagagtagccccagtagggtagggagtcagcttttcctttgtcttttcctcaatttcatatattaaaaaatatatattctaagaacgataaaacaatttgaaataaaaatgtttccagatctcttgaaatgaaaggaagatggggcagctttatgtagagcacttcccaaaaatgggctggtttctttcaagaggcagggatgctagccttcatgggatacatacgggagaaaaaaataagaaaaagaaaagagatttaaatataaataaatgaaaataacacttctctctgattataaaggaaatcacattctttttgtaataatttagatgacaaatattaagaaaaatctttaatttgccactcaaaacattctggtttgttgctttttatacttttttatgcatgtaaacattttaaaaagtggaatcacaatagatagtcttctgtcacttactatattttgggcatatttctgtggcagtaaatatattctggcatcatcatttttaatagctggatgtatattaagttaatcattgccaccccagaggtgaattttcttacatatagattttaatggactcgagcaagcatttttggactgaattcatagaagtagaatttctggagggcaataagttttagagtctttaatagaaattttcaaattatcctccaggaaaagtggctcagtttatactcccaccaacagggacagagctccaggttcccccttccattcatcatctttgctgcctttgtacagaaaatatcattgttttcatgacatttccttgatttccggtgcttttgaatcttttttatatacctattggccatttttatttttgtgagaaatgcctgtttctccgttgcccattttctgttgaaaatcatttgtatttttctgagtaatttaaaagatttctttacaggctaagaatacaaaccttttatttgttattgaggttacaaaaactttctcccagtaagtaatttatcatttcattttattttttcttttctttcttcctacccttccctttccttccctttcctttcctttcttttcttttcctttcctatcttttcttttttctttcctttctttccttcctttccttcctttctttccttttccttccttcttactttcctttcctttcttttttttccttccttccttccttccctccctccctccttccttccctccctccctccttccttccctccctcccttccttccttctccctccaaaccccaaagtcacatttcaccaatttttatttggtcaaatttgaaagcattttaacttagtgattttagtgtaaacaggagcaggagagaatgtaattatctaggtcttgctctgtcacccaggctggaatgcagtgccatcatcatagctactgcagccttgaactcctgggcagaagcaattttcccacctcagcctgccaagtagctaggactacaggtgtgtgccaccatgcccagctgttttttaaaattttttgtggagatgtgaactcactaagcttccgaggcttttcttgaactcctgacttcaagtaatcctcccaccttggcttgtcaaagtcctgggattacaggtgtgagctcctgctcctggtcaagaatttagttttgtttgctagtggtgttcttggtatcttttcatatttgaggctttggtgctagtgctgaagtattacactcaccatccaaggttcacaggacttttgttttaatatggaacagatggaactgtttagttctgcatctttgcaggtatgcaaaatgtgcctaccaggactctgcttcatatccatggaaagcaagaagtaatacagtaaaactttgtctggctagaggctttgaaggaatggagtgttctggttgaattctattaacttggaagtatgaaggtgaaaaaaattcagaacttaaatttcctttgaatgcaatttgaaaatatagccaataattccacttttcttctctagtaagtttggacattctgatctacttggtgttttatgatagaacccctagtgtgcctgagacttactttgtgaagatacttttttaaaactttagctgtaagaggatgtaaatgactttgtatgagatcaagctggatgagaactaatacttgtaaatatactttttagactaaa

SEQ ID NO: 12127 - DNA, 188 bp, Homo sapiens
ttggcctcccaaagtgctaagattcttcagtatataaatggtttttagaaaataccaaaacccaattcctagaaagaccattaaaaataatttccctttaattatagacaacttgattatctaaaagcttttttttccataaatccgcttatgatttactccagaccattcatgacatgcttgtgagg

SEQ ID NO: 12128 - DNA, 569 bp, Homo sapiens
aagaaatccaaactacaggctctttaatgagatcttccaaattttaaatgtcatctcaactttttaaaatgaagattaaaaactgtgtgacccaaataaaacagacatgtccacatatgttttttagggaaggatttttgtatctgttcactgctgtattcctaggctaccaaatgaattcagcctgtaggcctcgaatttgcaacttctgacttatatgtaaataaataataaatgtattttttcttttttgagacggagtcttgctctgtcacccaggctggaatgcagtggcatgatcttggctcactgcgacctctgcctcctgtgttcaagccattctcctgcctcagcctcccgagtagctgagactacaggcgtgcgccaccacgtctgactaatttttgtatttttaatagagacagggtttcaccatgttaaccaggctggtcttgaactcctgaccccaggtgatccgcccacctcagactcacaaagtgctgggattacaggtgtgagccaccgcacctggccaagtgttgtattcttaatcatctggaaaaaaataa

SEQ ID NO: 12129 - DNA, 569 bp, Homo sapiens; identical to SEQ ID NO: 12128

SEQ ID NO: 12130 - DNA, 587 bp, Homo sapiens
ccactgaaacctcacaattcttttctgaaattatacatgctcagaacgtatacttaacatttatgctaaaccttttttctcacctctctgccagtgctttacatcattcattttctgaaattccactttccattttctttttccacaccagccataagagaagtgacactattctttggccttggctaataggtttacttccttggctcactgctttaaaatcttcttagcttaggcatgcctgtttatttgttcagtgtgtgaactttggatctttttgttcaggatcagctatttcacacatcgagtactacaaagcagagattacataaatacgtatacaaattgttctctatgacaccccccaagtaggtgctaacatgattattataatgcatttgttatccttttctatttgctcctaggtttttagaacttcagccataaaaatgggcagaattttccttgatcatatcggtggtacccgtctgttttcttgtgcaaactgtgatacgatcctgaccaaccgctcagaactcatctccactcgtttcacaggcgccactggcagagcatttctttttaac

SEQ ID NO: 12131 - DNA, 167 bp, Homo sapiens
ggaagcaggaagggctgatggtaaaccctgagggagagagtaaatctgatagccctctaatcactagagagataatagaatgcagtggcttggccacttctggaaagtcacagtctctttaattcatctataaaagtgaggtgataaatacctactttaaaaattgt

SEQ ID NO: 12132 - DNA, 698 bp, Homo sapiens
agatcacacccttgcctattactaaagatgaagggaaggatgtttattcagaagaacagagagcttgcctggaacagagctacttgcttgtatgttgggttctcccatatggagtgagtggacacagaaaaccatgctttctgccttgaccttgtacatatggcttatgtgacctttggcaaatcacttgctttctctgagtctcgttttcctcgtctctaaaaaaaaattaaaattgaatagaggatggtgtgagatttcagcaagattaaaaggtataagaggccagtccactgctgggatatggagtgtggtctgatgatccttttaaagaatggctgcctgggagttggggagtaggcggctgtcatatgaaagaccctgggccaggtgcagtggctcacgcctgtaatcctagcactttgggaggccgaggcagaaggattgcttgagcccaggagtttgagaccagcctgggcaacatggtgaaagcccatctctaccaaaaatacaaaaattagtcattcgtggtggtgcaaacttgtagtcccagctccccagggggctgaggtgggaaaatggtttgagctcaggaggcagaggttgtagtgagccgagatcatgccactgcactccagcctaggcaacagagccagaccttgtctcacaaaaagaaaaaagaaaaaaaaaagacttga

SEQ ID NO: 12133 - DNA, 164 bp, Homo sapiens
gttttaaacagcagtttcttttacttgctgtatacaggttgatggtggaaatcattacatacagatatgtcctgatttgcacagaatggtccattttagacgtgttgtcccagcttaactactaatcacacctccttcacttcaaacgtgtcctggttcagatc

SEQ ID NO: 12134 - DNA, 2142 bp, Homo sapiens
caccgggcgcggcctgctggtgaccccgcgccgcgtcgtgtccgggttgtgtcctgcaggccgaagcggcagccgaagccgtcctcggatgagggttactgggactgtagcgtctgcaccttccggaacagcgccgaggccttcaagtgcatgatgtgcgatgtgcggaagggcacctccacccggtgagtcccgggcctgcccctcgcgccgccggccggcggggtggcgaccagaggacgcccttgcggctgccgccccctcccatgacactggcggacccggcgggaggaggcagacggaggtggctgtggcgataggaactgggtcacattgatcgcaacccaggcgatggtttgcggtgaggggtaattgaagaggctgtaacgttttttgctgccaagagagaataaattatttaagggaggcattagctactgcgatttaattcgtatcgctgggtgtaatgcccctctccccattctgggtataaaaatgttggctgcattgttgtgttagtgtgtggggatcaaggaaaacccataaaatctctttaggagcaaaggatgtaatttaatttcgttcctaaagaaagaaaagtatctgattgcagaatacacaatatattaaaacttatttttctacatgtacttctggaagggtcagatcaaggttttatttagtgtttttattccagtactctaatattttataaataagtagttggagatgagcccagtcacaggaacagatttttactgaaagtacctttatatctttagtttgattaaatggcagtctcttagacaaatgagatgaaaagatctctgcctattttcagactttatttattgtaagcttgcagtataataactctgtcttttaaaaaatgactttgaattaagtgaataaagaaaatcatccaggaaattcagtcagtggcattcttaatctgtcagcacttagttatcgagctccttgattcttatacgaaggtaccctttgaattaaatataatcctgtgatttattacttaatatttagagaagatatgtattttgatattacaaagtccattagaaactaaactataacaataagcatactaatcttactgttgctttaaaaaagaaggcacatgtaatattgacatatacaaatattcagtagacgttagatttctaaaaaatgagatcttgattttttaaaaaacactttacagaattttattaagtttaaaatttagagacaggaatggttgacagtaacttatctgaaaaatttctcagtgaagctcgctggttttgacatgcttgttttttgtaaatcatcatatgctttttgtatattcccacaattgataaaatatttcgtacatttttcatattcaaaaagcaaactttcaaacgtatgctaaatttaagggattacaacagaacattccaaaaagaaaaaaagtatttgctaaaatgattgtggttactatttttggacccgtgatttgtgatttaagtattttgaaaagcagagtatcttcttggctgtgtaaggttggagttggtttagagtatatttgtgtatctgtgttagtactttgtgctttttaaaatgctcaataagcaatttttagaaaattcgttttttggaggcaggaacattaaagtggaaacaattataatcttgatctctggtactatatattattgctttttgttgttccctctctattttcttgtagccattagaaaaatactgaaactagaagagcctatatgtttatttgcagggacagcaaggaaggggggaagctggtgtcctactccacagccagtcttggggttagaggaaccctgagaaatagagtaggtggtggcagctcagaagagaagaaacaggctgaatacctggcacctggaagaagaaggaatatagtacacaggggagttggcccaggacagagaagtgggcctagtttaaaagaggcttgaggcccacatgggggcccctgacattttttttttttaccagtacatctaagctcttgtagatccaatttttagtggtggaaacattacttgaggaggactcagagaagcattgtcatttggattgaaactgaagaggctctgggcaactcaccag

SEQ ID NO: 12135 - DNA, 14550 bp, Homo sapiens
cagtttccttcagaatgctgcaaaactatatgctacagtatattgtattccatttgcagaagaggtaagatattctttaagccttagcaagtgatgcaaaaccaaattagaattagatgactgatgcactaattgcatcaaaacatgtttgtttgttataagaatcattctttttgatacagaatttttattgtatttttacccatactaacataatggaagctaaaagctcattgcagtattgctaagtagaagtcggatttttccttctgaattgaagcagtgaaacagcattatttgttaaaagcagttaaactttgttttaagaatatttataacctgcttagcagcttcagttatcctagttattctaaaaagccacagcaaaccatttcatcgcaattttgaaatactgcgtagagattttctttgttaacatttgtttgttattttgtgataatttatgtgcttttcaggaaatctgaaaatgctcccttatattgacatttcttactttagcatcatactcattctcttaaacatcatcttcattgactaacatctaaagagcctcatacggttttgagaggcatctcttttcttcacaaatgcatattctagctaagtaaattgctgtacttttaggtgggctaaatagagaaacatgaatcagatcccataattaacactggctgttttggattcagataacaatatctgttttagattaatcctttttggaattcatacaaataaactgtaaatatttggtaaaaatagtggcattcagtctgatattctttttgggaaaatcagtggtaatttagtggtgagtgtggtaattgacctcaaaagcactaagtctcagcctttgccaagcaacttctcaatgacaaatgtaaatacaacccatagctttaaattcatataagttcatctttaaccatttaaatatctccctccttcttaaggtatgaattccatttacttattttacttattgagtataacttacttcagggaactttgtaaaacattaaaaacataaaacataaagctaagggaattaaaactgactgatcaagtcactcagttttatatttacaaccagtcctaaaaatgccttttaaaaaatttgcagaaggactaaaatttcaagtttgttgactaataagtacttttttaccccttaccttctcctcccccataacctttatggggggatatttttatagaaataaagataaatgtctcaaatggatgtctacatattcagataatgaaatattcatatattgtaatatgattaaggaccttttgtaggatatttttagctttagaatttagaagaatatgtttgttggtaaaattacttttttaaaaacaggacttatcagcagatgccctcttgaatattctttcagaagtaaagattcaggaattcaagccttccaataaggtatgtttaaaaaatcattcattcagcaaatagtttgggaatttggacttgtaccaagtcccattctaaacctggagaatatcacaatgaatggttcttgctcttgctcttgtcagtgcaacttgagtttgaagtagatttgtcagaatcacaaactgttgattaatactaattttattctagtgtggaattttaaaaaagatcagtatagacttagattgtatgagctactcagttaatatttttttatgcccactatatcattgtgggtattaaaaattagatatattggagttctgtcagtgaacaagatacataaagatcccctgttgttatagagcttacatgcctttgtgagaagatagataataaaatacatacatgaataacataataataccttctgaaggaatgtataaaatacattggaccaatgtattttgggcggagagggactataaacaaaaatgctaataagtacataatattgcagtgtgagtgtaagtgctaagaaggaaaaatacaacagggaaaagaaagagtgatggagctggtataattttatatgggatggaagtgaggaaaacctctgataacagtaacattttagcagaaacctgaaggaagtaaaggaatagtgaaagagcaatgtaggcagcagaaataagtgcagagaaaggccttgaaaagcttttaaggtcaggactcgtctagaagagaatatacaaggggaagagtcttaaatgaggaaattacagagatagttggggctatgataaagaaagaatattttcttagttgaaataagaagctagcttagtagctcagagtgaaggggataagaagataaaggaagtaagagcaaagaaaagaaggtatgaaataattgtccagtgaagtggaagagtcacttaattaaaagatgtagtaaaacgcaagacaatactgaagatccacttaatgttaatctgcttaatgtatcctactaaatgtggctggagaaagggtaatgatcttttctccagccagaatttagctgcttgggtggtattatactgtataatggatggaaaattggatataactagggttgggattttgccaggcaaatacattgaaaaaaaaaaaaaaaagcaatagggagtattggtaaagatggaacatgaaatttaggcaatgtaaataaaaaagtttgaaaacttttttttcttttttacatgttcaatatatgcctttcttgtatgttctctaaaaatcatccacaaaatttagctataccagaaaaggtggagtaatgaccacctccctgcaaaattcaagaaagaagtgacgtgtgcagtctttcgttctgcgtttttattttaggaaaaaaaaaaaagacttgtagggcagttgattttgcccaggtagatggatttgcagaacacaatgtttatgacttatagcctataaagaataaaaatagggtgaggataaacagaaatcccaaagaaggttcccagcccatgtttccaagggcaaaactagagagaagccaaggaaaaatgctttaactttactttccgttattgctcttgcttcggtatgttttctggcttgcattgcttctatctgtgttaaagtctgagggtaataaattctcctgagcaatttaactacagttttaacatgaactgtgggctttttcacaactccctaaaggagctcacaccgaagtttcaggtatggtactgctggttacagatgtcacagccaaaaatatcaactagccattcagacaaacaaaagtttctccttcctggactccttaatatttcttaattttttgtaataatgtttaatttgtaaaacgatgatttgagtgtatttttaaataaatattacttcatgataatgaagctaatttcttggtttgagaatattaatttccgtgccctcagggaatatctaataagtaatttcttaaggttaaattacttgtggtatgtactcccttaatcctaccaaactttctatatgaaagaaggcatattcttaaggaaaaaacttaacagcagtcagtgaatatttaaaggatggccatattatatatcttatggattgctttagtttccttgatgtgaagcagctctgtactagttagagcaaagcaacatgcgtttaaagtagatttgtcagaatcacaaagtgttgattaatactaattttattctagtgtggaatttttaaaaagatcagtatggacttagattgtatgagctactcagtaaatattttttatgcccactgtatcattgtgggtattaaaaattagatatattggagttctgtcagtgaacaagatacataaagatccctgttgttatagagcttacatgcctgtgcgagaagatagataataaaatacatacatgaataacataataataccttctaaaggaacgtataaaatacattggaccaatgattaataatctgatcaaaatatatagagaaaatattttctctttgtaatttgataaaacagttaaatggtaaccaaacagatgcaggaaatgataacattaataaaaatatattcatatattcaaaggttgttcaaacagatgaaactgcaaggaaaccagaccatgttcctattagcagtgaagatgagaggaatgcaattttccaactagaaaaggctattttatctaatgaagccaccaaaagtaagggaaaatctttataaaaatgttttgaactggatgagtttttattttcactaagctctacacctaagaatttgtggaatttaatcacaacaataataatgatgacaatattgattgatttcatgatcatattaaagtcagtgttcatctttaactgtgactaaattcatcatcttccccactattgccctactctcaaagattgaagtctaattctccaaatcacattaactgcattgttgttgtttttctgattgttttagttctttagatggtgagcaggtctaaaaccatgaatgaaaagctctgtttttaaggaattaaaaattcagtttaatggggtccttgtggaaactaatctttggacagacccatttaaatcactttaggataaagaactataaacagaaatattcttaggttcttagtctttagtaattaggttcataattactgacagggaatacagaatgacctatatatacttccttgctagatggacttaaatataaaaatacaggaaaactgaatttttaattccttaaaagcagccatacactcatctgttttgacctgctcaccgtcttttagttttataaatcagtggtttccaaacttttgagattttaagcatggaccagtagaatttcaggaaaaataacccagaataacaataattagaaggatcttgggaaccactgatctacaaagatttcagaaattacttattttaatttgaccaactgaccctgttcttagttaccagagggaaaatgtttcagagtcggatttatggaataaatttttgaactatacctaatgttggcttttttattgtaaaccacttgataggagatgtgcagtacacaactttcttattttgctatttattaaaaagtttttttaaatacagaaacgtctctagtttagtggcattaaaaccatcgtttttttttttttaattaaaaaaaattggctctctttaatcatgggaaaagctgtttttgtggccttcaataacattagttgcctgaatttttcttatgtttctcagtcattaaaaaatataaaaaggaatctttgaaagttagtaaattcacattgctttttacctagtaaaatctttactgcttgctgtggaactttgtttatctggttggtataatcaggtgaccttcagatggcagtgctttcatttgaaaaagatgatgatcataatggacacatagatttcatcacagctgcatcaaatcttcgtgccaaaatgtacagcattgaaccagctgaccgtttcaaaacaaagcgcatagctggtaaaattatacctgctatagcaacaaccactgctacagtttctggcttggtaagtttattattccttgaataaaaatgctcctttttcattgcctcttccctgacttccccgtcataccaacccagtcactcagagatgttagagagggaaggataaatattggatctcataatttaaaatttcaaaatattttctgaaaatgcagtcatctgtattgtgaagtattacataaatatacatttttaaaataaaaaataagctcaagatagattatgatttttcttataggcaataatcttttcactgatctttacgtcattcatacaaagcaggtactctgtttttcttgaataaaatgaacttccctaatctttattcataatgattcagaatctttaagtgcggccctagttattataccatattacatcattactctatgtaattatctatgaagctatgtagttatttacccctgtattaagtgattttagactgttgttattttttgagttacagcatgtgctttcaaaatagggagactgtatggttgaattaatatttttttaaataactgttaacatgtatagagtaggttgaaagtttgaaagtataaaatatactaaaagtatacagacctgtaataagaaatttatattactatagtcccatagctgcttttactatccacagagaaatgcttgaaaacgtgaaagttgaatagatgcaattaaaatcacggatagttttaggctgtttatattatcagatcaccttcttttatctaggttgccttggagatgatcaaagtaactggtggctatccatttgaagcttacaaaaattgttttcttaacttagccattccaattgtagtatttacagagacaactgaagtaaggaaaactaaaatcaggtatgtatgaaagtctatttctcttgtataatgagaatgaaataaaatattttaccttttaaaagggaaaaatactagcttcacctcttttttcttctattgtgtatgtgtaaatttttgccatcacttcaagatcagctcaaacctcatcttcattaaatatttctgactaaagtagccaaagaacccttacagcactttatctgccacattatttggcattatggtttcatctgtgtctgccagatgaattagaaggtaccctggtgtctgactgtaggtcatgagatttagaagaattccacaagcttgagacaaagcagaacaattcctgggcctgtactttttagttttcagattggcaacaaccaaaaacttgaaaaaaaacctaccttaacaagggtgtgagaaagcagacactctcatacattactaatgagagtacaaaatactataatccacagtaagggatatatagcactatatttcagatacatttgcacaagtctcaaactatatatttgcaagataattattctggcattatttatcgtggccaatgattagaataaccgaagtgtccagtaatggggtactggaacatccacacagtgaaacccattttaaaaagagagagacaacactgtcttgctaaaacatactgatttataatacactggaaggatcagcaaggtactgattaaaagtggttatctatatgatgtgatgaagaaataagattatggaatattttagaagatatattatcctttatttccccacattaatttctagcctgatcacaaataatggacttctgaaagtgggttttttttgtgtgtgtgtcatcactaaaaggaagaaaatttcaatgtttctgttctgaatatttttctgtaacagaaatggaatatcatttacaatttgggatcgatggaccgtacatggaaaagaagatttcaccctcttggatttcataaatgcagtcaaagtgagatacttttgttcatttagttcattagtagctttatgtctggtttctgttttgtttttatttataattttattggaagttataattatttaccatgaatttgctttttttactggtcataaaacattgtttacgaacaatgttaaataagcattttatgtttgagcgaggctttcattgtttcttttttggatattcacttttaggagaagtatggaattgagccaacaatggtggtacagggagtcaaaatgctttatgttcctgtaatgcctggtcatgcaaaaagattgaagttaacgtaagtattcaacattatatgcagcgattaacaagaatttaaatgtaagttgatgcacactaaaaaattaaatatagaggttactataattcagataaaagcattagtcttgtctaatgacattaataaagacagtgaatctgccaggtgaaggccaacaggctacctctcgagagattcagctcttcagttaataggtttagaaacctgatttggccagtacacttaagtaaaagtggatccgtctcttatgttgagacacttaatgaccaggcttatgagtaatctaactgccaaatcactatttttgttcatttattcaacaaattattgtttaaggtgccagctgtgtgccaggtactattctagtcattagggagatagcagttagcaaaccaaagttctttcctacttaaggagtttgcataacaataaggcaagtatgttaggtgatagtaagtattatggagaaattaaagaagaataaagagaaaaggaaatatggggagttgggggtgttgagttgctatattatactgagtagtctaggttttccctttgcctatcatagtctcacctgttaaggtggaatttgagcagagactgaaaggaagaaagaaccaaagaaagctaaagtctttatcgtggtctgcaagactctaaatttagattcctagttatccttctaagttccttccttactttcccttcacaatattccagctacactggcctccttatttgtccttgaatactcactctaatcatgctccagcatgggacctttgctttagttgttccctctgcttgtaactctgagacagtgacctggccaagtctcacccctggtctttgcacttcctaaagaggcctcatttaatactgcaacctgtcctcagccccagtctagtatgtctagtcccctttactcttctctactttttctttttttcagagcacttattactgtcctatgactgctgtgctgctgtgtattttgcttatatttattgtttgtttgtttttgagacggagtctcactgtgtcgcctaggctggattgcagtggcgcgatctcagctcactgcaacctctgcctcctgagttcaagcgattctcctgcctcagcctcccgagtatagctgggatgacaggcacccaacaccacacctggctaatttttgtatttttagtagagacggatttcaccatgttggccaggctggtcttgaactcctgacctaaggtgatttctcccgcctcagcctcccaaagtgctgggattacaggcgtgagccactgtgcccggcccatgtactgtatattagctatttacctgctactagaacatatatttcacaagagtgggaatctttatttgatcttgtcactgttgtatctcaagcacttagatcaatacctggcaaataaaaggttaccaacaaatatttgtcagactagtaaatgaatctctgcatgatggttgtgtttaacgtatctattggctttaactatgataatcagttgaggttaatcattcttaaattatgatctagtctgaattatctataccttaaaaagtaaaactactattttattagctaaggcattaatttgccttatattatttttcattaggatccctcagtatcttttggatcaagcaaggctagtgtttagaattcctttattttatgctgcagtggactgtacgtgatcataaagtgtattgactagtggagtttaaaatttgcggcaggttatttaaaaatgcttttaagatttggccaatatttgaaacctccagcatgataatatttttcattttattacattgaccttttagcaagtatttattgagtacctgttaagtactgaacacattaagtcagtcagtgggattatgattaatagcatgaggttggctttagaaagacctgggttcacattcttgctcagctgcttagttttgttaccttgagtagcttttgaaacttagtttcaaaaagctacaaatccacaaatagggatgactgtgcccatagttgagcactgaaataatagtaagggctaatagtgtaatggcatgtaagaagtattccataaatgttagtcctgttaatattttgttatcatacatggtcatcaagccctgccctcaagcagttcacagtctattaaaggaaattgattcctagttatccttctaagttccttccctactttgccctcacaatattccagctacactggcctacttatttgtccttgaatactcactctaatgatgctccattgtaggacctttgctttagttgtttcctctgcttgtaactcttgagacagtgacctggctaggtctcacctctggtcatgttaatcattaaagtataattgaataactgtgataatgaaaatttttacagagtattgtgctaactcagacctctagttcagggtagatttcatttgagctacctttgaagaaggattattccaggcaaaagcaacagtctttgcagctaaaaagagcatacatacaaaagtaaagctactgttatattagctaaggcattaatttgccttatattgattttcattaggatacctaagtatcttggataaattaagagtagtatttagaattcctactaaattctgaatttgggaatttagaattcactttttttttggaatgactcaagtatgaggtgatgatcatgaatggtggaaagaatgaaaagtttatgtacgggacaaaatatctttgtgaaatggaaagagctactgaggattaaatcgatattgttcagagcctggcatgaagtaggtacacagtgtatgataaaattattaggcaggagaatacatcaaatttatattttaagagaattctaggagcagtgtagattggaagtagaaaagagactagagaaagctagctagaagccaatacaatgatgtaaggggtgtgtagatgatgacttcatttaaggcagtagtggctatagcaaagagtgatttttcagtaaataggataaagattggacataagggaaaaagctaagaatgtcttttactttgtatttctagcttacattttaaggtttaaattctagcttgcttttttactgtttacagagaaatgcttgaatttatgatgcctccaaacttaagaggaagtttaggaggaaaatcaattttttaaaatcgttgcaacctctgtctcccaggttcaagcaattctcttgcctcagcctcccgagtagctgggattacgggcatgtgccactgttcccgtctcgtttttgtatttttagcagagatggggtttcgccatgtgggccaggctggtctcaaactcctgacctgaggtgatctgcctgcctcagcctcccaaagtgctgggattacaggcgtgagccaccacgctgagcctttttttgtcttttaataaatggtttgtattctttatcatgaccagtgtgtccaaatttattcactgttaggtaaatgagtgtcttgagtataaatgagttcagaccttttagtaaagaaaaatgaatatgtgaaagcagattattattagatgttaaagtctagatacaagtccaggttctctggatggcattagtcagcaaatcattttttcattttatagaatttaccaaagtattcattcttgcttatttttcttagaatgcataaacttgtaaaacctactactgaaaagaaatatgtggatcttactgtgtcatttgctccagacattgatggagatgaagatttgccgggacctccagtaagatactacttcagtcatgacactgattaatacaagttgtcttaacgttactccaggaccacttgattttggaaagagtgcacttaattcagaagctaaagaaaatcagttcataatactatggatttctctttcattaagccttaattttaagggaaacatcagtaagaaactgcactgaagaattataaaacattttggggcatagcatacacttgtctaacggttcacacgtggctatgatcacaagcaactttgaactggaatgctatttacaaaagttttgtgtattaatctgtgtattaatctctctggataaaaagaaggaaaaaatatgtatgaccagaacagatatggatgaagaaattgaaagcaacgaatgcaactattcaaaaagtttaattttatgaatttcttttttgtttagtcttgaagactgattttctatgcaaatagtgtttggcatcctgcacctctgatatgatttggctttgagaatttaataccactgggaagaagtatggtagtggtggatgaagggtggatattttaaattgtgcagttacagtttactgtcctattacctctgctcgtttaaccagtttgttatatcactgtgtccccaaaatcaggatttttgttgatagcatcagtgttgtaggagcaataggtcagatgagacatattaacttagactaaacgtgaacagtattatatggactctcacaacgctcttagagaatccgtgaatgtgaacagacaaatgtggctaaccatttgattcttcagtatgccttctaatgtggctattttatttatgtgagactctaaacctgattgtcctaatatataaaactaaaagattttgtaaagggagtgtctttagaaatagatgaaatgtagaatgttaaaaattattgctagggtagtcttttttttttccagaaacctaattagggtattaaattttgtgttttttttgttttttttttttaaacagaagcatgttatttcattcccattcccagaaagggagttaatgaagataaaaatttattttttaaggtctttattgagagaaactttgttttctgatatgaactattgcagatgtttttataaatactttcattaaaatgatgtaaacagtagtacccaacactgtaaactcagtgaaaatagtaaatgattcttttattactaagactgtcatgcattctgaagcagttggcttttttttaaccataggaagtaatttccctctagctcctttccttctactctcctgctcagaccattagtaggtactttgttaaataaaaaactagattaacatcaatattactccaatttggtatcttttacactatgtattatacctactttctttttatttcatttacaaatagtttaaattactttatcaaccagctgtattgtttccctcttgtaaaagtaccatcaagtggggaaaatgtatgtggaagtggagagtgaatttgtatgactaaaggataatctgtacatggggaagtgggcaaaagtggataggatgaatttaaagaaaatgactacctttggaaaaaagaaattaaattttgttcacatatcctaccctttcccattgtgcatatcccaagtgtcatatttaaaactaaggttacttaaaacagaatccaggaatatcaaggctctgtggcttggaattttagaggataggactaataaaaggacttttgcaaagaaggcttttttccacgttcactttgttttgtgttctttgaaagtaactgatacttttcgggtagttaattcagcagtccataaatatgatccagtaacttgcttatattttattgaagtctcgacagctcttcagaagtaaatttagaacgatgctgtcagttcatatttatagatattagtgttttagcagataaaacaaaatcaacaaaaattaagttcattttgtgattaaacctgcaaccatttttccattactttttttctatagttaatggttattgccatgatttcttctgtttggttctactaagctagaaagccagggtgaagttaatgataattcccattattttatttctgtaccatgagattgctgttgatgactgaaataccaggtgcaaaaattaatgatttgatttttgtacagtttcaatgagtattttttacttattaaaaataaattaagaaatgtaagaatatctttgtaaatcatgtttcataagttgactccagagattctgattttgctgtttattttgtgagtaatgttgctttggtgtttcctgattttcaagtttgcaatcatggagatacagcagttattaggtgtggaaggacattacctcaaatgtcctcagatggctccaggaaattcttttaaaacagttggagagaaatagtcgtgaccatgtaaaacctagaggatctggtaaatcccatactactggttagggatttgtaaagtccatttctttttagagttcaaagcagttctgttacttgtccataagttcctcataaattgtcccaaaggtaggacatggaaataaatgtatatctttattttttaatctactatgtcacactctggtgatattcatggaacattaaaaaagcaactatgtttattttataattagtaaaatgaagatagaaaattgttcttttgaaatttttagggaaaaaaaaaatctcgtgacctaaatctttccactataatgaatattcattgtgattgcaaatatctaattttatataatcactgtgtatggatttagcgattttacttttcatagattcaaaaacatataatctgaatgctttctctgaaaaaaaaaaaatcagagttgagctcttgaggatcagagttaagtatccattgataatatgtgttcattttgctctatgtcataactttgtttttttattgagaaatatatatttttcaaaaacacatatatattcaaaaatacataaaatataaatatgcagttcaaggaataattttaaagcaactatat

SEQ ID NO: 12136 - DNA, 10478 bp, Homo sapiens
ggtataatcaggtgaccttcagatggcagtgctttcatttgaaaaagatgatgatcataatggacacatagatttcatcacagctgcatcaaatcttcgtgccaaaatgtacagcattgaaccagctgaccgtttcaaaacaaagcgcatagctggtaaaattatacctgctatagcaacaaccactgctacagtttctggcttggtaagtttattattccttgaataaaaatgctcctttttcattgcctcttccctgacttccccgtcataccaacccagtcactcagagatgttagagagggaaggataaatattggatctcataatttaaaatttcaaaatattttctgaaaatgcagtcatctgtattgtgaagtattacataaatatacatttttaaaataaaaaataagctcaagatagattatgatttttcttataggcaataatcttttcactgatctttacgtcattcatacaaagcaggtactctgtttttcttgaataaaatgaacttccctaatctttattcataatgattcagaatctttaagtgcggccctagttattataccatattacatcattactctatgtaattatctatgaagctatgtagttatttacccctgtattaagtgattttagactgttgttattttttgagttacagcatgtgctttcaaaatagggagactgtatggttgaattaatatttttttaaataactgttaacatgtatagagtaggttgaaagtttgaaagtataaaatatactaaaagtatacagacctgtaataagaaatttatattactatagtcccatagctgcttttactatccacagagaaatgcttgaaaacgtgaaagttgaatagatgcaattaaaatcacggatagttttaggctgtttatattatcagatcaccttcttttatctaggttgccttggagatgatcaaagtaactggtggctatccatttgaagcttacaaaaattgttttcttaacttagccattccaattgtagtatttacagagacaactgaagtaaggaaaactaaaatcaggtatgtatgaaagtctatttctcttgtataatgagaatgaaataaaatattttaccttttaaaagggaaaaatactagcttcacctcttttttcttctattgtgtatgtgtaaatttttgccatcacttcaagatcagctcaaacctcatcttcattaaatatttctgactaaagtagccaaagaacccttacagcactttatctgccacattatttggcattatggtttcatctgtgtctgccagatgaattagaaggtaccctggtgtctgactgtaggtcatgagatttagaagaattccacaagcttgagacaaagcagaacaattcctgggcctgtactttttagttttcagattggcaacaaccaaaaacttgaaaaaaaacctaccttaacaagggtgtgagaaagcagacactctcatacattactaatgagagtacaaaatactataatccacagtaagggatatatagcactatatttcagatacatttgcacaagtctcaaactatatatttgcaagataattattctggcattatttatcgtggccaatgattagaataaccgaagtgtccagtaatggggtactggaacatccacacagtgaaacccattttaaaaagagagagacaacactgtcttgctaaaacatactgatttataatacactggaaggatcagcaaggtactgattaaaagtggttatctatatgatgtgatgaagaaataagattatggaatattttagaagatatattatcctttatttccccacattaatttctagcctgatcacaaataatggacttctgaaagtgggttttttttgtgtgtgtgtcatcactaaaaggaagaaaatttcaatgtttctgttctgaatatttttctgtaacagaaatggaatatcatttacaatttgggatcgatggaccgtacatggaaaagaagatttcaccctcttggatttcataaatgcagtcaaagtgagatacttttgttcatttagttcattagtagctttatgtctggtttctgttttgtttttatttataattttattggaagttataattatttaccatgaatttgctttttttactggtcataaaacattgtttacgaacaatgttaaataagcattttatgtttgagcgaggctttcattgtttcttttttggatattcacttttaggagaagtatggaattgagccaacaatggtggtacagggagtcaaaatgctttatgttcctgtaatgcctggtcatgcaaaaagattgaagttaacgtaagtattcaacattatatgcagcgattaacaagaatttaaatgtaagttgatgcacactaaaaaattaaatatagaggttactataattcagataaaagcattagtcttgtctaatgacattaataaagacagtgaatctgccaggtgaaggccaacaggctacctctcgagagattcagctcttcagttaataggtttagaaacctgatttggccagtacacttaagtaaaagtggatccgtctcttatgttgagacacttaatgaccaggcttatgagtaatctaactgccaaatcactatttttgttcatttattcaacaaattattgtttaaggtgccagctgtgtgccaggtactattctagtcattagggagatagcagttagcaaaccaaagttctttcctacttaaggagtttgcataacaataaggcaagtatgttaggtgatagtaagtattatggagaaattaaagaagaataaagagaaaaggaaatatggggagttgggggtgttgagttgctatattatactgagtagtctaggttttccctttgcctatcatagtctcacctgttaaggtggaatttgagcagagactgaaaggaagaaagaaccaaagaaagctaaagtctttatcgtggtctgcaagactctaaatttagattcctagttatccttctaagttccttccttactttcccttcacaatattccagctacactggcctccttatttgtccttgaatactcactctaatcatgctccagcatgggacctttgctttagttgttccctctgcttgtaactctgagacagtgacctggccaagtctcacccctggtctttgcacttcctaaagaggcctcatttaatactgcaacctgtcctcagccccagtctagtatgtctagtcccctttactcttctctactttttctttttttcagagcacttattactgtcctatgactgctgtgctgctgtgtattttgcttatatttattgtttgtttgtttttgagacggagtctcactgtgtcgcctaggctggattgcagtggcgcgatctcagctcactgcaacctctgcctcctgagttcaagcgattctcctgcctcagcctcccgagtatagctgggatgacaggcacccaacaccacacctggctaatttttgtatttttagtagagacggatttcaccatgttggccaggctggtcttgaactcctgacctaaggtgatttctcccgcctcagcctcccaaagtgctgggattacaggcgtgagccactgtgcccggcccatgtactgtatattagctatttacctgctactagaacatatatttcacaagagtgggaatctttatttgatcttgtcactgttgtatctcaagcacttagatcaatacctggcaaataaaaggttaccaacaaatatttgtcagactagtaaatgaatctctgcatgatggttgtgtttaacgtatctattggctttaactatgataatcagttgaggttaatcattcttaaattatgatctagtctgaattatctgtaccttaaaaagtaaaactactattttattagctaaggcattaatttgccttatattatttttcattaggatccctcagtatcttttggatcaagcaaggctagtgtttagaattcctttattttatgctgcagtggactgtacgtgatcataaagtgtattgactagtggagtttaaaatttgcggcaggttatttaaaaatgcttttaagatttggccaatatttgaaacctccagcatgataatatttttcattttattacattgaccttttagcaagtatttattgagtacctgttaagtactgaacacattaagtcagtcagtgggattatgattaatagcatgaggttggctttagaaagacctgggttcacattcttgctcagctgcttagttttgttaccttgagtagcttttgaaacttagtttcaaaaagctacaaatccacaaatagggatgactgtgcccatagttgagcactgaaataatagtaagggctaatagtgtaatggcatgtaagaagtattccataaatgttagtcctgttaatattttgttatcatacatggtcatcaagccctgccctcaagcagttcacagtctattaaaggaaattgattcctagttatccttctaagttccttccctactttgccctcacaatattccagctacactggcctacttatttgtccttgaatactcactctaatgatgctccattgtaggacctttgctttagttgtttcctctgcttgtaactcttgagacagtgacctggctaggtctcacctctggtcatgttaatcattaaagtataattgaataactgtgataatgaaaatttttacagagtattgtgctaactcagacctctagttcagggtagatttcatttgagctacctttgaagaaggattattccaggcaaaagcaacagtctttgcagctaaaaagagcatacatacaaaagtaaagctactgttatattagctaaggcattaatttgccttatattgattttcattaggatacctaagtatcttggataaattaagagtagtatttagaattcctactaaattctgaatttgggaatttagaattcactttttttttggaatgactcaagtatgaggtgatgatcatgaatggtggaaagaatgaaaagtttatgtacgggacaaaatatctttgtgaaatggaaagagctactgaggattaaatcgatatagttcagagcctggcatgaagtaggtacacagtgtatgataaaattattaggcaggagaatacatcaaatttatattttaagagaattctaggagcagtgtagattggaagtagaaaagagactagagaaagctagctagaagccaatacaatgatgtaaggggtgtgtagatgatgacttcatttaaggcagtagtggctatagcaaagagtgatttttcagtaaataggataaagattggacataagggaaaaagctaagaatgtcttttactttgtatttctagcttacattttaaggtttaaattctagcttgcttttttactgtttacagagaaatgcttgaatttatgatgcctccaaacttaagaggaagtttaggaggaaaatcaattttttaaaatcgttgcaacctctgtctcccaggttcaagcaattctcttgcctcagcctcccgagtagctgggattacgggcatgtgccactgttcccgtctcgtttttgtatttttagcagagatggggtttcgccatgtgggccaggctggtctcaaactcctgacctgaggtgatctgcctgcctcagcctcccaaagtgctgggattacaggcgtgagccaccacgctgagcctttttttgtcttttaataaatggtttgtattctttatcatgaccagtgtgtccaaatttattcactgttaggtaaatgagtgtcttgagtataaatgagttcagaccttttagtaaagaaaaatgaatatgtgaaagcagattattattagatgttaaagtctagatacaagtccaggttctctggatggcattagtcagcaaatcattttttcattttatagaatttaccaaagtattcattcttgcttatttttcttagaatgcataaacttgtaaaacctactactgaaaagaaatatgtggatcttactgtgtcatttgctccagacattgatggagatgaagatttgccgggacctccagtaagatactacttcagtcatgacactgattaatacaagttgtcttaacgttactccaggaccacttgattttggaaagagtgcacttaattcagaagctaaagaaaatcagttcataatactatggatttctctttcattaagccttaattttaagggaaacatcagtaagaaactgcactgaagaattataaaacattttggggcatagcatacacttgtctaacggttcacacgtggctatgatcacaagcaactttgaactggaatgctatttacaaaagttttgtgtattaatctgtgtattaatctctctggataaaaagaaggaaaaaatatgtatgaccagaacagatatggatgaagaaattgaaagcaacgaatgcaactattcaaaaagtttaattttatgaatttcttttttgtttagtcttgaagactgattttctatgcaaatagtgtttggcatcctgcacctctgatatgatttggctttgagaatttaataccactgggaagaagtatggtagtggtggatgaagggtggatattttaaattgtgcagttacagtttactgtcctattacctctgctcgtttaaccagtttgttatatcactgtgtccccaaaatcaggatttttgttgatagcatcagtgttgtaggagcaataggtcagatgagacatattaacttagactaaacgtgaacagtattatatggactctcacaacgctcttagagaatccgtgaatgtgaacagacaaatgtggctaaccatttgattcttcagtatgccttctaatgtggctattttatttatgtgagactctaaacctgattgtcctaatatataaaactaaaagattttgtaaagggagtgtctttagaaatagatgaaatgtagaatgttaaaaattattgctagggtagtcttttttttttccagaaacctaattagggtattaaattttgtgttttttttgttttttttttttaaacagaagcatgttatttcattcccattcccagaaagggagttaatgaagataaaaatttattttttaaggtctttattgagagaaactttgttttctgatatgaactattgcagatgtttttataaatactttcattaaaatgatgtaaacagtagtacccaacactgtaaactcagtgaaaatagtaaatgattcttttattactaagactgtcatgcattctgaagcagttggcttttttttaaccataggaagtaatttccctctagctcctttccttctactctcctgctcagaccattagtaggtactttgttaaataaaaaactagattaacatcaatattactccaatttggtatcttttacactatgtattatacctactttctttttatttcatttacaaatagtttaaattactttatcaaccagctgtattgtttccctcttgtaaaagtaccatcaagtggggaaaatgtatgtggaagtggagagtgaatttgtatgactaaaggataatctgtacatggggaagtgggcaaaagtggataggatgaatttaaagaaaatgactacctttggaaaaaagaaattaaattttgttcacatatcctaccctttcccattgtgcatatcccaagtgtcatatttaaaactaaggttacttaaaacagaatccaggaatatcaaggctctgtggcttggaattttagaggataggactaataaaaggacttttgcaaagaaggcttttttccacgttcactttgttttgtgttctttgaaagtaactgatacttttcgggtagttaattcagcagtccataaatatgatccagtaacttgcttatattttattgaagtctcgacagctcttcagaagtaaatttagaacgatgctgtcagttcatatttatagatattagtgttttagcagataaaacaaaatcaacaaaaattaagttcattttgtgattaaacctgcaaccatttttccattactttttttctatagttaatggttattgccatgatttcttctgtttggttctactaagctagaaagccagggtgaagttaatgataattcccattattttatttctgtaccatgagattgctgttgatgactgaaataccaggtgcaaaaattaatgatttgatttttgtacagtttcaatgagtattttttacttattaaaaataaattaagaaatgtaagaatatctttgtaaatcatgtttcataagttgactccagagattctgattttgctgtttattttgtgagtaatgttgctttggtgtttcctgattttcaagtttgcaatcatggagatacagcagttattaggtgtggaaggacattacctcaaatgtcctcagatggctccaggaaattcttttaaaacagttggagagaaatagtcgtgaccatgtaaaacctagaggatctggtaaatcccatactactggttagggatttgtaaagtccatttctttttagagttcaaagcagttctgttacttgtccataagttcctcataaattgtcccaaaggtaggacatggaaataaatgtatatctttattttttaatctactatgtcacactctggtgatattcatggaacattaaaaaagcaactatgtttattttataattagtaaaatgaagatagaaaattgttcttttgaaatttttagggaaaaaaaaaatctcgtgacctaaatctttccactataatgaatattcattgtgattgcaaatatctaattttatataatcactgtgtatggatttagcgattttacttttcatagattcaaaaacatataatctgaatgctttctctgaaaaaaaaaaaatcagagttgagctcttgaggatcagagttaagtatccattgataatatgtgttcattttgctctatgtcataactttgtttttttattgagaaatatatatttttcaaaaacacatatatattcaaaaatacataaaatataaatatgcagttcaaggaataattttaaagcaactatataactagcactcagcttagtagaatatattgacagcagttcagaaattacacatgtagttccttcccagtcacaaccagctccctgccacgtaccctttggtaattaccactatcctaccttgtatgataattgtctctttgtttttatagtgttaccacctatgtgtgtaaacttaaacaatacagtttgcttgtttttgagttttatttaaaatcatacattcttttgtagctgcatttgttcaagatgggattgattcatgttggttgtagctgtactttattcttcattatgtctgtgtaatttacttttctgttaatatgccacaatttatttactgtagacaattgggatgtttttagtttcaggcaattacagtttcacaatgaacatcattttatgtaactcctagtacaaagagtatatatttaggagtagaattttttggtcatagggtattcatatcttaaattttattagatgattacaaatttttttctaagcattagtatgttggttggttttgtgttgctataaaggaatatccaagactcggtaattcataaagaaaaaaggtttatttggctcatggttcagcaggttgtacaaacattgcaccagcatccctgcaatcatggcagaaggcaaaggaggaactggcgtatcacatggctagaggagcaagagagaaatagaggaagtcccagatcatttttaagaatcagatctcacattaactcatggagcaagaactcgtcatctcaacgagggcaccaagccatttatgagggatccagatatccatccccataacccgaacacctcccaccagccctcacctccaacactggggatcacatttcaacatgatatttgcaggggacaaatatccaaaccatatttctccatatcttggtcagtgctggtgttaacagtttttgtttttaattttgccaatctggtggatgtgcaattgtatctcattgaagtgtcactctgcatttctctattacctgtgaagttgagtattttttcataagtttattggccaatttgactttctgtttttgtaaagtatcttgtcaggactgccacacgtttttgttgtgttgctaatctttttcctcattgattcataaaggatctttataaatcttattctttgttggctgtatagttgccaatatcttctcccaatttgtggcttgcctttccctcccttatgatgttctttgataaaaacaatttattaatggtt

SEQ ID NO: 12137 - DNA, 1599 bp, Homo sapiens
agaaaggcaggacaactcaaagcgggggcttccagggtataggttaatttaaaacattttctggttgacaattggtcgagtttatctgaagacctgggatcaataggaaggaaatattcaggttaaataagagattgtggagaacaagttttattgtgcagaggaaactctcagcagacttcaaagagagcaggttgtaaagtgtttcttattggacctaaaaggatgcctgggtcttagttgattatctcctggatttggaaaggaaggaaggacaaaaaaaaaatgggtaaaggggaaaggggattctttatagaatgtagatttttcccacaagggatggctttgcagggccatttcaagatatggcagagaaacatatttcggggtaaaatattttgattttctttcttgttatgccagagtcagattggaaagttaagtcacaatatacagggttaaataaaacccatctgatgagaatttatggtttgtagagcatgactccccagactccttagacaggaatttgggcaagataacaaaatatcagagcttagtccttacatctctttctaaacattttttcccttttttctatccctgtgctagtataccatcatcatcatcattgtagctgatatattcttgatatctggccaaacaaatcctcccaacttattgttcttttagagtatcttggttattctcagccccttgtattttcagttctcatatttctaattgaaagcatgtaaatttgtcactcctgcagtttctaattgtcttgctgaaattttcaatttcttatctgcttcaaaatgaaaagcataattattttctagtctgtctaataattccagaatcaaaacccgcctgtgggtctgtttttattttgtttgttctagtcttcattcttactgtcttgtctccttgtgtgcctggttacctttaattatttaccaatattgtttgaaaaaactagaaataacttgatgctcagaatgatatttttatcctccacagagttttttgcttctggcaggtacctgcattagtaatttaggattattttgatccagtttcagatactgaaattttccaggtcacctaggtgactgaaagctgagccacagactgtggtaatgctcttctgttcatccttatttctagggttcaaccattcagggtttcaaagcatggtttggagttaccaggcccttacctcttcactgaccctggactctttttgaatctttagccccttagctctatctactcaacttcccagtggccttttgcaatctataaatactcctaacacagtggtcccaaatgaatggttcatttttctgaatttctatcttttctcagatattattggcatggtaattattcaccaacttatcagctccctgctgccttcctacatctttgaaaagtatattttatccagcttttctaaatgttttcaagtgagaatgttaatccaaattacttagcccacattatttcctgttgattatgtgtaaaatacagttggtttatttgtattgtttttgtacctggaaacaataaactctgtagtgattctctaaa

SEQ ID NO: 12138 - DNA, 755 bp, Homo sapiens
gtttctgtgtatgctttgtatttttcattgagaactggatcttttgactgtaatgatataactctcaaaattcagattcttttccttcccatggattggcgatgttacttgatgcccctgcaatcatctttttattggtggcttttccaaattattttcacaaaaactatttttcttattatatgtagtcaatgatgactctcttccattacttcacggcgagcagtgctttaacagagatttcctatattatttggatccaatgtaaaatttttttaaaatgtgtttatcttttcataccttcttagactgatattactggtaaagctgcttcagcctgaagtcttgaaacagtggccagtctctgtgccagacacttagcaatcacaagcaattgtcaaaacatacaccgtaatttttgaagtacaatatacctatcatccaccctagcaccagcaagccacactggaattgttggcccccatccacgtggttgttcactatgggactgaagggtagagaatgggggccattatagaaaacagtgaatttcactgtaatgaaccctgactctttcttcataaagctatcatctggagactacaagtgtccaaatagactcgagaattccaaagtagtttctctagatacttcttgtcagttcaataactgttttggtaaaggtactaagttctggagcttctcactttgctatcatctgttatgtcattctaattttctgttttctaaataaa

SEQ ID NO: 12139 - DNA, 755 bp, Homo sapiens; identical to SEQ ID NO: 12138

SEQ ID NO: 12140 - DNA, 1050 bp, Homo sapiens
caaataccatgtggctggtaaaaatgatggtgtaaattatatttacagactgataaacgtaaaaagtatctgggacatagcattattgaaaagaaagcaggctagtgaatactataattattttgtaaaagtctcttatggacataagttatatatttacatggccatattttgcacaggaaatatgaaaaagtatatatatcaaacagtaatggcttatttttatcttctgggagttttgcaggtgcttccctctttacaccattatatgtcatctgaagttttgttctgattctgtattatttcatttctaaaagaaaagccccaaaaccaagtgctgttttcctggtctgtggaaacagagtctccgaggaattaggctagacatggtaagaacaaagttctgttgtgataaaagctttggcctgaggttccaaccattaagtttgccagctcagacttgatcttgaatgaaggcggggttctgtgactggagaccatttctctccttttgtatttgttggtgtgtccaaaaacctcagatctcccagcttcaggcttctttgagggcagtgctaaattggttgaaaccttatttgaggcagttcctgaaaagggtaggtgaaatttcctgctgataaaaggcatcttgtgtcttgttcatccttagcaaattgccaattagcaaagaagagagggcagatgaagtaccagccaatttgaaattggtgtggacttccatcaaggtatattaattcactttacctagatgattcgaaattagttgcttttttcttttaatcctaaaaggataattttcttcatgttcttcttgtcatgtcagccaaatcctatagtgtcaactttcagtaaatgtatcttagatataactatggaccaatctagatctttctctctctatcatctatacagtttagagattttaaaactcttaccacttagtttgaaattttattttaatttataaaatgatatattcttatgtaaaaaattcagacaataaagatgtatttaaagtaaaaggcaaaa

SEQ ID NO: 12141 - DNA, 273 bp, Homo sapiens
gtggcccatgcctgtaaccccagcactttgggaggcctaggtgttggatcatttgaggtcaggagtttgagaccagcctagccaacatggtgaaaccccctctctcctaaaactacaaaaattagccgggcatggtattgcatgcctgtaatcccagctactagagaggctgaggcatgagaatcgcttgaacccgggaggcagaagttgcagtaagctgagagatcgcaccactgcactcccgcctgggtgacagagtgagactctgtctca

SEQ ID NO: 12142 - DNA, 930 bp, Homo sapiens
actcttcatgctttggtagtgcttataagcatcatcactatctagcatgtagactgtacttctttttatttgttgtcactctcccctcttagaatggaagcactgtgaggacagcattttatgtgcatatgtgcgtgtctattttgtgcctggaacacagggggtacttaatacatttttgttgagtgaacaaatgaatatgttgagcctcatcatgactctgagctgaacaagctgagcatcatctgcatcttacagatgaggagactgaggctctgtgagcctataaaatggggagccagatcaaagccaggtctcccaatgtcatgacctttatatttttcccttcaccggtaatacccttagacttggtcagtggagatcctcccttgggcctcaaattttagagcatcccggagtctttctctggctgtaccccttaccattaagtgggatacagtggctgcctggagtttgtcctgcctcttctagatcacgttgcaggtacccaggactctggagttccctgctcagatagtcttgagcctgctgacaagaccaacattgggggtttcttcccaggctgtctctactcaacctgggcctgaaggatgggcacagggtggttgcttatagaatatatgggtagaatttgaacatatgggctgcaaggatccacccacatgtgtacaaggcccctggtgatataagatggagttaggagcagaagagaagtgatacagtaagaagtgtaagaatatgagcacaataactgaaagtaaaatctcaatggatacattaaacattaagttagatgcagcagaaaagagaagcaatgaactacgagatacatctaaagtaattatctagaatgcaacacagagagagtaaggtataaaaaatccaaataagagttcaaaatataaaaaa

SEQ ID NO: 12143 - DNA, 961 bp, Homo sapiens
caacttcttactcccccaacggcttcactttccatactttgtttgttcttattagcatctatcactatctagcatgtagactgtacttctttttattttgtttgtcactctcccctcttagaatggaagcactgtgaggacagcattttatgtgcatatgtgcgtgtctattttgtgcctggaacacagggggtacttaatacatttttgttgagtgaacaaatgaatatgttgagcctcatcatgactctgagctgaacaagctgagcatcatctgcatcttacagatgaggagactgaggctctgtgagcctataaaatggggagccagatcaaagccaggtctcccaatgtcatgacctttatatttttcccttcaccggtaatacccttagacttggtcagtggagatcctcccttgggcctcaaattttagagcatcccggagtctttctctggctgtaccccttaccattaagtgggatacagtggctgcctggagtttgtcctgcctcttctagatcacgttgcaggtacacaggactctggagttccctgctcagatagtcttgagcctgctgacaagaccaacattgggggtttcttcccaggctgtctctactcaacctgggcctgaaggatgggcacagggtggttgcttatagaatatatgggtagaatttgaacatatgggctgcaaggatccacccacatgtgtacaaggcccctggtgatataagatggagttaggagcagaagagaagtgatacagtaagaagtgtaagaatatgagcacaataactgaaagtaaaatctcaatggatacattaaacattaagttagatgcagcagaaaagagaagcaatgaactacgagatacatctaaagtaattatctagaatgcaacacagagagagtaaggtataaaaaatccaaataagagttcaaaaaaaaaaaaaaa

SEQ ID NO: 12144 - DNA, 142 bp, Homo sapiens
agtagctgggactacaggcacgtgccaccacgcccagctgatttttgtatttttagtagagacggggtttcactatgttggcgaggatggtcttgatctcttgacctcgtgatctgcccaccttggcctcccaaagtgctgg

SEQ ID NO: 12145 - DNA, 1267 bp, Homo sapiens
atagatatccttttattattatactttaagttctagggtacatgtgcacaatgtacaggtttgttacatatgtatacatgtgccatgttggtgtgctgcacccattaactagtcatttacattaggtatatctcctaatgctatccctccccctccccgcaccccacaacaggccccggtgtgtgatgttccctttcctgtgtccaagtgttctcattgttcaattctcacctatgagtgagaacatgcggtgtttggttttttgtccttgcgatagtttgctcagaatgatggtttccagcttcatctgtatccctataaagggcatgaactcatccttttttatggctgcatagtattccatggtgtatatgtgccacattttcttaatccagtctatcgttgatggacatttgggttggttccaagtctttgctattgtgaacagtgccacaataaacatacgtgtgcatgtgtctttatagcagcatgatttataatcctttgggtatataccatgtaatggcatggctgggtcaaatggtatttctagttctagatccctgaggaatcaccacactgtcttccacaatggttgaactagtttacagtcccaccaacaatgtaaaagtgttcttatttctctacattctctccagtacctgttgtttcctgactttttaatgatcgccattctaactggtgtgagatggtatctcattgtggttttgatttgcatttctctgatggccagtaatgatgagcattttttcatgtgtcggttggctgcataaatgtcttcttttgagaagtgtctgttcatatcctttgcccactttttgatggggttgtttttttcttgtaaatttgtttaagttctttgtagattctggatattagccctttgtcagatgagtagattgcaaaaattttctcccattctgtaggttgcctgttcactctaatggtagtttcttttgctgtgcagaagctctttagtttaattagatcccatttgtcaattttggcttttgtcgccattgcttttggtgtttcagacatgaagtccttgcccatgcctatatcctgaatggtattgcctaggttttcttctagggtttttatggtttcaggtctaacacttaagtctttaatccatcttgaattaatttttgtataaggtgtaaggaagggatccggtttcagctttctacatatggctagccagttttcccagcaccatttattaaatagggaatccttcacc

SEQ ID NO: 12146 - DNA, 3221 bp, Homo sapiens
tcctcccaaggcagcccggccccgtctctgccctggtggattggtggggagctgcggagggaaacagcagccaggactacttcaaggtcacccccagctcagccgggccctgggccaacagctccctgatcctccaagggggggcttggctccaacctcaggctcacctttgaggcccagaacgtccatggggcccagagctctctgattcctggcggacagtcagggtatagggtggggaggcctgggctcaccaggtcctgcatccagggatgtaggaagggcctggagaaccaagttgcaataagagaggaaggattcggaagtgtggtttagaaggtgaatgggccttatcccacttttccaggcaaatcagggcccatgacgggggtggttctggtggctgttggggaggtggctatgaagatcctgcttctctgcctctgcctcatcctcctcaggtgagccctgccccagggaccaaggggaggggcggagagggcaaaggatacaccgctgaatcccagaatctcaatcctgggggtacttggacagttaaagaggcctgtggccaggcagaggctgagttgatcgtgatgattccacacgggccagtgttgtcagtctccaactctggaccaatgtccaggctggggaggttcctgcttgtatcagggaggtcctgggggctaggcctgctctctctgcctcagtcccctccaaccccttagcagggcacagggaggtgagtctgctgccctcttcacccccatccagccacactcacaggccctggtctcttcacccagagtgaggtcttgcaggaggaaggcagcaagggcagcattgggcatggaggctgcagacgctgtcacggactaatctccaggtgagtgtcgtgggcctcttaccctccaacatcccgctggacacctccccctcgatggccccaaggactgctccactcaacttggccataactgactcatcacctccctttccaagcccacttctcttgttgagagccccatccctctgatgacatggtagccccatctctaacgtcagaacccgggtgtgggtgtccaccttgacctccctccctcctccagatcccaaaaatcactagcacttgtccctcctcctaagtacaggtcaccttggagcccttttctccatcctggccccggtcatgcctgggcctcacctcttccctggtcgctgaacccacctcacctcttgcctccatctctcccaacagactccagactgcttccagatgcctcctcatccagttcctccacagtctgagcggccgtgtttcctctgcaggctttgcatggtctgtcccctgctggactctcctgatccctcctttccctgtcacccaacatctccccaaaccctccgggccaaggactctgcggctcttgacactttgcacgtgtagtttcttctcctgaaacacccttccctcctgccaaaccacgtctggaccctccttcaggttcacttttttttttttttttgagacacagtctcactttgtcacccaggctggagtgcagtggcgcgatctcggctcactgcaacctctgtctcccaggttcaagcgattctcatgtctcagcctcctgagtagctgggattataggcgcccgccaccacgcctggctcatttttgtatttttggtagagacagggtttcaccatgtcggccaggctggtcttgaactcccgacttcaggtgatccgccagcctcggcctcccaaagtggtggggttacatgtgtgagccaccgtgcccagccagctgtgtcttctttttgcaggatttacttacaaaattccttgcagctgcagtctgcgttccacccacatcctaatatggtgtttgcggtggtcacatccaacttccttcctcctccatccatggaacgtgcattagggaggaaccacacgcaccacgtgcaagatgagccagttccctgaacggccggccacggcgttaaccgcgctgctctgggctctgcacgtctcatctgctgaggcgcattactgcatctttcatgcagaacttgctttccatgcctcacatctccacatgtgtggggatatgtcctgagaaatgcacggttaggtgattctgtcgtgtgagcatccttgaatgtgcttacacagtcataaatggtacagcctaccacacgccgaggctatacggtatagcccattgctcctagactatacacctgcacggcatgttcctgtagtgaaagctgtaggcaattataacgcaatggataggttaaagacagagttttagtaaaaatatggcataataggccaggcgtggtggctcatgcctgtaatcccagcactttgggaggccaaggcaggcagatcacaaggtcaggagtttgagaccagcctggccaatatggtgaaacccagtctctactaaaaatacaaaaattagccgggtgtggtggcgggcgcctgtagtcccagctactcgggaggctgaggcagaagaatcatttgaaccaggaggtggaggttgcagtgagccgagatcgcatcactgcactccagcctgggcgacagagcaagactgtctcaaaaactaaaacaaaaaaacaccaccaccaccaccaatgtctgattaaatctaagccacggttccattttggggcaaggggcagggtgtgggtgtggtggacagagaacgggctccagccaccatcagctgcacgtcctggtagcacctgagccattcccagtctcctgtgctgggagatcatcatctaatcctgatgatgacgccctcctctcagagctcgggggatgagctgccaaaacccatggaggttcaaaacccgggctctggagacagaagacactgggctcagagacatggggccactgtccaggctttccctgggcctggacctgggctccttccactgtctgagcagggtcagcctgggctggctgtgctggttcaagagatgagggaggaggacacagcggttgccaggaccctgaggcactggactgggcactgcccaaggggcagaggatggaacccggtgttgatattgtgatgctgacccgtctgctcacctgatttgggtgctgaagggcagctgacccccctaatcttttatagacttgtgaaacgaaaataaataaaagtcaagctgggaacagcttagggcaaa

SEQ ID NO: 12147 - DNA, 3223 bp, Homo sapiens
tcctcccaaggcagcccggccccgtctctgccctggtggattggtggggagctgcggagggaaacagcagccaggactacttcaaggtcacccccagctcagccgggccctgggccaacagctccctgatcctccaagggggggcttggctccaacctcaggctcacctttgaggcccagaacgtccatggggcccagagctctctgattcctggcggacagtcagggtatagggtggggaggcctgggctcaccaggtcctgcatccagggatgtaggaagggcctggagaaccaagttgcaataagagaggaaggattcggaagtgtggtttagaaggtgaatgggccttatcccacttttccaggcaaatcagggcccatgacgggggtggttctggtggctgttggggaggtggctatgaagatcctgcttctctgcctctgcctcatcctcctcaggtgagccctgccccagggaccaaggggaggggcggagagggcaaaggatacaccgctgaatcccagaatctcaatcctgggggtacttggacagttaaagaggcctgtggccaggcagaggctgagttgatcgtgatgattccacacgggccagtgttgtcagtccccaactctggaccaatgtccaggctggggaggttcctgcttgtatcagggaggtcctgggggctaggcctgctctctctgcctcagtcccctccaaccccttagcagggcacagggaggtgagtctgctgccctcttcacccccatccagccacactcacaggccctggtctcttcacccagagtgaggtcttgcaggaggaaggcagcaagggcagcattgggcatggaggctgcagacgctgtcacggactaatctccaggtgagtgtcgtgggcctcttaccctccaacatcccgctggacacctccccctcgatggccccaaggactgctccactcaacttggccataactgactcatcacctccctttccaagcccacttctcttgttgagagccccatccctctgatgacatggtagccccatctctaacgtcagaacccgggtgtgggtgtccaccttgacctccctccctcctccagatcccaaaaatcactagcacttgtccctcctcctaagtacaggtcaccttggagcccttttctccatcctggccccggtcatgcctgggcctcacctcttccctggtcgctgaacccacctcacctcttgcctccatctctcccaacagactccagactgcttccagatgcctcctcatccagttcctccacagtctgagcggccgtgtttcctctgcaggctttgcatggtctgtcccctgctggactctcctgatccctcctttccctgtcacccaacatctccccaaaccctccgggccaaggactctgcggctcttgacactttgcacgtgtagtttcttctcctgaaacacccttccctcctgccaaaccacgtctggaccctccttcaggttcactttttttttttttttttgagacacagtctcactttgtcacccaggctggagtgcagtggcgcgatctcggctcactgcaacctctgtctcccaggttcaagcgattctcatgtctcagcctcctgagtagctgggattataggcgcccgccaccacgcctggctcatttttgtatttttggtagagacagggtttcaccatgtcggccaggctggtcttgaactcccgacttcaggtgatccgccagcctcggcctcccaaagtggtggggttacatgtgtgagccaccgtgcccagccagctgtgtcttctttttgcaggatttacttacaaaattccttgcagctgcagtctgcgttccacccacatcctaatatggtgtttgcggtggtcacatccaacttccttcctcctccatccatggaacgtgcattagggaggaaccacacgcaccacgtgcaagatgagccagttccctgaacggccggccacggcgttaaccgcgctgctctgggctctgcacgtctcatctgctgaggcgcattactgcatctttcatgcagaacttgctttccatgcctcacatctccacatgtgtggggatatgtcctgagaaatgcacggttaggtgattctgtcgtgtgagcatccttgaatgtgcttacacagtcataaatggtacagcctaccacacgccgaggctatacggtatagcccattgctcctagactatacacctgcacggcatgttcctgtagtgaaagctgtaggcaattataacgcaatggataggttaaagacagagttttagtaaaaatatggcataataggccaggcgtggtggctcatgcctgtaatcccagcactttgggaggccaaggcaggcagatcacaaggtcaggagtttgagaccagcctggccaatatggtgaaacccagtctctactaaaaatacaaaaattagccgggtgtggtggcgggcgcctgtagtcccagctactcgggaggctgaggcagaagaatcatttgaaccaggaggtggaggttgcagtgagccgagatcgcatcactgcactccagcctgggcgacagagcaagactgtctcaaaaactaaaacaaaaaaacaccaccaccaccaccaatgtctgattaaatctaagccacggttccattttggggcaaggggcagggtgtgggtgtggtggacagagaacgggctccagccaccatcagctgcacgtcctggtagcacctgagccattcccagtctcctgtgctgggagatcatcatctaatcctgatgatgacgccctcctctcagagctcgggggatgagctgccaaaacccatggaggttcaaaacccgggctctggagacagaagacactgggctcagagacatggggccactgtccaggctttccctgggcctggacctgggctccttccactgtctgagcagggtcagcctgggctggctgtgctggttcaagagatgagggaggaggacacagcggttgccaggaccctgaggcactggactgggcactgccccaaggggcagaggatggaacccggtgttgatattgtgatgctgacccgtctgctcacctgatttgggtgctgaagggcagctgacccccctaatcttttatagacttgtgaaacgaaaataaataaaagtcaagctgggaacagcttagggcaaa

SEQ ID NO: 12148 - DNA, 516 bp, Homo sapiens
ccctgtctccatttcagatcctccagagaacctgagagtgatggtttcccaagcaaacaggacaggtaggaaaggagacagaggagccagggcctctcagtgccaaattgggggcccaggtgtctggagggtccccatgcaggcgggtccctgagccctgagctgcacgtcgattctgcctcttccttccctagtcctggaaaacctgaggaacggcacatccctccggtcctggagggccaaagcctgcgtctggtctgtgtcacacacagcagccccccagccaggctgagctggacccggtgggacagaccgtgggcccctcccagccctcagaccctggggtcctggagctgcctcgggttcaaatggagcacgaaggagagttcacctgccacgctcggcacccgctgggctcccagcgcgtctctctcagcttctccgtgcactgtgagtggggaaaggggacacctgggtcccaggaaggggcccctgctgagtcctgtcctccctccc

SEQ ID NO: 12149 - DNA, 323 bp, Homo sapiens
gctcactgagatagatgcatgtctgatcacctcagttgggaaaggctaatcagaaactccaaagaatgcatctgttcatctctcacccatctgtgacctggaagccccctccccacttcgagtcttcctgcctttgcttcaagttttcccgcctttccaaatggaaccaaagtacttcttacatatagtgactcatgtctcaagtctccctaaaacgtataaaactaagctgtgccccaaccacgctgaccatgtcatcaggacctcctgaggctgtgtcacggcctgtgtcctcaaccttggcaaaataaactttctaaatt

SEQ ID NO: 12150 - DNA, 323 bp, Homo sapiens; identical to SEQ ID NO: 12149

SEQ ID NO: 12151 - DNA, 518 bp, Homo sapiens
ccctgtctccatttcagatcctccagagaacctgagagtgatggtttcccaagcaaacaggacaggtaggaaaggagacagaggagccagggcctctcagtgccaaattgggggcccaggtgtctggagggtccccatgcaggcgggtccctgagccctgagctgcacgtcgattctgcctcttccttccctagtcctggaaaacctgaggaacggcacatccctccgggtcctggagggccaaagcctgcgtctggtctgtgtcacacacagcagccccccagccaggctgagctggacccggtggggacagaccgtgggcccctcccagccctcagaccctggggtcctggagctgcctcgggttcaaatggagcacgaaggagagttcacctgccacgctcggcacccgctgggctcccagcgcgtctctctcagcttctccgtgcactgtgagtggggaaaggggacacctgggtcccaggaaggggcccctgctgagtcctgtcctccctccc

SEQ ID NO: 12152 - DNA, 1363 bp, Homo sapiens
aagtaatattttattgacatataatgcacatacagtaaaatttactacttcacagtataaaattcagtggttttagtatatccacagagttttgcaatcatcacaactatttaattttagatcattttcattgctactcccaaaagaaaccccatatccgttagcagtcattcttcattacccccatcccctagcccctagtaaacactgatgtattttttctgtttctgtggatttgcctgttctgggtatttcctataaaaggaatcatacaatatatctttgtgactggcttcttccacttattgtttttaaggttcatcatcagtacttcattttactgccaaatcacattccagagtatgtatataccatcttttgtttattcatccattgatggacatttgggttgtttccactttttggctattataaaaaatgttgctaggaacattcaaatacaagtttttgtgtgaaaatatattttcatttctcttgggtatatttgtaggagtgaaactgctgggtcatacaataactctatgcttaacattttgaggaactgccaaacagtgttccaaagttactgcaccattttataatcctaccagcattgcatgaggattccaaattctccacattcctgcccccatttgttatggtcgattttgattctagctattctaataagtggtatcttattgtggttttgatttgcacttccttaatgactagtgatactgagcattcattcctatgatggttgcttcctttctatgagttgccttttcattttcttgattgtcttctttgaagcaccaaagactttaattttgatgaagtatgatttatcttttttttgttatgctttggtgtcataatcaagaaagtactgcctgacctaaagtcacaaagatttaccccaacagttttctcctaacagtttcatagttttataggtttagctcccacatttaggttgatgatccattttgagttaattttggctatggtgtgaggttggaatctaacttctgttgtctttatatggataaccagttgtcccaacaccatttgttgaaaagacaatttccctattggattgtgttagactcttgtcaaaaataaatttgccataaatatgaaggtttatttttgaactcccaattctattccattgatattttggtctatccttatgccagtatcatgctgttttattgttaagttttgaggctgggatttgtaagtgctccaactttgttctttttaaagattgttttgattattcttggtcctttgcatttccatatgaattttaggatcatcttgttagtctctgttaaaaaaaaaaaaggaaagg

SEQ ID NO: 12153 - DNA, 1363 bp, Homo sapiens; identical to SEQ ID NO: 12152

SEQ ID NO: 12154 - DNA, 1363 bp, Homo sapiens; identical to SEQ ID NO: 12152

SEQ ID NO: 12155 - DNA, 547 bp, Homo sapiens
ctctatgatgtttgctcaataacaaacttgtccaactacatatttgtcagaatgtatccctgttgttaagcaatgcatgactgtatttatttctagcttaattccatagtgtttagaaaatttactctgagtgatttcagttctcttatatttgagacttgtgttatgaccaggatatggtctgttttaataaatatcttatgtgtccttgagaagggaatgtatattctatgtcattgaatattatgttcccagtatgtcatacacttgtgaagttggctaatcatgttcaagttttcatcattcttactgtcatttttctgcttgtcttattagttactgaggatggtgtgttaatgactcttactgtgattgtggatttgtttactatttcttttagctctttcaattttgttttgtatattttgaagctgtgttattaaacacatgcaagttttgttgtatcttcctgggaaattgaccacttattcattgagaaatgttcatctttttattttaagttccggggtacatgtgcaggatgtgc

SEQ ID NO: 12156 - DNA, 547 bp, Homo sapiens; identical to SEQ ID NO: 12155

SEQ ID NO: 12157 - DNA, 547 bp, Homo sapiens; identical to SEQ ID NO: 12155

SEQ ID NO: 12158 - DNA, 20017 bp, Homo sapiens
caaggtccaggctatcaatcaactaggatctgggcctgaccctcagtcagtgactctctattctggagaagactgtaagtgatgcacctaaaactgctaagcacgtcagtaactgttgctttcaaatatattgtacttcaatcaacaaatatttgtgaacaactactgcatgcaaagaggatgtactagccgtgggagataaaaacaaatataacacatgacttctatcttaggattgattgtaggacagttgatcgtatagagtaccaaggaagtatgttgaaagttttcattttattcagtttcctataaagctctttctacattgaaaattgaagacctggaattatcactgcaatcatttaaagcagcataactgtcataagattttcaagtacatctgccctttgcccttacttgtcaaggatcccctaagagccacttgctctcatgccctgggcttcagtggcatgtctggagctttcctaatactgatgagatatatacccagatttatatgtagaattatatgcacacacaccttctgatgccatagtaactgctgcaaataggttattggaagaagaaaaaaacactgcattctgtattgctaatactgtgaataatattaggggttattctcattgcctttccagcatctaaaggaataatttgatccaaaaatagaaaaggttcagaatgagaaatagccaactcattactcacctgccgtctaaattcttctacccaaataaaagcacacaaaacacatatcacaagtgaattaagatagtattagccttgactgctctgtatttggcttattactctgtagtaagaactcctgtagaacagagataataatatcctcttcacagggttgtatgaaccaatttaggtaagtcccttagaacagtgcctgacacatagcatatgctcaaatgttagctgttattaatatttgattaacaaaattcctgaccaattttatttatattactagtttaattcacttgcttccaaaggcaagatgcccacagaatagtttctggttttatttatccacattgtatctatctggagggctttgtttctcagtgtgatacagtctgtcctcttctttgggaaatctatttgggctgataaacttatctatcatgagaaactcttttggttccatttggagtgaatttcacaaaagtgctttctccagaagaaacattatgaaaatttttgaaaaggatcctaacaatcacatttgcaggttattgaaaactaatcaatcttctatgattaacagatcctgatacagctccagtgatccatggggtggacgttataaacagtacattagttaaagttacctggtcaacagttccaaaggacagagtacatggacgtctgaaaggctatcaggtttttatcatcatggtttttcctcttcttgttgaattggtatctttcctgagaataaagaagaattgatttcagaagaagtcaaagagaatctgcgaccacaatggatatactaaaagattttggttttcattgcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggaggtgagaggataatgatgtagagtcatgtcaaaaatggaggtgatccatggccatattaaacattcttccttatggccaggcacagtggctcatgcctgtaaatcccagcactttgggaggccaaggcagatggatcacttgaagtcaggagttccaaaccagcttggccaacatgatgaaatcctgtctctatcaaaaatacaaaaattagccagatgtagtagtgcatgcctgtagtcccagctactcgggaggctgaggcaggagaatcacttgaacccgggaggcggaggttgcaatgagccaagattgggctactgcattccatctagcctgggccacgtgagactctgtctcaaaaaaataaataaataaacattattccttattagtagttaattaatatttacttcagatgagtttgcttgtcaatttctataaaatttataatataataaggcttttttgaatttttctaattgatgtgagtttatttttggtcttgtgttttctagtacctgaacagccaacttttctaaaggtcatcaaagttgataaagacactgccactttatcttggggactacctaagaaattaaatggaaacttaactggctatcttttgcaatatcagataagtaagtagaaatttgaattggagttaacttgttaatgtttcattttttggttgaatattctctgtgctatgttgggagtctaatgatcacttaaggccatggtttgtaagctgccgttcttccttgtagcccaggggtctgtaaactggcttgcaggccaaattcagcctgctgcctgtttttaggaataaagttttatgacgacatggccatgtccacttatttatatatgtctacagctactttctccctggagtggcaaagttgagtcatctcaatggagactacacagcctacaaaggctaaatgtttaccgtctggccctttaatgaaaggtttgcttacctgttttagaaaaaaagcagtgtgctgatgggtacacaaaacacgtgtttaatgtttatatataagatgtttggagaagtaggaaacatgtgaaagagttattgagtgatgtgatggagattcaaagcataggtaccttccacgctacctcttctgcctcagatatatgctcccagactcaatcctaaatatgcttgtgtttatccaatgtctatgggttgctcactgtttcatggagatgatattgcaaggactaaataattgtctttggatcatgactcagaatgggctctgcccagatgctgctgtgcgactagagtaacgtgaatgtgtttagatgagatcaggtcgtttttaatagcagcgcgttccctctgaaacagtcgtcaagtttaagcatcatctcaaaatggaaattcggggattgacattatagaaaattttatcaacaacccatcatgaaaattttaggctttcaagacatcaattcccaaaacaccagaaatacagagacccagcacacactgcttactagtcaacttgatcatagtcctgttgtgctactttcacatcagctcaagacttccagcaatccaggtcacgtatttgctttagtttctgatggtttctgctgaaattagcacgtatgtttaaatacatacaggcataatcccaacggaagtagactttagcacttttacgtgcttgctaagtagcaggatcaatactaagtgtatctctttgcattgtgccattaaaataagaaatctattagaaatgtactatcactattttatgaatgagggaattgatgtacatcagagtcaagtagtaaaataagtgttaagtgggaggccgaggctggtggatcacgaggtcaggagatcgagaccatcctggctaacacggtgaaaccccgtctctattaaaaatacaaaaaattatccaggcgtggtggtgggcccctgtagtcccagctactcgggcggctgaggcaggagaatggcgtgaacccgggaggcagagcttgcggtgagctgagatggagccactgcactccagcctgggcgacagagccagactccgtctcaaaaaaaaaaaaaaagtgttaagaatgcaaagcaagatcagtccaattctagatgttgagctcttaaccttatattagtcgatgaactggttttcaaaaaaattgtaagaactgcagaaatattttaagattcttttaaatgtcaatttgtttggtaaagatataacttctccttatcctaacaataggaaactcaactaattaaattcccaccttcatattgatccgtatgtgacatttacgtttatttaaaaacaagttcttagaatatagaagttgaaatattaacaattgtaatgattattgaactgcttgatatgtgtattttaaaataaaataatatataattattttgctttctattaatattaattgatcaagacattttaggtagtttacctttttcttattgcttttagatattttaaattgttgcaatttatatgtatgagagctctatgtatactctcctgaattcttatattgattgtagtcgtttttcaattgactttgtggtcattcacaattatgtgttcaaaaaatctaaaaaagtgatgatttcacctccttctttccaatgtttgaatgcctagtttgtttgttttttcttttcattgatttgaattgcatttttatggaccaaggaaggcatttttatgtcaataataaatgcatttttttaacctctatggtatcttggactgggagtcaagaggatttattctacattccttcttgccactaacagctgcactatcttgggtgtatttcatctcttggactattgttacagtaatcttataatactccatactcttacacaaatctcatgtctttgctgggttccaaattctttgaaagaagctgtctatctgattcagctttttacagtgagcactttacatagtacttagtacacagtagatattcttaaatatttaatatattccttcatttattgattctatgtatactgagtagctatttggtgccacatgttaaactagaaaccatagaagacacaaataaattatcatctcaattattcttccaaaaggaaattataatacttaagtcaaagatacaatgaaaatatagcaatggggaaaattcattattattaatgcgtattatgaagctggagcagctggctccaatatagcacagggattaaagacgtttctctggggtcaaaaggccatggtttggattcaaatcccagtctgcaaatttagagacccaagatgggagcaaagggcttattcttgcgagacctcagttttgtcatatatgatatagtcatagtagttgtatgtacctcataggattaaatgagttgatggttatgaatcattaatgtatctttacgtaccacaagcataaggagaaatgaaaataatgaagaatgcaacttgaatggttaaatacatttgagctgttgttcatgtttatttttttagtaaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaagtacatgaggcttctctttttaatagaggctttaaaaagagactgcatctttttaaacagctgcactgaaaggaaagcaccgtgccagtcattgtaaattagaaatgattgtgatcccactctgtctgaccttctgttttccactgacatagaggcagaatttattaatctgtttggaaagttcacactgactcaatttatggatttctgcgcaataccaatcaaattatagcttagtgtatacaaggtcaggaactataattttacttaattaaagtagcaggacataaggtcacaaagctattcaaaaggttagtaaaggtacgtttttcttttagaaatgtttccatacagaaaaatatttggctcttccattggtagacattacagatctaatacatctcactttcatgccttcactctatatacattgattcatatgtcaattttgttttactgtctgatgatggatgccaagcaactgtctgggaaatggcttataaatgtatggtttcacttgtaacacaattatcctaattcaattacacttttctgtttttttctacctttaaccatttcctttcccaaattgcatctccagttatgattttagtgaggttcttgctaagctttctatgatagcaacaggacctttgcagagaaatcaggtcagaggaactgatgtacacacgaagtgaaacagagagagatttatgtagggcttaggctgttcaggcatggaaggatattggagaaagaaaagaaggatgtagaagatggcagaaagggaaatagagttgtttatttatcatgtattaagtgtggtgcaaaagtaattgtggcccttccattaaaagtagtaatggcaaaggccgcacttacttttgcaccaatctaatactatgtgtcagactgtgttctggatgcttttccaagttgtagattagaaaaacggtagaatcaatgaaagaaacatcacagaggggaaaaatagtagagaaaatgcagttgcctattatttattgaagatgtatattaaaatatattcaagcttgtgagtgactgtaaatcaccgtgtttgtgtgtgaatggttatgctctgacctttaatattggtttgtttttacatcttattgtgcctactatatctaactaataacaagcttacgtttttctcagattccttaaacatttaaaagccctttatgtgggaaaattgtataatccaaataattacttccctaaaactcacaaagtattcccagggatgaattgaacaccaagtgaaatgaagaactaatttcactgactttacctactcataaaagttagacttaaagatggggattggaaacttcccagtaactaaaaggttcttatgtctgaagcattggaactgacatcaagtgtccaatacaaagagaagtcagagtggtagtagtccaaacatgcaactgccatatttttaaaaacagaatttaaggcatggagttggttgctattttgatataaccaagaccataatgtgcatgtgaaatgctgatcccattcttaccaattggaagcacatgagaaaaaatattcacagaattgcctgacaagtgttacacattctagtatatatgttgcgaaatttgggcttggttgcattcgtgcttgagaaattgtttttggaggatgaaagtgctgttcatgtgattttacaggtgatgtggcatcttttctttaaactaaaaatgtaactaatgtgctgcatgtcttaaagaacatttcttcactgtcgtatgtgtcaggaatttaaaaatgtttcttactggtgtgtttgtgctctttttcaggaatccacattttcagtattccagctaactgcccccttcccgagttgacactgatttctattctataggcatgtcttgctataagtacagggaaaaaaattacaatctctttttctactagagttcaacatgatctttgaaaaaaatatatatttccaatgaggagagatacatcttgttatcagtcagcactctaaaaatgatcacttgtgcaaataggaacctactgctatgcatctttcttcttgctctgcctatatagctcatttcaaggtcatttggcatttgttcaaaaaataggatttgattgacaagtatttttctctgattgttttcactctgatttccaagtaaatcatattccataatctaagaggggaaaagatggagttaatcagaaatattatttttgtgtcattagcggtttgaataaatcacttgctttactctatttttcaaaagcttgcactacttaatgttatactaatatctctgtttttcaaggtcaaaattaattgcactctgtttcaatgacgcttaatcttgaaggctttgctcatataattggccttatttctctcatggtgtcatttttaataaaacctttttgttatttagtaactatataattaatttttattttatagtgaaaatacataatgaaatattgatctgtaacatatacccacttaaaatagcatttcataaccccttgtagtctcagtaagaaacatattttatatcattgttaacattttctgggttatgtttattatattgagttgattcccagcaaagctgtggatcacatgcaaaaatatttaagatatttggtggtaagacaagaagttaacatatttttgttcaacttgattcattttatcttctactatgagattctactattaacatattgacatattaatattttttgaaaagtattaacttctcacaccactttcaaaatgtcagtaaaaccattccattggtatgtacctgcaagcctgcatttcacgtagtttggacttctataaatttcaaatatttaatatatgaccatattttaatgctatttcatcagtgtttatggagaagaccaaagcaaaaaaaagcaatatatagttagttacgattataaggttatgtgctgtcaattataagtcaaaaggccatattcagtttcgcattaggtttgcgaaaatccaaattgcacaaaattatattgtataatttttttaagtctgtggttttgaaccattcatgtgaccaggcagatttacagtaccatttcatcttaaatggccatgcattgagttcatttcatttactcaatttcattatattaaaaaagaaagttgaaatgttgattttcttgatctcctggtaattcaaaaactatctgagaaaatatggtataagtgactttcttattcacctctaacaacaatatttttttatgtcctgtttttccatgattacaattcacatgatttaactgtgtacatttcttaggtaaaggtatcgggaagatatcaggagtaaatcttactcaaaagactcacccaatagaggtatttgagccgggagctgaacatatagttcgcctaatgactaagaattggggcgataatgatagcatttttcaagatgtaattgagacaagagggagaggtgagaaatgagattatatttggggaagtcttagtcaatctatgtcctgtagaatacttagtgttgcctgtgtcctatattaaacataaaaacactgagtgtattaattatgaaaatcgtaatttcaatttgttttgacatatttttaaattatcaaaatgaaaaatgtttcacagtagtccaccatcctttattttgtttttactagagttgttgcctaaaaatatctcctgctaattaacatatcttaataacacaaactaaaaagaaaaagcaaaacaaaacaaaaaccaccggtctccatggtcatctgcttctaaccaaggcagcttgcgcttttgtttgctccttgctgcttctgagtttaacttcatctgccttcattatccttctttggtttttcatcctcggaatcaaacacaactcgaagaagtccctttttaaataaagaaggaaagatttaccagtattctcccattaacatgtccttcaaattgcattccttctggggtcattaaaaaaactgatactatttggtatgtttaaaaatgatgtctaattttccccaatgttacagaatacaaaagactgtttctagtttacaatgctgtgacttctctttctaccacagaatatgctggtttatatgatgacatctccactcaaggctggtttattggactgatgtgtgcgattgctcttctcacactactattattaactgtttgctttgtgaagaggaatagaggtggaaagtactcaggtaaaattgtttcttaatgtgattttcaacttattaaaaagcattttctgggaagcattcttcagagacaactttttttaaaaatacacattcaagtcaaatttatattagcaagttagatgtacaatgcactgacaggaaaaacgtattgctaaattaaccaaagaaaatatgtatgttctagtttctagcacttaaaatgggctctaactgccgggcgcagtggctcacgcctgtaattccagcagtttgggaggccgaggtgggcggatcatgaggtcaggagatcgagaccatcctggccaacatgatgaaaccccgtctctactaaaaatacaaaaattagccgggcatggtggcagctgcctgtaatcccagctactcggaaggctgagacaggagaatcacttgaacccgggaggtggagtttgcagtgagctgagatcatgccactgtacttcagcttgggcgacaagagcaaaaactccatctcaaaaaaataaaaaataaaaaataggctctaacaaggttgataacacttccaagcttctattgtctatctgtaaaatatcagcgtcgttgagagacatatcactaggtcacatatatgctttagtgttttaagaagtgacccatgtatagcacgcctctctctatgcatgacatacatgactcatatttttcgcactagtgcattctaatattactggctccactggtcaattttgttggtgttaatcattactaggaatgcatttcttattaccatggcatgtagtagacacactgcctcttgaattaatgatacataagatatacatgaaaaccatcatagttggtaatatgacgtttgcctttaatttcattcaactcccgaatttgttttgtctttttcagatatacatattgtatcaagatgatgattattactagtattgcttagtattcatgatgcttttataaagggacaaagatttaggttacactgctatttgtttcatgatgttcagatatatgagaagttcattactggcttatgatttatctagcaaatatttattgggaacccgtcatctacatagaaacattgagagcataatttctaggtttttgtaaaatgacatgcataatttatggagttatgcgtttcacttttttctctgaagactgaatgattatgaattaagttcacaatgactaataaatgttctgagtaattaattggaaacgttaaagagttatagcattctccttatccccaacagataatcatttgtgtattgtggtgctatccagattccaaagatgtttcttcaaatcatgccctaaaaagaaaaaaaaaattagcatttcatattgtagagcaactaagagaatctactaggtctctgcatgtagtcgtaaaatgttccaggaagaacaatttgtatttgagggctttttttttttttttaagtaaagggaacaagagctttttggtcttatattccactaataagagaaatcagccaggcatagtggtggctgcctgaaatcctaactactcgggaggctgaggcaggagaatcccttgaacctgggaggcagaggttgcagtgagccgagatcacgcctctgcactccagcctgggcgacagagtgagactgtctcaaaaaaagtaataataaaataaaatgtcagtggagacctgaatattcagattgttgcaacaattttgagtaagagtgatgtataacaaccaaatgactgcctttttttttttttttttttgagacaaggtcttgttctgttgcccaggctggagtgcagtggttctatctcatctctttgcaacttctgcctcccaggctcaggtgatcctccaacctcagctcctcgtgtagctgggactacaggtgtatgctaccatgcctggctaatttctgtgtttttaatagagacagggtcttgctttgttgcccaggctggtttcaaactcctgatataaagtgttctgcccaccttggcctcccaaagtgccgggattacaggcatgagccaccacatccagccttgattgactttttaaattcaatttagtttaatgacacagatctaataggtgtctatgacatcttcaaaaagttcagatagtaaaataaatatttagtaatttggtcttcactgagaaatcaaactcagttgggctcttccaataagacttctcgttcacataaaattgagtagtcacgtgaaaatatgcaacatgctgcaggtgtgacgacaagtagaaccccccaaaatcccctctcttttttgtttaaacaaagaagcaactgatgggctgtaggtatagccagaaaaaaatattgcctcactggtatcaaaacatttgagcaatgctgttcttactgactattaactattccacagcactggtaaaatgtcttttaaatggtcactgtattacttttcccactttttttctcttttttagttaaagaaaaggaagatttgcatccagacccagaaattcagtcagtaaaagatgaaacctttggtgaatacaggtaaacataaggttctgttgtaaaataaaacacatattcatcatgttgaaagcttaagtgaacaaaaaggtgtttattcttaataaaaaggttacataactacaatgtaatgaccctataaagaatactttgtacaaatagggcccacttaagtgctagcaaccaaatttctgtgtgtgtgatgagggtgtataaataattaccgtctaggcagaaatgtcaggtaggacacttttcttgaagctctgtgcctaacacaaagaatatctatttggggtagctaaaacatctatagcatggccattatgaactcgggttcaatccaatttgcatccacacacgcatatctgtatacctacagcgttgcacctgcaaaggtaagtaagttacaaaccctgtcctctagatgaacctgatcagcagagaaaaatatcctatatatgcaaatgactgtaatgaattaaatagaataaaagagcacaaaagagagtaactgtttctgcccaggtaggattttggaaaaagaatcatccataagagataagctaagccttaaaggataaaaagtattgtgttactgttaaccactggacagaggatgaccaaatgagtgagggtgtgtcgggcaagggaggaatggcaagaagtctactctgagctaggtaggaatctttcggggacgtgttaaactgtctcattctccttttatctttctccaccttcccctttctgctactctctcaacttcttagttcttttttgttgtaatgtcatcatttttctcaggtctcctgtatatttcagccaacagacatattgtaagttccaggtttgtattgattttagcacatgggaaaccagagtttatattaaagaagaaatctgattgatcctgattctctcatctctggattcattactctagcaagggatatggagtattttcattagctaattggtagacatttgggcttacctgtacctccattttgtggtatacttatttttctgtattctacttagtcaataccctttttatatttttatatttcttaataaatgactttaaattctttccagaataaagaacaataaagagaaagaaagaaagagagaaaaagaaaaaggaagaaagaattttggaacttcacgaattgtgatcattactattgtattagttagcagttgcctcataacaataaccaccaatactcaacagcttaaaacaataaacatttattatttcaatgtcctcataattcaggaatccagacatggcttagatgggtacttctggctcaggacctctcatgaggttgcagcaaggttttgaccagggctatggtttcatctaaagtttcagccaaagcacaaatcattcctaggccattcgtgtggctgttggcaggatatagttccatacaggctgttgaactaagggcttctgttcttcacaggccagaggtcattcctaactccataccacgtagatatctccatggggccattcacaacatggcagctggcttccttcagaatgtgtgagccagggagcaagagagagcacccaagttggaagccacagtccttttgtaacctaatattggaagtgatatcccatcacttttgttgtattctataggaacaaatcattaagtttagctcacaactcaaaggaagaggattatacaagatacaaattccatgaggcaatgatcattaaggacctgcaacaacttttcaaaagctgaggcaggagaatttcttgaactcaggaggcggaggttgcagtaagctgagattgtgccactgcactccagcctgggcaacatagcgagactccatctcaacaacaaaacaaaaacacaaacaaacaaacaagcaaaaaaaaattttgaaagacaatattagctcaattttacaggcaagaaaacaaaaacaatgccttgtctaaaaacccatttccccacaccctgctgctcctttataaagatagctaacatcttcctgtgcattatttcctatgacatccctttatagtagctgatgtgttttccaacctctttcccccaaactacatatttatcaggataattgtctactttccacattatcccaggagacacttttataagatgctgtgcccttgcataagtcctcattcttctagcttctgataatcatcccttttgttatttttctttattctttgttcctgattcctcagccgatgcctcattgtttttcttgatttgttcttgtaactgcaatatcctaattcaagagccaattatcgtatcagtcaggggagcctgtgttatgctgctgtcaaaacaactccaaaagcattttctttctcaagttatgtgtcccacagagattgcccttttcatcttaatcacttaggagcactggctggtggacgagcatccaggctccccacagcagggaaaatagaatgtaataaactgagcactggctttaaatctttggctcggaagagacacatgtcacctttgctcactttttttttaaaccaaagaaaattccatggtggcatataacacagagtaggcaaagaagtgccatcctgctttattcctagaaacctgacatacttgatgaacagctctgacaaataccacaaattataaagtgatatgtacatccaaattatattttttccaaatgcttcattgatcaaatttgataaaatcattttatatggtgtatagcttcataatgtaatactaattggtacttaaaaaaatcttgatccaaaatttagaagatcataccatttgataagcatttcactaatggatttgcttctgttcatgaataaaacacctaccataaatatagtatacttatttatgttcttaaaataccagccatttctttctgtcttaaaatgtaacaaacttgaattgttaactatattaaagaaagttatttggtttcaaaaacagaatgtgattgatttttaaaaaagaacattttatcaggatataagagaatcaaaaggatcagaagtaaaggcagaagatcaagacttggaggccaggagctccaaaagttcatgacagcaagggaaattgcatttgttctctgtctgagtccattagggctactataacaaaataccataagctgggtggcttataaaagaacagaaacttaattcccacagttcaggattctgagaagcctaagagcaaagtgccagcattttcaatgtctggtgaacgctcactttctgggtgacagatggcaccttctctttgtgtcctcacatcgtgaaaggggtagggcagctctctggggcctcttctctaagggcactaatatcattcactagggttccacccttatggcctaatcacttcccaaagactccacctctaacaccctcacattggttatcaggttttaacataggaagcttgggaggacacagatattcagaccatagcagccactgtggacatcaacaggttgaatcccacatgtcctacagaagctaagctgctcaattttaaagagaagcacaaatgttgtgaataatgaaaaattgtttggtggaaattgcttatgactttgtagacatgtgtttacagacttcgtaaacttggtaaacatttgtggtagtatcatgtgggctttactatctgtcttcaatgctaacacaaatgtcctgaaaattataaaatcttttatcacttatgactgtgttgctttacatgaatattaatattagattttgttgagctatttttgtttgtttgttttctagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacaagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatataaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttatagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctgctcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacagagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggttccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgatttgtacatgccattgaaaattattaatcagaagaaaattaagcagggtctttgctatacaaaagtgttttccactaattttgcatgcgtatttataagaaaaatgtgaatttggtggttttattctatcggtataaaggcattgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaaa

SEQ ID NO: 12159 - DNA, 3924 bp, Homo sapiens
agtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacgagcatcactttttgtgtctgtttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgagggtccaaagctgaagactttgtataaaggatttgggttttggtcttggattgctttctttcaacaggttcaaaataaaatatcatacaaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggctccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaactatatgattcatatattttatgaatcagaataaccttcaaataaaataaatctaagtcggttaaaatggatttcatgattttccctcagaaaatgagtaacggagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctcacaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttctttgggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaaa

SEQ ID NO: 12160 - DNA, 10383 bp, Homo sapiens
atgacatctccactcaaggctggtttattggactgatgtgtgcgattgctcttctcacactactattattaactgtttgctttgtgaagaggaatagaggtggaaagtactcaggtaaaattgtttcttaatgtgattttcaacttattaaaaagcattttctgggaagcattcttcagagacaactttttttaaaaatacacattcaagtcaaatttatattagcaagttagatgtacaatgcactgacaggaaaaacgtattgctaaattaaccaaagaaaatatgtatgttctagtttctagcacttaaaatgggctctaactgccgggcgcagtggctcacgcctgtaattccagcagtttgggaggccgaggtgggcggatcatgaggtcaggagatcgagaccatcctggccaacatgatgaaaccccgtctctactaaaaatacaaaaattagccgggcatggtggcagctgcctgtaatcccagctactcggaaggctgagacaggagaatcacttgaacccgggaggtggagtttgcagtgagctgagatcatgccactgtacttcagcttgggcgacaagagcaaaaactccatctcaaaaaaataaaaaataaaaaataggctctaacaaggttgataacacttccaagcttctattgtctatctgtaaaatatcagcgtcgttgagagacatatcactaggtcacatatatgctttagtgttttaagaagtgacccatgtatagcacgcctctctctatgcatgacatacatgactcatatttttcgcactagtgcattctaatattactggctccactggtcaattttgttggtgttaatcattactaggaatgcatttcttattaccatggcatgtagtagacacactgcctcttgaattaatgatacataagatatacatgaaaaccatcatagttggtaatatgacgtttgcctttaatttcattcaactcccgaatttgttttgtctttttcagatatacatattgtatcaagatgatgattattactagtattgcttagtattcatgatgcttttataaagggacaaagatttaggttacactgctatttgtttcatgatgttcagatatatgagaagttcattactggcttatgatttatctagcaaatatttattgggaacccgtcatctacatagaaacattgagagcataatttctaggtttttgtaaaatgacatgcataatttatggagttatgcgtttcacttttttctctgaagactgaatgattatgaattaagttcacaatgactaataaatgttctgagtaattaattggaaacgttaaagagttatagcattctccttatccccaacagataatcatttgtgtattgtggtgctatccagattccaaagatgtttcttcaaatcatgccctaaaaagaaaaaaaaaattagcatttcatattgtagagcaactaagagaatctactaggtctctgcatgtagtcgtaaaatgttccaggaagaacaatttgtatttgagggctttttttttttttttaagtaaagggaacaagagctttttggtcttatattccactaataagagaaatcagccaggcatagtggtggctgcctgaaatcctaactactcgggaggctgaggcaggagaatcccttgaacctgggaggcagaggttgcagtgagccgagatcacgcctctgcactccagcctgggcgacagagtgagactgtctcaaaaaaagtaataataaaataaaatgtcagtggagacctgaatattcagattgttgcaacaattttgagtaagagtgatgtataacaaccaaatgactgcctttttttttttttttttttgagacaaggtcttgttctgttgcccaggctggagtgcagtggttctatctcatctctttgcaacttctgcctcccaggctcaggtgatcctccaacctcagctcctcgtgtagctgggactacaggtgtatgctaccatgcctggctaatttctgtgtttttaatagagacagggtcttgctttgttgcccaggctggtttcaaactcctgatataaagtgttctgcccaccttggcctcccaaagtgccgggattacaggcatgagccaccacatccagccttgattgactttttaaattcaatttagtttaatgacacagatctaataggtgtctatgacatcttcaaaaagttcagatagtaaaataaatatttagtaatttggtcttcactgagaaatcaaactcagttgggctcttccaataagacttctcgttcacataaaattgagtagtcacgtgaaaatatgcaacatgctgcaggtgtgacgacaagtagaaccccccaaaatcccctctcttttttgtttaaacaaagaagcaactgatgggctgtaggtatagccagaaaaaaatattgcctcactggtatcaaaacatttgagcaatgctgttcttactgactattaactattccacagcactggtaaaatgtcttttaaatggtcactgtattacttttcccactttttttctcttttttagttaaagaaaaggaagatttgcatccagacccagaaattcagtcagtaaaagatgaaacctttggtgaatacaggtaaacataaggttctgttgtaaaataaaacacatattcatcatgttgaaagcttaagtgaacaaaaaggtgtttattcttaataaaaaggttacataactacaatgtaatgaccctataaagaatactttgtacaaatagggcccacttaagtgctagcaaccaaatttctgtgtgtgtgatgagggtgtataaataattaccgtctaggcagaaatgtcaggtaggacacttttcttgaagctctgtgcctaacacaaagaatatctatttggggtagctaaaacatctatagcatggccattatgaactcgggttcaatccaatttgcatccacacacgcatatctgtatacctacagcgttgcacctgcaaaggtaagtaagttacaaaccctgtcctctagatgaacctgatcagcagagaaaaatatcctatatatgcaaatgactgtaatgaattaaatagaataaaagagcacaaaagagagtaactgtttctgcccaggtaggattttggaaaaagaatcatccataagagataagctaagccttaaaggataaaaagtattgtgttactgttaaccactggacagaggatgaccaaatgagtgagggtgtgtcgggcaagggaggaatggcaagaagtctactctgagctaggtaggaatctttcggggacgtgttaaactgtctcattctccttttatctttctccaccttcccctttctgctactctctcaacttcttagttcttttttgttgtaatgtcatcatttttctcaggtctcctgtatatttcagccaacagacatattgtaagttccaggtttgtattgattttagcacatgggaaaccagagtttatattaaagaagaaatctgattgatcctgattctctcatctctggattcattactctagcaagggatatggagtattttcattagctaattggtagacatttgggcttacctgtacctccattttgtggtatacttatttttctgtattctacttagtcaataccctttttatatttttatatttcttaataaatgactttaaattctttccagaataaagaacaataaagagaaagaaagaaagagagaaaaagaaaaaggaagaaagaattttggaacttcacgaattgtgatcattactattgtattagttagcagttgcctcataacaataaccaccaatactcaacagcttaaaacaataaacatttattatttcaatgtcctcataattcaggaatccagacatggcttagatgggtacttctggctcaggacctctcatgaggttgcagcaaggttttgaccagggctatggtttcatctaaagtttcagccaaagcacaaatcattcctaggccattcgtgtggctgttggcaggatatagttccatacaggctgttgaactaagggcttctgttcttcacaggccagaggtcattcctaactccataccacgtagatatctccatggggccattcacaacatggcagctggcttccttcagaatgtgtgagccagggagcaagagagagcacccaagttggaagccacagtccttttgtaacctaatattggaagtgatatcccatcacttttgttgtattctataggaacaaatcattaagtttagctcacaactcaaaggaagaggattatacaagatacaaattccatgaggcaatgatcattaaggacctgcaacaacttttcaaaagctgaggcaggagaatttcttgaactcaggaggcggaggttgcagtaagctgagattgtgccactgcactccagcctgggcaacatagcgagactccatctcaacaacaaaacaaaaacacaaacaaacaaacaagcaaaaaaaaattttgaaagacaatattagctcaattttacaggcaagaaaacaaaaacaatgccttgtctaaaaacccatttccccacaccctgctgctcctttataaagatagctaacatcttcctgtgcattatttcctatgacatccctttatagtagctgatgtgttttccaacctctttcccccaaactacatatttatcaggataattgtctactttccacattatcccaggagacacttttataagatgctgtgcccttgcataagtcctcattcttctagcttctgataatcatcccttttgttatttttctttattctttgttcctgattcctcagccgatgcctcattgtttttcttgatttgttcttgtaactgcaatatcctaattcaagagccaattatcgtatcagtcaggggagcctgtgttatgctgctgtcaaaacaactccaaaagcattttctttctcaagttatgtgtcccacagagattgcccttttcatcttaatcacttaggagcactggctggtggacgagcatccaggctccccacagcagggaaaatagaatgtaataaactgagcactggctttaaatctttggctcggaagagacacatgtcacctttgctcactttttttttaaaccaaagaaaattccatggtggcatataacacagagtaggcaaagaagtgccatcctgctttattcctagaaacctgacatacttgatgaacagctctgacaaataccacaaattataaagtgatatgtacatccaaattatattttttccaaatgcttcattgatcaaatttgataaaatcattttatatggtgtatagcttcataatgtaatactaattggtacttaaaaaaatcttgatccaaaatttagaagatcataccatttgataagcatttcactaatggatttgcttctgttcatgaataaaacacctaccataaatatagtatacttatttatgttcttaaaataccagccatttctttctgtcttaaaatgtaacaaacttgaattgttaactatattaaagaaagttatttggtttcaaaaacagaatgtgattgatttttaaaaaagaacattttatcaggatataagagaatcaaaaggatcagaagtaaaggcagaagatcaagacttggaggccaggagctccaaaagttcatgacagcaagggaaattgcatttgttctctgtctgagtccattagggctactataacaaaataccataagctgggtggcttataaaagaacagaaacttaattcccacagttcaggattctgagaagcctaagagcaaagtgccagcattttcaatgtctggtgaacgctcactttctgggtgacagatggcaccttctctttgtgtcctcacatcgtgaaaggggtagggcagctctctggggcctcttctctaagggcactaatatcattcactagggttccacccttatggcctaatcacttcccaaagactccacctctaacaccctcacattggttatcaggttttaacataggaagcttgggaggacacagatattcagaccatagcagccactgtggacatcaacaggttgaatcccacatgtcctacagaagctaagctgctcaattttaaagagaagcacaaatgttgtgaataatgaaaaattgtttggtggaaattgcttatgactttgtagacatgtgtttacagacttcgtaaacttggtaaacatttgtggtagtatcatgtgggctttactatctgtcttcaatgctaacacaaatgtcctgaaaattataaaatcttttatcacttatgactgtgttgctttacatgaatattaatattagattttgttgagctatttttgtttgtttgttttctagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacaagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatataaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttatagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctgctcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacagagtccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggttccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgatttgtacatgccattgaaaattattaatcagaagaaaattaagcagggtctttgctatacaaaagtgttttccactaattttgcatgcgtatttataagaaaaatgtgaatttggtggttttattctatcggtataaaggcattgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaatccaaaaa

SEQ ID NO: 12161 - DNA, 11532 bp, Homo sapiens
aggataattattgatggagctaatttgaccatatctaatgtaactttagaggaccaaggtatttactgctgttcagctcatactgctctagacagtgctgccgatataactcaagtaactgttcttggtaagtgcactaactaatgagaaatctgttcatttcttcatttctgattaaatcccatcgttcctggccaataaagctaatgattctttgagcccctgcacatatattgttagtttcaaatttttgtttaaaaagcaacacaacttcaaatcctttctccttttttcatataaaagaaattaattaatgcttaattttttttccctacatgtgttaatttgccaatagcagtgggaggtaagtgatgctatccgcagaaagaaaaataaagcacgcttgagttcctagcactcttgagctactctttcctggtgtacaaagaaatggggctgaggaatggaggtgggctagactggaggatctcgataggggtcaagaggtggatgcacggtggtcatctctaaaccaaaggcacagactgagttcccagggttccaggaaggatggagaggaacttccagcattctacaaaggaatgtctttgatttttgtcgttgttgttgttgatgaaagtactaatcaggaaacagtgtgcacacttcactagtataatcaatgcaattactcctgaaatcaccaatgtttaaagctcttagaccatctgctggatgttttccaaaatttcccttccagattcactctctaccagctctttgacctagaaaggttgcttttaaggacaacatcagcaaaccactttccttccagctattatttggttcagcaagtggagggccgtttggagtgttgtactgattctccctactccatccctgtggactggctgtgtcccactgccaaagtcatggcttctgcagacagggtctcctcacaccattccttctgatgaggctctagcagctgcatcccaccaccaatatttcaagtctctctcacacccaacctactgaacatcctgcccacatctttttaaagacgttttattaaaacattttggaactatcgtaaatttgtgtgagttattcattgattttctgcagggaccctaacagctacagacatttgttctgtttcggtggccaccatgtagtctttcttttagtttgcagacattccttaaaagtgttggttttgcctacccttctttatcatatgtctacattaatcactgttatcaacagacctttgtgtctttagcactccagctgttggggccacctgttaggttccaaacaagggaggtggtggtacagaccaagggagaaagttcagtctcttctgagagactgataaaaaaatgggtcaacaggctggatcccttcaagtaaagcaaatggccaacctgtctcgggcgaaacaaatggccatcaaggttgggttctaaaataaaagaacagtttccacttacagaaggtatggacttgtagagttgtcgagtcggctcagtagaattgtacctttaggcagaatgtttggccattgggtatttgagcattttcaggtctttacaagcagaaaggtttaatcccctaggatgatttcaacaataattcatcagataaagtagtcgagcttcagataaactggaattcatcccaggcctagtgagtagaggggtaagtgtcaggctccgtgcgctttgtccctaagtattttgagcagtctcagccaccaaaaggaccgggtctcctactgcttggtgctccccttctcaatttccttacaaaatttaaaagttcattcttgcgattaggctgccatttttggaactattaatttttttaattctacataaattttacctacgattatatgtactggttatatacgcagtaatctaccagtgtttacagaataaaaataaaaataaattttggagaatattatgtttaaaatttacattcttttattttttagacaaacttctgatttaccaaagcatctctcgacaattgacaataaaaaaataattatatagacacatacgaggtttctaaaagactatgttttaccccctggaaaacaattttttaaagtacatacttgaccccctttaatcaaaagttatttttaaaagccttgacataaacatgctttcaggatatcattttttaaaagtttcagttgcaagttcatcagttctagctccatacgattctcagaagagccagattttaatatcagatgcaatacacagccttagtttattccaggaagcttcagaaatcagtggactcagtaaatactgaagagaaaccaaagtcctctgagctcagagattctgaaacctgttgaagaattaactttttatttatggctttaatgtttggacacagtcatgaaccacattttttaaaaaacatgttctctcttctgaattggaaacgatgctttttgtcaatgtaaatttctaacaattagcaaatattcaggaggagcaatggacggtgctttccacttggagaagaaagagcccattgaaaggctacattagataatatcttccttttctcttctgctaaaagataaaagtcctccaatgcttgagagaattcaaacccaattttcagagtaaataccattagaaataagatttctttttactgttgctttattttcaaagtaccagaaattttcattttctttagtactcaaaaatttgtgatcatttacttacttaattttccagtttctgtcacaacatttaacaatgccaaatctccctgttctgatataaactgccttcctactctttttgagaactccaggttaagacggtatcaaagttgctataatgaaaattcattgttatcaataatgataaaaatccaacacagttgcagaaaagaaagcagagctcatgatctctttttctataaccataagacctaatgtttattgctttaatataataattatacacatgattgaagtaataatatctttttcactgatttatttagttataaaacatttatgtgtgaggcactgtgggcaatgcaaagcttaataaaatatgacccctattcttggagatgaatcaggcatataaacaaatatgtactggacaaacagaaatgattcatttgagatacatcatgtttcccagacttgggtatacctaatccccatccaaggaacttgtttgcaaatgcagattcctgggcccaccttcctcagtaagccagaaatagggcctaggaattttcattgttattaactactcctaaaagaattctgatgtccctggtcaaggataaccccttgagactgtaatcagagaagagggaggtaatatggtccattggggaggacatgtggagatgctgcattttacaaagaaccccagaccccagagcctgatgcgattgaacacagtggagacatgggcccagaaaagaagggtttttatggaaccaaactggggtccaccaacccagtgcagtaagaccaggtatctatactgaggtttgcagtgggagaaaggaagacacttatctgcagggcaccaaacaagaactggtcagctcatgcttaagtcccaacctccccagtggcttgcaggtgaaggtatttaaaagcaggagtaaatttcaggagagcaaatgctataggcaaaatagtaaattagtacattgaggttacacattgctttatgcctaaaagggtgaggtatcttgaactggagttggggcatggcttacaggtcataggtggattcaaagattttctgatttgcaattggttaaggaagagaagctttgtttaaaaattgggagtcagccaaaaagaatattagctctggctcatggatgtggctccctttaggccctcaggaagaaatttacaaaaaatgatggtcagaactcagacttcagtttccccttatctgaggtctccatgccagcaaagttatttggtgagagtctgggttccagaaaaacaacttagagacatatattaagatgttatcttcagtttctataggagaaccaaacatccctgtgattccagcttccttggctattgtttaaagctactattacctccgttcttatcaagttgtttatttacttcttagggctagctaggtgcctgaattacccttgaaactccacctttcccttccatatgtggggtggggggcgggggtgcttcccaggtccctaagagggtggtacctcctctgtctccgggtagctggcaatgtgtctgaggaagggaatcaggtaaacaaaggcaattatctacattttcccttcctttattaattagatgttccggatccaccagaaaaccttcacttgtctgaaagacagaacaggagtgttcggctgacctgggaagctggagctgaccacaacagcaatattagcggtaggaagacttgggataactgttttcattactctagatagtcaaaattaatagcgaagtcactttttaaccactcttactggtttattcttcttataacatccttttgaacttttaatattgagtataaattttggtataacttatccatactccatacattctaatattttttccctgtttatactaccagagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcaggtatgcaggttctcacatcaggtttctaacaaaatatttgtttgtccccatctttgaacatctaaaaaaaaaagattgatagagtaatgtaggattttagatttctccaaatagtgttaacagttctctaaacagcacacaaaatattcaaagcacacaagtttcagaagtgttacatacgagttcgataaaagcaggaaattaggggagtgacatatgaaaaaaaaacattactttcagtaattttgtgatggctaaatatcaagtttaaccagatatcatcaagtaagttctaaattaaaattcaatatgtatgcatctaacattattaatttttatgcattcagtgtcttttcttgtgtctcaacatcaatctaaatttccaagatgcgtttgaaaaaatctcaaggatgactgctaaaatttgtattactgaattgttattgatcatcaatgtggtcatagcatgatattttatttttccttggctaaaataaatactctaggacataatttcctttttggactgagaaaaagcaagtgaaggttataactggatcagatagaaattaacacttgtgtgattttagtgcatgtcaacctttgcactaaactccacatttagctatttctaataaaacgaatccatctaaaaatattcatgactactgtacaggttttattcattttgatgtccttaaaacttggctgctgatattaatacatggtgtttactttattcttctacaggcaaatattcacaacatatgtttctaatgacaattctaatagaaaaaatagagcaggcttaaattaaaatttttttttaaaaaagcaggttcagaattttaaaaagcagttttaaaaattttaaaagcagattcaaaattaagacacatatactaaaccatctactctccactggataataattatttcactccaagaagactgttttactcttttaaataaaatacatatttaaaatctaccttaaatctttttaggaactggaccagatataaattaataagtacaatcaaacttacttaattatctgtgtttttggggggcaggagttgtgatatgatgacttacctatgggttaaaaggaaaaataatgttaatgtttttaatttttcagctccagataggaatccacaaaacataagggttcaagcctctcaacccaaggaaatgattataaagtgggaggtgtgtatttcttaatacgttatgtatttctttgtgcttttctcttcctcttaggtctgcatgctaactacaatgatagcacaacatttttttaagaacaaagataagatttggaaatgaaattaacttgtgagtcatcatcacaaattttaaagatcattgtgattaaaatgatgttatgaaatcgagtttaacactggtcaacaatttagggaagattatacagattgatttagttgtaatacattaccgaagtttcaaattattaataatttaattaacaatattctagattctcttccattcaaaaaatactgaaaatctttaattaatttagtataatctactagatattatgcatatcaaactgatgaacccccataaagtattcactactcattaaacaccagtagacattttgtattctcctttctagtaattctgaggatggtcttgtgaagaaagcatcatgaacgccttattctagatctggagatggcatccaggattatgaatgtcttgcccatcaccacacaaccagaaatccgcaaagctaggatttatgtatgaggatctttggactccaaacctcactttttcctcctttacatatctcggttaaatgttattaaatagacttcaccatttgaattttgcataaaaatgcccatctacccagataattttaattattctagggtcatttccaaattttttctgtaacagtggggcattttattttctctctactacttggatgtatttaatgaccagtatattggcctacctaaaaggaaattatcattcaaccattctgatgagtaataggcctccaacattgaatttataaaattttgtgtaaacatagaacatttttaatgtatgctgaaatatactaatttatttccacaattcattccaggtataatttttgggagaattttagaatgcacaaagtttagtttgctttttatcctcatatgttggtctttgtactcattacacaatcacatggcccatacctgcaaaatatttagtcaatattttttagatcaaaattagatctttatttccacttcagtgaaattaagttttacaagtttaagatgtggaaaactttttttaaaatggtaatacatagaaatgaaatatattcaataatattatttctttccttgaatgtgtggttatagttactactacattgtcttgataattacttaatttatagtctaaaatgatgttagtcttttagggtgtatctgtattatcctcccttaagttccatagaaattttcataaagtagataatatagttggttagatatcagtaatactgtgtatttgccagtcagttcctcagagaagcacatcatgttccagtaacattagctcattaatcctcactactcctttgggagggctgtggtccatgatggtgtcagtcttatatgtcataaagagaaactgggaatctcagagtttaatgacctcacccagatgccatgggctgagtcatatggaaaaaaggccagaaatcttcagtctttttgactgctcctctcactcataagtcattttttattaccccaaagatacacaagattgattattaatgctctcttcttgtaagaatgggactgtactaagaaagcatctatggccaggtgctgtggctcatgcctgtaatcccagcactttgggaggccaaggcgggcagatcacaagatcaggagtttgagaccagcctggacaatatggtgaaactgcatctctactaaaaatataaaaattagccaggtgtggtggcacatacctgtaatccctgctacttgggaggctgaggcagaaaaatatcttgaacccgggaggtggaggttacagtgagttgagatcatgccactacgctccagcctgggtgacagagcgagactctgtctcaaaaaaaaaaaaaaaaaagcatttaaaattggtctttgaggagcaaacgacatgtcatttagtaattaattgactagaggaaggaagtagtcacaggatttggatctaggctgacagttacattcccaatatgtcccatggtgtctcctattatcttgatgtgtcagagatctaatcactactgacacagccagtgaagtttaagaacattcattcactgagtatggttctgtatggatcatcctgcggaaaggagttagactccaggtttttcccagtttcacaatcagatagtattgtgaatgaattaccagaccccctccagagatgtactagaaataattcctatctacatgataatggtcagagggacataatttgaaaaaaaaaaaaaaaaagctgatctttcccaaaagaattaacaatgaagatgagcagtaggaacagactggacatccctaatttttgtttatttgtttatgttttacatttaacattaaacatgattcaatttaaagtaacattacaatttaacttaatggtagaactaggctttttagttagcattaccttcagacattcacttctcatatattaagtcggtcatgactcactcatatattttgagtgttcgaacatcataatgttctacttgcaaaacaggacaaaagagtctactgcaaccttatcagttaaatacctgtatcaggataatttttgcttgagagtttccattgttcttaagcatatgtatgtgaatttttaactttgctcagcaaaataacacatttcaaacttaaaggacaccaaaagcaaaaccaaaagcccaaaaccccactaatgttgggaagcaggaacatctttaattacctggttatataatcgcatccaagatagttaactcctaatggatctaggttttattatttataatacaagtataataagaagacctactggctttaaaatgaaaataagtggaattaaatgaaatattgtataacataatgactatagtagataacaatgtattgtattcttgaaaattgttgagagactaggttttaagtgttctcatcataaaaaataagtatatgaagtaacatatattttgagtagctcaatttagccactccacaatgtatacatatttcaaaacatgttgtacataataagtagatacaatttttgtttctcaagaataaataaaaatgttcaacaattttttaaaaaatggaatcaaggcaggacggcagtctttctgttttctagattaatagttataaccttgcttgggtcatagatctctttgaaactatgttggacgtgcaagctctttttctagaaaattacacacaaaaagtcatactaacaatatcattggtttctcagatcctctaaaggatacacatgtaccccatctagagattcctacaccccacgttaagaacctcttttctaaagactccttcctcgtgggctccttcacgagaggcagagggaagggaaggctggtggcctcttcctgcttactctgccctggctccttttgttctttcttgaagagattatttgggaaatgtctgaggctcagtaggcattgccttcaagtcaaatacaaagcattcaggctgtttatttgggttcccaggtactaaaaaggccgctaatatagctaaaatatttttgtttaaagtgttatggtttattatttatttatttaaaatttgtcagagaactttattaaatttaactcctttctttggagcaaaatgtgtaaaatgaataatattatttgcacacacttattgtcagcagagactgaagaaaactatcattccagattgcagtacggcactacaagcccatggcctaattcactgggacaatgctaaagcccctggtgaatttatatccatttcacactctaaaatatcttggagcaaaactttccaatgaatccaagtattaacaaggtctgcagaaaatctcagaaagttttcattttgttttgattttttttttccctcagttagtttagtttattcaccttggaataggaatacacttaaaattattttgctgatatgtcactaccctttcaacttaattccaagcaatgcctctaataagtgttttagtaaattagattaagttgagaaggattacagattctgtaagaacactatgtatgacattgttgactcactcacatatccagagaaaattactgtttatataagtgaaccttaaatttaggattaaaatcgtattttaaacttattttatataactgattcatttcaatgcacaatcccattatctttgaaagctaaacaggcagtttaaaccacattattgtttttaaattaaagtgttgctcaattaaaaactaaagtggaaataaacaatttcccatactagaaattattcctccaggctgggtgctgtggcccatgcctataatcccagcactctgggaggccgaggcaggcggatcacctgaggttgggagttcaagaccagcctgaccaacatggagaaaccctgtctctactaaaaatacaaaattagccgggcgtggtggtgcatgcctgtaatcccagctactcaggaggctgaggaaagagaatcgcttgcacccgggagatggaggttgccgtgagccgagatcacaccactgcaatccagcctgggcagcaagagtgaaactccgtctcaagaaaaaaaaaaaaaaaaagaaacgaaaaaaaaagttattcctccaaatatttctatggagaaaaataaagtgggtaagggtgacattttttcttaaagaaaaataaagaatggtcaaggagctgggaaattataagaaagaggagctactgtttttttgtattaaaatatgaacattcatattctccaaaaatatttacatgatctctctcttcttatagaagaaaaatggagaaggatagaaccaggtgcaagaaagagttctcttcaaaaagccatgggagaatcccattcacaaccaaagaattcgtggccatattattttttatttcagcctgttctttgaaaatgaaaaggcggaatgtagtggaaagcataagcaaaaagctaaaacactttgtggaatttctttgtaacttccttcgtgtgtaaaaacttaagactttaccatgaggacataatccaggcatctgattgtaggcttctcgttacttggggagttaagggattaattttcatacttaagctcatatgatgacaaaactttttcacaactgtctctaaaccaagaagggggatttaagatctctcaacaaatgaccatttcattacattgttccttattccacttagggtggttcaccatcatctctgagtcaacacatctgtgatcagactaaatgagtcttgccttctgttttagcctttgaaatccatggagcagaatggaccaggcctagagtacagagtgacctggaagccacagggagccccagtggagtgggaagaagaaacagtc

SEQ ID NO: 12162 - DNA, 337 bp, Homo sapiens
ggctcggaagagacacatgtcacctttgctcactttttttttaaaccaaagaaaattccatggtggcatataacacagagtaggcaaagaagtgccatcctgctttattcctagaaacctgacatacttgatgaacagctctgacaaataccacaaattataaagtgatatgtacatccaaattatattttttccaaatgcttcattgatcaaatttgataaaatcattttatatggtgtatagcttcataatgtaatactaattggtacttaaaaaaatcttgatccaaaatttagaagatcataccatttgataagcattttactaatggatttg

SEQ ID NO: 12163 - DNA, 2488 bp, Homo sapiens
tggaaatatgtttgtcacaggtaaaattgtcacttgggtaaattttatctcaagcaactcctttttagttttaatactttctatgttgcccaaatcaagtcttatttccatgaatcactgttttatgtaataattttcttggtgaggtcaatttacatagttttggtactttcatgtcagatttctaaggtagtataatttagtttagaggaagaatttctacacagatcatgcaattgtctcttcattatatatcagggtaaaatctataaaaaacaaaattggtttgagaacaaagctgtcattacttgcaagatgaaaacagaaaaattgcatgtgtttattaaaacacagaagtatattcctgtgcaaattaatgcagattctgaagcgaaagacaggacttttgagagattttgagtccaagggttcacctcttcaaacacaactgaaaaaactctattttttctatttttaaatctaatcagtttatatatgcccaggtccagcaaaaagaagctgggttgataatgtgttttgcagttattcaagctagtttgaaagagtacctggcagtgattgtgaagaccaatgattgtgctactaaggtctctcaattgccagacacccaccaagtattttttaaatatgctattctgttttgaaactcaaaaccttgtatttttgttaatctagttacctgccaaatcaaacaggaatccaaagtttcataaccctgctgtgttctctggttactagaaataagcatatttttgatgttttaacaaccttttaaaataataatttctaataatgaaatagaatatttctattttaagtagctattgggtatatctttacataactagatgattatattaaatgggttttttagatgaatgatgtgcatgggtagatatttttaaaatgaaatatgttttttccttttttacttaaatttctttttagaacatactgttatgaacattaacatttattcaagtccttgggacaattcttcttcagttacccagtaaaattttcatgatctctgcaaaacatagattagaaatataaaataacataaattttagaatacagtgagatgacttacacaatttgataattttttatataatattttatgattaaccagttaactgaaacctaaaaacctgtattaactgattaatattgcagcaaaatgtcagttcatgttattgtatcaatcacttatggatacatgattatgctgttgtgatatgatttctaacaattgtcttgtcatttttagcttttactattataattttaattaaaatatattaaagtcactatgtcataacagactttatattgtgccatgcagtcctattgctcttttgtttcaaatatcatatagtctaaagcaatgattctcattaaatacatgcatcaaaatcaactgcagttattacatgctaactcaaacttacaaaatcaagctctctgtgatcctggttaatacatctaagtacttgagccgataatccaagtactttggggggtcgaggtgagaggatagcatgtggccagaagttcaagaccagcctgggcaacatagcgagactccatctccacaaaaaagtgttaaaaattagccagacatggtggtgcatgtcttagttctaactactcaggaggctgagaaaggaagattactttagcccaggagctcaaaggtgcagtgagctgtgactgcactccagcccgtctaaaaaaaaaaaaaaaaggaaagaaaagaaaaaaagaaataaaaaggtatacacattttttttctgaagtggatggaaatatgtcatgtcagaggtaaattgtgacttgagtaagttttatgttgagcaactctttttgtttacattttctatgttgcccaaataaagtcttattttcataaatcactgctttacataacaacttttcctgcagccctgggtatggtggcacacagttgtagtcccaggtacactggatgctgaggcaaaaggatcatttgaacccagaacttcaaggtcaacctgggcaacatagcaagatcctatctgtagcaaaaatttttttaatgataattctcatgcaaaattcagtttgcactgttttaaaaaatgaaacacttataagagcatggtcataaggcaattctgacttggtgtcaagccatttaaacttagatataacctaggatttaggatccttgctattgtttacatagtaagtccacatttaatatcagtagattattggaaactgcaactatcagcaaaatggtgaacaatgaaacaaattttaccataggccaattgatacaacaagatataagttcctactgcatatttctggtcacaatattatcactgtacttctaaatggagactaaaacacttataacattcaacactgaaataagtgtgaggtatacatacatttttaaaaagattgataaaaacaa

SEQ ID NO: 12164 - DNA, 2153 bp, Homo sapiens
tggaaatatgtttgtcacaggtaaaattgtcacttgggtaaattttatctcaagcaactcctttttagttttaatactttctatgttgcccaaatcaagtcttatttccatgaatcactgttttatgtaataattttcttggtggggtcaatttacatagttttggtactttcatgtcagattgctaaggtagtataatttagtttagaggaagaatttctacacagatcatgtaattgtctcttcatattgtatcagggtaaaatctataaaaaacaaaattggtttgagaacaaagctgtcattacttgcaagatgtaaacagaaaaattacatgtgtttattgaaacacagaagtatattcctgtgcaaattaactcagattctgaagtgaaagacaggacttttgagagattttgagtccaagggttcacctcttcaaacacaactgaaaaaattctaatttttttatttttaaatctaatcagtttatatatgcccaggtccagcaaaaaaagctgggttgatgatgtgttttgcagttattccagctagtttgaaagagtacctggcagtgattgtgaagaccagtgattatgctactaaggtctctcaattgccagatccccaccaagtattttttaaataagctgttgtgttttgaaactcaaaacctcgtatttttgttaatctagttacctgccaaaccaaacaggaatccaaggtttcataaccctgctgtgtcctctggttactagaaataagcaaatttttgatgttttaacaaccttttaaaataataatttctaataatgaaatagaatatttctattttaagtagctattgggtatatctttacataactagatgattatgttaaatgggttttttagatgaatgatgtgcatgggtagatatttttaaaatgaaatatgttttttccttttttacttaaatttctttttagaacatactgttatgaacattaacatttattcaagtccttgggacaattcttcttcagttacccagttaaaattttcatgatctctgcaaaacacagattagaaatataaaataacataaattttagaatacagtgagatgacttacacaacaatttgataatattttatataatattttatgattaaccagttaactgaaacctaaaaacatgtatcaactgattaatattgtagcaaaatgtcagttcatgttattgtatcaatcacttgtggatacatgattatgctgtcgtgatatgatttctaacaattgtcttgtcatttttagcttttaatattataattttaattagaatatatgaaagtcactatatcataacagactttatattgtgccatgcagtcctattgctcttttgtttcaaatatcatatagtctaaagcaatgattctcattaaatacatgcatcaaaatcaactgcagttattacatgctaactcaaacttacaaaatcaagctctctgagatcctggttaatatatctaagtacttgagccaataatccaagtactttggggggccgaggtgggaggatagcatgtggccagaagttcaagaccagcctgggcaacatagtgagactccatctccacaaaaaaatgttaaaaatcatccagacacggtggtgcatgacttaggtcgaactactcaggaggctgagaaaggaagattactttagcccaggagttcaaaggtgcagtgagctgtgactgcactctggcccgtctcaaaaaaaaaaaaaaaaaagggaagaaaagaaaaaaagaaataaaaaggtatacacattttttttttctgaagtggatggaaatatgtcatgtcagaggtaaattgtgacttgagtaagttttatgttgagcaactctttttgtttacattttctatgtggcccaaattaagtcttattttcataaatcactgctttacgtaacaacttttcctgcagccctgggtgtggtggcacacagttgtagtcccaggtacactggacgctgaggcaaaaggatcatttgaacccagaacttcaaggtcaacctgggcaacatagcaagatcctatctgtaacaaaaatttttttaatggtaattctcatgcaaaattcagtttgcacagttttaaaaaa

SEQ ID NO: 12165 - DNA, 337 bp, Homo sapiens
cacattcactcacattgggacacacagtggggaaatgccaattaaccagacatgcacatcttggggatgtgagaggaagcaggagttcctggagaaaacccatgcaggcatggggagaacatgcagaccctacacagatggtagccctgtccaggaatcaatatttattctcatctacattatagcaaaacaacattgaataaaacaactttatttgaggacctgttttacttgtacatctttgggaaaatctttcaacttttattactcataatgttctcaataaaagtgagttaagaatacatattcaggaggttttttgagacaatcaaatgtg

SEQ ID NO: 12166 - DNA, 446 bp, Homo sapiens
acattattagtaaggaacttaataatatcatgaagtatctttaaccaaagtaataattaaaaagtaggagtaaaccatagtaagttcaaatttagaatttgatagataatggagattactttttaggcctaaatattgaaggatagatgtttatgaaactttgaggttcaaattatttgtagaaatgtttatttaatattatattcaagatattaaaatgacaacaatgggaaaatgtataagagatttgttaaacacatcctgaaagcatggaaataaccatatatcttagcctaatgcatgaaatagtatagcaaatataagcaggatgttttcatttttattttaaaattgtgtttgtcactggatagggataataaatttattctatttattttttgctgttaaacatatactttaataaactaaacacatttgtttctgca

SEQ ID NO: 12167 - DNA, 333 bp, Homo sapiens
ataagagcatgctcatgaggcaattctgacatggtgtcaagccatttaaacttagatataacctaggatttaggatccttgctattgtttacatagtaagtccacatttaatgtcagtagattattggaaactgcaactataagcaaaacggtgaacaatgaaacaaatttcaccataggccaattgatacaacaagagttaagttcctactgcgtatttctggtcacaatattatcactgtacttctaaatgaagactaaaacacttataacattcaacattgaaataagtgtgaggtatatatacattttttaaaagagtaataaaaacaa

SEQ ID NO: 12168 - DNA, 447 bp, Homo sapiens
acattattagttaaggaacttaataatatcatgaagtatctttaaccaaagtaataattaaaaagtaggagtaaacaataataagttcaaatttagaatttgatagataatggagattactttttaggcctaaatattgaaggatagatgtttatgaaactttgaggttcaaattatttgtagaaatgtttatttaatattatactcaagatattaaaatgacaacaataggaaaatgtataagagatttgttaaacacatcctgaaagcatggaaataaccatatatcttagcctaatgcatgaaatagtatagcaaatataagcaggatgtttttatttttattttaaaattgtgtttatcactggatagggataataaatttattctatttattttttgctgttaaacatatactttaataaactaaacatatttgtttctgca

SEQ ID NO: 12169 - DNA, 6837 bp, Homo sapiens
cactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaaggtgagtgaggatggcagcacacctggagggagcacacctggagtgaccctttggctcaagcttgggacaaagccaccccttctttgaagtatagcaaagcaaatatcctccaagcctatcttagcaattctgttagcatagcagtgtgccattgccccgcccaggaagtttatggcctccccttttctgggaacacttacaaaccggagaataatttgctgggaaccaagggctgaccttttgaattgtgttttatgtgcagcacctttggtggtaagtccaatggcatgggaatggatagcagatctagtctgccccggacccctggaatcacctcacttcgtaaggtccctgcaaactagagaagggatcagggaggccaaggcttggactcatagggtggtgaaagcagaagtaacctcagaatagggaaaggaatcctgtgaagggaaagtcatttacccaaatccacacagctcagtaacagtcccctgacctcaaaggcatgcttgctttctgctcttccaaattgttacctattcatttgctttagaataagccagtggttttcaaaatttctggtctcagtatccctttatagcttaaaagctattgagcacctaaaagagcttttcttcatatgggttatatctatcaatatttaccatattaaaattaaaactaagaaatttttaaagtattttattcatttaaaaaagcaagtatctatcatgttaagataagtagcatatttttatgaaaaacaactattttcctttttttttttttatttgggatggagtctcgctctgtcacccaggctggagtacagtggggcaatctcggctcactgcaagctccgactcccgggttcacgccattctcctgccttagcctcccaagcagctgggactacaggtgcccaccaccatgcgcagctaattttttgtgtatttagtagagacggggtttcaccacattagccaggatggtcttgatctcctgacctcgtgatccgcccaccttggcctcccaaagtgctgggaatataggcgtgagccactgcgcccagccgaaaagcaactattttcaaacaaaaatataagtgagaagagtcgttttattttttgcagatctctttaatgtctggcttaatagaagacagctggattttcctatctgcttctgcattcaatctgttgcaatatggtgttttggttgaaatataagaagaaaatctggcctaacagatatgtaattggaaaagggaagagtatttttataaccttttcagataattgtggatattcttttttgatactacagcaaaactcagcaagttgtagttttttaaaggtttgtttgtaaagtgaaatctgaaaccttatctatgaaatattcatacttcattccattgaaattcattcatctgtcttgcatttaatgcatgatactaaaatatcacacatcggtcatttagaaaatattggtccactacattatgcaaattctgcaaatagtgatacatttcattatccagtatctaaaaacatattcattaatatcatcaaaatgtgtaagtattaagttctcaagaccatggtggcggatgcaagttttccaaaatcctgatttttacttaaaacttaaattttatcattggcaagaaacactatccattgtgttccttgaattgacaggctcactttgttcattttctaaaagatgtctcaagaaccagtttgtctgtctttgaactaacagtgatattccatgataaaaacattcaactcaaaactcaaaactatcacaagtacctttatttaagacagctgttggccaggcgcggtggctcacgcttgtaatcccagcacttcgggaggccgaggcgggtagatcacctgaggtcaggagttcaagaccagcctggccaccatggtgaaaccccgcctctactaaaaatacaaaaagttagccgggtgtggtagcagacacctgtaatcccagctactcgggaggctgaggctggagaatcacttgaacccgggaggtggaggttgcagtgagcagaggttgctccactgcactccagcctgggcaacaaggagagactccgtctcaaaaaaaaagacagctgtcatactttgcacacagctgaagtactttatgcatactttccattttgtcacatacagtaaggtcaagatttagtaaaataaaaaatatgtattcctttattaaggatggttcttagtgaaactggcttttttaaactgcacgtgcgtgtcagtgaatggctttacagtttggcaccactgccttaatttgtgctaaggctccagcagctcacccactattgcctttgtatcctcagtgcaaaggcaaacacagtggaaaggcaaataatgtcttactataaagagagctttggccttccagatatcctgcaagggtttgtggactaccacactttgagaaccactggactaggatattggttttctagagacagtggaatattttctctggcctcatgaatgccctgctatctccctccttccctcttattccagtaacttttcagagcagtatccctgcactgggtctgtatgtctctctcaccccgaagcagcacttggaccttagggccttcatgaggtctaggggaagcaggcttggccacatatctgatggtgccctttcccctcagctctgaaccatcacattcactcagtgaagacagcctccatcgggactctaggaaggagccggcctcctatgccagtggttgttcccagtgcccctgaagtgcaggagaccacaaggatgttggaagactccgagagtgtaagttcgtggggccatcagtccagccagattgcctgggaacatgccccagggcctgagactgctggtcaagctgataatctgtgcataccaggcccgccacccagaactatgaagcagatacactcattcattcagtagatacagtgttgagcatctcttctgagccgggaactgtgctgaggacttggtgtgctttctttcccatatccactcttttttttttttgagacagaatcttgctctgtctcccaggctggaatacagtggcatgatctcggctcactacaacgtctgcgtcctgggttcaagggattctcctgcctcagcctcctgagtagctggaactacaggcacccatcaccatgcctggctattgttttgtatttttaatagagatggggtttcactatgttggccaggctggtcttgaactccctacctcaggtgatccacctgcctcagcctcccaaagtgctgggataacaggcatgagccaccacgctcggcccccatatccactcttgaacatcttaaattagcttttcacactagcccagctaatggccccttcccccacttcctgcctgccttttagttctgtcccttctgtcattgttcttttcttggtttgaaccatccatacattccctcagttctactctgtgacctttcctgagcaagatgctggaggagaaagtgcctgagtggttgttctcgaaacaaaaatcaccagggtctttctttgatctttcactctcaaactccagtaaaaatgttttgcctctgaatttccaggtacaggattctctaagcggaaagcttggggcccagagatccagggacataccaactgtgctgactggggcagagacctagaaggggcaagcagtgggccttctggcctgtgaagtcattgtgaccctggggagtatgtgttgggagaaaggcattgtgcattatcaggaaacgggatcctagtgaccttgggtctatcctgctactttccactcttctgagccaccctgcgtgttagtagccagttttctggggccatttgactactgaccacatgaggctttggcctctctctgggctctcctttctgagctgctccctggatccagcccagtaacagtgttttcttttccatagagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaa

SEQ ID NO: 12170 - DNA, 6836 bp, Homo sapiens
cactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaaggtgagtgaggatggcagcacacctggagggagcacacctggagtgaccctttggctcaagcttgggacaaagccaccccttctttgaagtatagcaaagcaaatatcctccaagcctatcttagcaattctgttagcgtagcagtgtgccattgccccgcccaggaagtttatggcctccccttttctgggaacacttacaaaccggagaataatttgctgggaaccaagggctgaccttttgaattgtgttttatgtgcagcacctttggtggtaagtccaatggcatgggaatggatagcagatctagtctgcccagacccctggaatcacctcacttcgtaaggtccctgcaaactagagaagggatcagggaggccaaggcttggactcatagggtggtgaaagcagaagtaacctcagaatagggaaaggaatcctgtgaagggaaagtcatttacccaaatccacacagctcagtaacagtcccctgacctcaaaggcatgcttgctttctgctcttccaaattgttacctattcatttgctttagaataagccagtggttttcaaaatttctggtctcagtatccctttatagcttaaaagctattgagcacctaaaagagcttttcttcatatgggttatatctatcaatatttaccatattaaaattaaaactaagaaatttttaaagtattttattcatttaaaaaagcaagtctctatcatgttaagataagtagcatatttttatgaaaaacaactattttcctttttttttttttatttgggatggagtctcgctctgtcacccaggctggagtacagtggggcaatctcggctcactgcaagctccgactcccgggttcacgccattctcctgccttagcctcccaagcagctgggactacaggtgcccaccaccatgcgcagctaattttttgtgtatttagtagagacggggtttcaccacattagccaggatggtcttgatctcctgacctcgtgatccgcccacctcggcctcccaaagtgctgggaatataggcgtgagccactgcgcccagccgaaaagcaactattttcaaaacaaaaatatagtgagaagagtcgttttattttttgcagatctctttaatgtctggcttaatagaagacagctggattttcctatctgcttctgcattcaatctgttgcaatatggtgttttggttgaaatataagaagaaaatctggcctaacagatatgtaattggaaaagggaagagtatttttataaccttttcagataattgtggatattcttttttgatactacagcaaaactcagcaagttgtagttttttaaaggtttgtttgtaaagtgaaatctgaaaccttatctatgaaatattcatacttcattccattgaaattcattcatctgtcttgcatttaatgcatgatactaaaatatcacacatcggtcatttagaaaatattggtccactacattatgcaaattctgcaaatagtgatacatttcattatccagtatctaaaaacatattcattaatatcatcaaaatgtgtaagtattaagttctcaagaccatggtggcggatgcaagttttccaaaatcctgatttttacttaaaacttaaattttatcattggcaagaaacactatccattgtgttccttgaattgacaggctcactttgttcattttctaaaagatgtctcaagaaccagtttgtctgtctttgaactaacagtgatattccatgataaaaacattcaactcaaaactcaaaactatcacaagtacctttatttaagacagctgttggccgggcgcggtggctcacgcttgtaatcccagcacttcgggaggccgaggcgggtagatcacctgaggtcaggagttcaagaccagcctggccaccatggtgaaaccccgcctctactaaaaatacaaaaagttagccgggtgtggtagcagacacctgtaatcccagctactcgggaggctgaggctggagaatcacttgaacccgggaggtggaggttgcagtgagcagaggttgctccactgcactccagcctgggcaacaaggagagactccgtctcaaaaaaaaagacagctgtcatactttgcacacagctgaagtactttatgcatactttccattttgtcacatacagtaaggtcaagatttagtaaaataaaaaatatgtattcctttattaaggatggttcttagtgaaactggcttttttaaactgcacgtgcgtgtcagtgaatggctttacagtttggcaccactgccttaatttgtgctaaggctccagcagctcacccactattgcctttgtatcctcagtgcaaaggcaaacacagtggaaaggcaaataatgtcttactataaagagagctttggccttccagatatcctgcaagggtttgtggactaccacactttgagaaccactggactaggatattggttttctagagacagtggaatattttctctggcctcatgaatgccctgctatctccctccttccctcttattccagtaacttttcagagcagtatccctgcactgggtctgtatgtctctctcaccccgaagcagcacttggaccttagggccttcatgaggtctaggggaggcaggcttggccacatatctgatggtgccctttcccctcagctctgaaccatcacattcactcagtgaagacagcctccatcgggactctaggaaggagccggcctcctatgccagtggttgttcccagtgcccctgaagtgcaggagaccacaaggatgttggaagactccgagagtgtaagttcgtggggccatcagtccagccagattgcctgggaacatgccccagggcctgagactgctggtcaagctgataatctgtgcataccaggcccgccacccagaactatgaagcagatacactcattcattcagtagatacagtgttgagcatctcttctgagccgggaactgtgctgaggacttggtgtgctttctttcccatatccactcttttttttttttgagacagaatcttgctctgtctcccaggctggaatacagtggcatgatctcggctcactacaacgtctgcgtcctgggttcaagggattctcctgcctcagcctcctgagtagctggaactacaggcacccatcaccatgcctggctattgttttgtatttttaatagagatggggtttcactatgttggccaggctggtcttgaactccctacctcaggtgatccacctgcctcagcctcccaaagtgctgggataacaggcgtgagccaccacgctcggcccccatatccactcttgaacatcttaaattagcttttcacactagcccagctaatggccccttcccccacatcctgcctgccttttagttctgtcccttctgtcattgttcttttcttggtttgaaccatccatacattccctcagttctactctgtgacctttcctgagcaagatgctggaggagaaagtgcctgagtggttgttctcgaaacaaaaatcaccagggtctttctttgatctttcactctcaaactccagtaaaaatgttttgcctctgaatttccaggtacaggattctctaagcggaaagcttggggcccagagatccagggacataccaactgtgctgactggggcagagacctagaaggggcaagcagtgggccttctggcctgtgaagtcattgtgaccctggggagtatgtgttgggagaaaggcattgtgcattatcaggaaacgggatcctagtgaccttgggtctatcctgctactttccactcttctgagccaccctgcgtgttagtagccagttttctggggccatttgactactgaccacatgaggctttggcctctctctgggctctcctttctgagctgctccctggatccagcccagtaacagtgttttcttttccatagagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctgtctagttcagtcttcagccagtccagcgctctcttccacacttcagagccccttcagagaaagcattatcaggaatgatacaaggcacagctgcactgccccctgaggcttccacacatctttctgaatattatttgtaaagtcacactggcctggacagcagaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaa

SEQ ID NO: 12171 - DNA, 10445 bp, Homo sapiens
atttgctgtccaaacaggatgctgtggaagctgcactttttttttccccagggagtgggggctggcccttactgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggtaaggcttctaatataacgtgattttctttagttttcaaagcattatgctaactgggactattaactgaatacttgggagaatgtggctctcttgtgggtttgggggttttgaaagaaatccaaagtctttcgagccttgaaaatcaaaagctgttgcctgaggaattaactgaggaaggaatttctaaagatctcaatatttgacaacatccaggcccctgaaccaactcactaggaaggcgagagttggggcatcgtgtgtttttcattctgtgtatgttgtaagtgaacttttcagaaagaggcctcttctgacagtgaatagtgttttacttttgtagccagcgttgtgaataatttcatttcgtcttaggaaataaatgttataaagatatttgtatgtttgtagtaattatgagggcctggcctcaagctcccagatttctctaacaagagaaaatgccgccagagcaaataataaaactggagaaattaagtgtgagatcagtgtgcctcctgggcagcagctctctttgatggtgattaatataatcattttaatcactacacttttcttcttcatttgattaaaatgtaagttttttcatcagcagctatccggctaattgagctttaataatactgtataggaatgaatcctgtatgctctatttgaggggtggtatttgtgcctggtggtgttatatgctttatatccaaagccatattgggacatgcgaaggtttctttttttaaaaaaaatcaaatgtaactccataattgtatataatgcttatgggctcgcaccatagtgtttggactagattgcagagcacattctatgtttttaaagtactacaaagtgagttcacttaacatgagccttatgtgagtaaaatcactattttttaaatgaagtagagatgccatccaaaagctataataactaggtatcagttattagaacaaataagattcttttataagagaaaggcatcatagtaatctagattttaaagataatgtgaattctcttttgttctggtcctaagccctgaacctgtattctaaaaatattcttcaaagtcatctctcccaaattctgaatcataacttcaaaactaaacagtgggtcacagtgcctattgatgaggtcatacaaaattccaaatgtacgaagacacacttttgccagaaacttgcccgtgctcaagagaggtggggaaaaagagtgagaggcggccagatgaactctaccgtccgccagctccgcgttccttcgcacgtgcctctgcgggatccctcgtgggaaagtctcagaaatgtccctaaactgaagaaaagccggggaatgcaaggagagcaaggtcgtaggttgttccgactgctccttaacgacctgcctggcagggaccgactaccctgctcctacccgcagccccatgtggagcaggcatccaccagtgcctccccgcgcttgctagcagtgaacattcctgaagacactctcctctcttatcctgaatcctcgctcccactgcagagacactgcgccttccataggttctccaaggtcctcagtgagctctgtccgcgctgcctaccatccacaccctgcgccatccccttcttcctggccagccccttctgcctttcacacgggctcccacaaactgtcctaagtgtttttgcctggtaaaaagattcacaaaacccggcgactagaagcccatgcagtcttccttggagctttgactgtccaccagttaaactccctctctgaggagttgcagtggcccccagctgcccccaccgacagccacactccaggacccagcctagggggctgtcccctgagcaacctaagcttgtaatcccccacctcgagctttgcattctaagagctcaggacatctcctaattctcactagccctatggcaccagagcgaggtgtgcacagacacgaaagccaggatgcagaaaatggtccatttgcagaacattaatttttaaaccagtatcattttagagagttaaaaagtaacagactgagataaaagcgatcgtggaaatttttaaaaactacttattttaagaaatgcaaaactttctaccaactttgttatttttcaagtcagtatttctttttttcaaattagctgcagttcttttaagccttaaagaaatctttgatatatgcaacactgccctgagctgaacggtggggttggagttggctagccggggaaggctataggacagagaaaaaagggggggtgagtgggggaaggccataggacagagaaacatggggagcaaattaccaaactgtacctccctggaaaatgctcattctactttttaaaaaagtttgttaccgtaagtagtgtctatgtattggcaactgttctgctgattcgatgaatgtaataaatcataccttcttaccttcttgtaaaatcacctgcattgggactaaaggccatagtcccctaagaggggaaaggcttttctctaagaaagaagttaggagttcttgaaaggattgatgatccacttcctcagtaaaaaatgtattgaggaggccaggcacggtggctcatgcctgtaatcccagcactttgggaggccgagggatcacctgaggacaggagcttgagaccagccttgccaacatggcaaagccccgtctctactaaaaatacaaaaattagccaggtgtgctggcaggcacctgtaaccccagctactcgggaggctgaggcaggagaatcacttgaacctgggaggtggaggttgcagtgagccaaaactgcaccactgcactccagcctgggtgacagagcaagactctgtctcgaagaaaaaaaaaaaagtaatgacatcatctagtcaagggtcatatgcaggtaaatttcaactccttttatttttattgttatttttcaggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcaggtgagttgggttcattgctatgcatgcttctccctcctccctccctcccttttgtaaagcagcttatacgttgcttatgttatatgctgaccggaaactctgagacttcaccttgagaaagacaaaattcctactctgaatgttcagcgtctcacttgttttaagaagatatcaaggtgcatttgaaagcaacctcagacattgcccctgaccttcctgggttgataatgatgggggaaagaaagccttccctgttcactggggagcttgcagggtgcagcggggtaggcgtggctatgcaaacaccctaaggtttgcgcagcaggtttccatgaatttgctcaagggttggagctcatgacccactctagactgagcagaccagagtggttccctgctcatgtggtgctgggggtactcagcagagaaacaggagtctgcagaagatgcctgcaaatcagcccaggactgccaggtctggcttgaaaggaaaataggggataaccagactgggcgcagatgctaagaaaccctctggttggcagggttcccagccccagggcacccacggcagggagaggggtagctggggttgggcttgccttttctcctgcccactaccattttgaccctcctctggggaacttaggacaggtgacccaccttcaaggcagctcccagagttccatttgatgtccttaggggctgacagattgtcagggaagaagagaggagcttctagaatgcagccagctcctcagtaaagcaagtccccctcaggctctgagcacccccccaacccgcccccaccacacacacacatacacacataccttgctgggatgggagaggaccctgtccaaaggcctcccccagtgggaggaagctcatctgacaccacgccagagagccaaagtgtcttttcttcctcaaagtgaggacagcgaacttgctgggcccttcaagtataaataaagcatttgggatccccgccccacccctgacctttttgccctgggaggcacaggctgagctttgaccttgggtgcctaggccttcctgtgtgagtacactcctttctgcacgggataagattttatgcaaataattacttagtactcctctgaccttttctgtttgtaaaacaatgcatattcattgtgaaaacttggggagggcaatctggaagtgcagagaaaacctacaccgcgcagcttgagatgtaagagctctatggacagccctctcatcactggtcagcatttctaaaaccaaactaggatcgtaggttattgttccttattcttatttcttaaagtctcctgggaagtggcttttttttttttttctggcatctgatccagagtcccggagagggaggtgcagagctgctgctgggtggggaaccctaggggcaggtggagccctggctccctgtccctgagaagctgtgtcctctcagaactgtggcctaggctttggactttcagagcttgcctctgtggtatgaggagcggggagagactgattccaagagccctcctgacctcaatgacagtgacttaaatttccatatatactaaagtcacctctgctgattttctgtccatctaggtcaagcgtaattatttgcagtccctgtgcctgtgactcccatagccctgggagggggctgtcatcctatctgtgccacaaccagagttcatatgtccttttgccctccccattacagaccatcttacaattggtcctggaatcacacctgtcctgacgcctggacattgacctgcccatctcccggaactggcgttaggtgctgttgcctcactgcagttcttccctggcaacaactgacctgtgcttattttctctcctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggtgagcagggccctcgggtgggagggaggcagggggagacacagctgctgccctgcaccagggagcagtaccaccactacccccgtagctctcctgagcccatgccggcatgttttgtgagcttctctgtattcttctgcgccaccgtcccttgtgctgggagcatgcctgcctcttggcaccacctgcagtgttagagagactgcggctgatcgtggggaccctgcatcacgcccctccaccccccgcagtgtcccaggaatccattcctgtgtccactgagcacagcctgcgtgggaggcctgagccccggccccaggttctgtcgctccggatagggatgagtgattggactttggaaagggaaaatcgatgccccctttaagaaatgttatttttaatcaaaataaattctccctttcctgtgattctcacctggccttcttaaaggaaaagggaaggagaaccataggccatggtgagggaagggccgcggtcgggctgccctaccccagggcctgtgggctggtcccctacagagcttgctaaagaaagaggaagttcccgtcctctggagggacaaaagtgtgagcactgcggggagggggtaggttcctcaggctctttgtccaaaatgtgggccttaactggtggaattgtgagcagtagatgagatcatcgagtgaaaggcacttccatcagcacctggctcacagtcagtgttcaatgcaggatttttgaaaaccataaaatgttggtggttcctgtcctgtcctctagggtttgggtgaggaggcaggtgtgagggagagtcttggggtgaagaggtttgagccttctcctgctctgtccgtggagcaagtcaaataaatgctgagaccgtcagctcctcatttctccttgaccagcaatctgatgttcccttgggttgagggttttgttttcttggtccatcagcagtttcatattgaaaagattacatttctgaaaacattgtccaaacggaaattccctctgtgggataaagcaagactcacattacttactgctaattgtggcgtgaaggtcaagatcagaaatggccattttgaggaagcgtgtgctccccccacagcagctcctggcccgggggcatgagcatggctgagggtgtggagtcttcccctaggttaggaatgggagaaaacagggtctccacttgcaaagaggtgtccacagttccagaggcaaatgctgttaataaaaattctgcatactccagaatataccacttccttcaccgagggcttattggagaaggctttttaggaaatagacgtaataaaatcagtttgtccttggttcacttaacagtgagcttgagtgagatttcatatttcacctgtgcttttcaaccaacaggattgcggagattttgcaaattatggtcctaaaccctgagctttctggattttcgatgattagtaggtagataagagacttgcaaagaggtagatttgtaagaggctcttaaccagcattttcagcaatccatctgacctcccatgcctgaattctctctctcagagagctgagctcctttgcctttttcagtgcagttataataacattccagtcccacatgtgatagagaaaagatcaccaccttccttatcagtaaaagtaccttccaggtttagaggagtaaccagtgtggctggaggtaggaagctctcctgggccgctcttgtcgggcggaaatcacacagtggttggtgcggtgcctcctcgcttacccgaactgcaaagaaatcccaagcacaggccgggcgcggtggctcatgcctgtaatcccagcactttggaaggctgaggcaggcggatcacgaggtcaggagatcaagaccatcctggccaacatggtgaaacctcgtctctactaaaaatacaaaaattagctgagtatgatggcatgcgcctgtagtcccagctacttgggaggctgaggcaggagaatcacttgaacctgggaggcggaggttgcactgagccgagatcttgtcactgcattccagcctgggcaacaggcaagactctgtctcaaaaaaaaaaaaaaaaaaaagaaagaaagaaagaaaaagaaaaaagaaaagaaaagaaatcccaagcacaaagccctggaagaaaactgaccatgaggccacaccctgtgggtggagcaggttgaagcaaacctcctgcccctatttcagatccctgcccagcagggcaccaataacgatgcagtctccattcttaaacatctttctaggtgacatgggctggacaagcatgtggtgagccgggttctcattgcctcgggcactcactcatgctgttagctccatgaagtcaatacctttaccgtctcctttactgaggagggaactgaggtgcacagggaagcagaataaagtgcccatgagccctgggtactaaggagccaggctcagagctgccttcatgagcaccagagatgcacactcttcccgtggccagagcggcaccccagcgggaggccccagtcccttcattctacattgccgggtttttcagttgcagaaagctctccccacccttgctggaccagagtggcctgaacttggccaacctggtagaactcaggctgacatagaacagcaggacactcctggtcccggggattagaagttgttctaaggaaaagatgcccaggtcaaaaacgtttccagagcacctggctccgtgcagccacccctgcgtctgctgcagggcctcctgtggcgcccttcctgggcgtgcactgcgaccctcaaataggagctgcatgagggaggcccagggttctgtttccaaatacgtttcttcatccatctttttcctgaaccgaagtttctcacattcacacttgaggaaatgctgacagaaagggagttctctgggtagtttagatatctggtggacatgtgaagtataactagaaaaatgcattccttctatacttctcatgtgcctggactcccagaatgtttgactaaaaacagagtcatgcacaatggaaatctctctttttctgaatgagctagcaaagaaatacaaacccaaaatatgtctggctgtgtctctcagcccaatcgaatggtcacgagcagctggcccagcagagccctgaatgctcttttatgtttgccttttgactcccaaggacttgtctgagtgaccctgcgattattttccctccttaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaa

SEQ ID NO: 12172 - DNA, 10503 bp, Homo sapiens
aggacttgactcaggaatttgctgtccaaacaggatgctgtggaagctgcactttttttttccccagggagtgggggctggcccttactgctttataagcaccagctcaagaaggaacctacagcctcttggaaaggaatctcactaggggcttgactgcgtgggtctgtagcgctttcactgtaagaaagcaagatgcattttagaaactttaactacagttttagctccctgattgcctgtgtggcaaacagtgatatcttcagcgaaagtgaaaccagggtaaggcttctaatataacgtgattttctttagttttcaaagcattatgctaactgggactattaactgaatacttgggagaatgtggctctcttgtgggtttgggggttttgaaagaaatccaaagtctttcgagccttgaaaatcaaaagctgttgcctgaggaattaactgaggaaggaatttctaaagatctcaatatttgacaacatccaggcccctgaaccaactcactaggaaggcgagagttggggcatcgtgtgtttttcattctgtgtatgttgtaagtgaacttttcagaaagaggcctcttctgacagtgaatagtgttttacttttgtagccagcgttgtgaataatttcatttcgtcttaggaaataaatgttataaagatatttgtatgtttgtagtaattatgagggcctggcctcaagctcccagatttctctaacaagagaaaatgccgccagagcaaataataaaactggagaaattaagtgtgagatcagtgtgcctcctgggcagcagctctctttgatggtgattaatataatcattttaatcactacacttttcttcttcatttgattaaaatgtaagttttttcatcagcagctatccggctaattgagctttaataatactgtataggaatgaatcctgtatgctctatttgaggggtggtatttgtgcctggtggtgttatatgctttatatccaaagccatattgggacatgcgaaggtttctttttttaaaaaaaatcaaatgtaactccataattgtatataatgcttatgggctcgcaccatagtgtttggactagattgcagagcacattctatgtttttaaagtactacaaagtgagttcacttaacatgagccttatgtgagtaaaatcactattttttaaatgaagtagagatgccatccaaaagctataataactaggtatcagttattagaacaaataagattcttttataagagaaaggcatcatagtaatctagattttaaagataatgtgaattctcttttgttctggtcctaagccctgaacctgtattctaaaaatattcttcaaagtcatctctcccaaattctgaatcataacttcaaaactaaacagtgggtcacagtgcctattgatgaggtcatacaaaattccaaatgtacgaagacacacttttgccagaaacttgcccgtgctcaagagaggtggggaaaaagagtgagaggcggccagatgaactctaccgtccgccagctccgcgttccttcgcacgtgcctctgcgggatccctcgtgggaaagtctcagaaatgtccctaaactgaagaaaagccggggaatgcaaggagagcaaggtcgtaggttgttccgactgctccttaacgacctgcctggcagggaccgactaccctgctcctacccgcagccccatgtggagcaggcatccaccagtgcctccccgcgcttgctagcagtgaacattcctgaagacactctcctctcttatcctgaatcctcgctcccactgcagagacactgcgccttccataggttctccaaggtcctcagtgagctctgtccgcgctgcctaccatccacaccctgcgccatccccttcttcctggccagccccttctgcctttcacacgggctcccacaaactgtcctaagtgtttttgcctggtaaaaagattcacaaaacccggcgactagaagcccatgcagtcttccttggagctttgactgtccaccagttaaactccctctctgaggagttgcagtggcccccagctgcccccaccgacagccacactccaggacccagcctagggggctgtcccctgagcaacctaagcttgtaatcccccacctcgagctttgcattctaagagctcaggacatctcctaattctcactagccctatggcaccagagcgaggtgtgcacagacacgaaagccaggatgcagaaaatggtccatttgcagaacattaatttttaaaccagtatcattttagagagttaaaaagtaacagactgagataaaagcgatcgtggaaatttttaaaaactacttattttaagaaatgcaaaactttctaccaactttgttatttttcaagtcagtatttctttttttcaaattagctgcagttcttttaagccttaaagaaatctttgatatatgcaacactgccctgagctgaacggtggggttggagttggctagccggggaaggctataggacagagaaaaaagggggggtgagtgggggaaggccataggacagagaaacatggggagcaaattaccaaactgtacctccctggaaaatgctcattctactttttaaaaaagtttgttaccgtaagtagtgtctatgtattggcaactgttctgctgattcgatgaatgtaataaatcataccttcttaccttcttgtaaaatcacctgcattgggactaaaggccatagtcccctaagaggggaaaggcttttctctaagaaagaagttaggagttcttgaaaggattgatgatccacttcctcagtaaaaaatgtattgaggaggccaggcacggtggctcatgcctgtaatcccagcactttgggaggccgagggatcacctgaggacaggagcttgagaccagccttgccaacatggcaaagccccgtctctactaaaaatacaaaaattagccaggtgtgctggcaggcacctgtaaccccagctactcgggaggctgaggcaggagaatcacttgaacctgggaggtggaggttgcagtgagccaaaactgcaccactgcactccagcctgggtgacagagcaagactctgtctcgaagaaaaaaaaaaaagtaatgacatcatctagtcaagggtcatatgcaggtaaatttcaactccttttatttttattgttatttttcaggccaaatttgagtccctctttaggacgtatgacaaggacatcacctttcagtattttaagagcttcaaacgagtcagaataaacttcagcaaccccttctccgcagcagatgccaggctccagctgcataagactgagtttctgggaaaggaaatgaagttatattttgctcaggtgagttgggttcattgctatgcatgcttctccctcctccctccctcccttttgtaaagcagcttatacgttgcttatgttatatgctgaccggaaactctgagacttcaccttgagaaagacaaaattcctactctgaatgttcagcgtctcacttgttttaagaagatatcaaggtgcatttgaaagcaacctcagacattgcccctgaccttcctgggttgataatgatgggggaaagaaagccttccctgttcactggggagcttgcagggtgcagcggggtaggcgtggctatgcaaacaccctaaggtttgcgcagcaggtttccatgaatttgctcaagggttggagctcatgacccactctagactgagcagaccagagtggttccctgctcatgtggtgctgggggtactcagcagagaaacaggagtctgcagaagatgcctgcaaatcagcccaggactgccaggtctggcttgaaaggaaaataggggataaccagactgggcgcagatgctaagaaaccctctggttggcagggttcccagccccagggcacccacggcagggagaggggtagctggggttgggcttgccttttctcctgcccactaccattttgaccctcctctggggaacttaggacaggtgacccaccttcaaggcagctcccagagttccatttgatgtccttaggggctgacagattgtcagggaagaagagaggagcttctagaatgcagccagctcctcagtaaagcaagtccccctcaggctctgagcacccccccaacccgcccccaccacacacacacatacacacataccttgctgggatgggagaggaccctgtccaaaggcctcccccagtgggaggaagctcatctgacaccacgccagagagccaaagtgtcttttcttcctcaaagtgaggacagcgaacttgctgggcccttcaagtataaataaagcatttgggatccccgccccacccctgacctttttgccctgggaggcacaggctgagctttgaccttgggtgcctaggccttcctgtgtgagtacactcctttctgcacgggataagattttatgcaaataattacttagtactcctctgaccttttctgtttgtaaaacaatgcatattcattgtgaaaacttggggagggcaatctggaagtgcagagaaaacctacaccgcgcagcttgagatgtaagagctctatggacagccctctcatcactggtcagcatttctaaaaccaaactaggatcgtaggttattgttccttattcttatttcttaaagtctcctgggaagtggcttttttttttttttctggcatctgatccagagtcccggagagggaggtgcagagctgctgctgggtggggaaccctaggggcaggtggagccctggctccctgtccctgagaagctgtgtcctctcagaactgtggcctaggctttggactttcagagcttgcctctgtggtatgaggagcggggagagactgattccaagagccctcctgacctcaatgacagtgacttaaatttccatatatactaaagtcacctctgctgattttctgtccatctaggtcaagcgtaattatttgcagtccctgtgcctgtgactcccatagccctgggagggggctgtcatcctatctgtgccacaaccagagttcatatgtccttttgccctccccattacagaccatcttacaattggtcctggaatcacacctgtcctgacgcctggacattgacctgcccatctcccggaactggcgttaggtgctgttgcctcactgcagttcttccctggcaacaactgacctgtgcttattttctctcctcagaccttacacataggaagctcacacctggctccgccaaatccagacaagcagtttctgatctcccctcccgcctctccgccagtgggatggaaacaagtggaagatgcgaccccagtcataaactatgatctcttatatgccatctccaagctggggccaggtgagcagggccctcgggtgggagggaggcagggggagacacagctgctgccctgcaccagggagcagtaccaccactacccccgtagctctcctgagcccatgccggcatgttttgtgagcttctctgtattcttctgcgccaccgtcccttgtgctgggagcatgcctgcctcttggcaccacctgcagtgttagagagactgcggctgatcgtggggaccctgcatcacgcccctccaccccccgcagtgtcccaggaatccattcctgtgtccactgagcacagcctgcgtgggaggcctgagccccggccccaggttctgtcgctccggatagggatgagtgattggactttggaaagggaaaatcgatgccccctttaagaaatgttatttttaatcaaaataaattctccctttcctgtgattctcacctggccttcttaaaggaaaagggaaggagaaccataggccatggtgagggaagggccgcggtcgggctgccctaccccagggcctgtgggctggtcccctacagagcttgctaaagaaagaggaagttcccgtcctctggagggacaaaagtgtgagcactgcggggagggggtaggttcctcaggctctttgtccaaaatgtgggccttaactggtggaattgtgagcagtagatgagatcatcgagtgaaaggcacttccatcagcacctggctcacagtcagtgttcaatgcaggatttttgaaaaccataaaatgttggtggttcctgtcctgtcctctagggtttgggtgaggaggcaggtgtgagggagagtcttggggtgaagaggtttgagccttctcctgctctgtccgtggagcaagtcaaataaatgctgagaccgtcagctcctcatttctccttgaccagcaatctgatgttcccttgggttgagggttttgttttcttggtccatcagcagtttcatattgaaaagattacatttctgaaaacattgtccaaacggaaattccctctgtgggataaagcaagactcacattacttactgctaattgtggcgtgaaggtcaagatcagaaatggccattttgaggaagcgtgtgctccccccacagcagctcctggcccgggggcatgagcatggctgagggtgtggagtcttcccctaggttaggaatgggagaaaacagggtctccacttgcaaagaggtgtccacagttccagaggcaaatgctgttaataaaaattctgcatactccagaatataccacttccttcaccgagggcttattggagaaggctttttaggaaatagacgtaataaaatcagtttgtccttggttcacttaacagtgagcttgagtgagatttcatatttcacctgtgcttttcaaccaacaggattgcggagattttgcaaattatggtcctaaaccctgagctttctggattttcgatgattagtaggtagataagagacttgcaaagaggtagatttgtaagaggctcttaaccagcattttcagcaatccatctgacctcccatgcctgaattctctctctcagagagctgagctcctttgcctttttcagtgcagttataataacattccagtcccacatgtgatagagaaaagatcaccaccttccttatcagtaaaagtaccttccaggtttagaggagtaaccagtgtggctggaggtaggaagctctcctgggccgctcttgtcgggcggaaatcacacagtggttggtgcggtgcctcctcgcttacccgaactgcaaagaaatcccaagcacaggccgggcgcggtggctcatgcctgtaatcccagcactttggaaggctgaggcaggcggatcacgaggtcaggagatcaagaccatcctggccaacatggtgaaacctcgtctctactaaaaatacaaaaattagctgagtatgatggcatgcgcctgtagtcccagctacttgggaggctgaggcaggagaatcacttgaacctgggaggcggaggttgcactgagccgagatcttgtcactgcattccagcctgggcaacaggcaagactctgtctcaaaaaaaaaaaaaaaaaaaagaaagaaagaaagaaaaagaaaaaagaaaagaaaagaaatcccaagcacaaagccctggaagaaaactgaccatgaggccacaccctgtgggtggagcaggttgaagcaaacctcctgcccctatttcagatccctgcccagcagggcaccaataacgatgcagtctccattcttaaacatctttctaggtgacatgggctggacaagcatgtggtgagccgggttctcattgcctcgggcactcactcatgctgttagctccatgaagtcaatacctttaccgtctcctttactgaggagggaactgaggtgcacagggaagcagaataaagtgcccatgagccctgggtactaaggagccaggctcagagctgccttcatgagcaccagagatgcacactcttcccgtggccagagcggcaccccagcgggaggccccagtcccttcattctacattgccgggtttttcagttgcagaaagctctccccacccttgctggaccagagtggcctgaacttggccaacctggtagaactcaggctgacatagaacagcaggacactcctggtcccggggattagaagttgttctaaggaaaagatgcccaggtcaaaaacgtttccagagcacctggctccgtgcagccacccctgcgtctgctgcagggcctcctgtggcgcccttcctgggcgtgcactgcgaccctcaaataggagctgcatgagggaggcccagggttctgtttccaaatacgtttcttcatccatctttttcctgaaccgaagtttctcacattcacacttgaggaaatgctgacagaaagggagttctctgggtagtttagatatctggtggacatgtgaagtataactagaaaaatgcattccttctatacttctcatgtgcctggactcccagaatgtttgactaaaaacagagtcatgcacaatggaaatctctctttttctgaatgagctagcaaagaaatacaaacccaaaatatgtctggctgtgtctctcagcccaatcgaatggtcacgagcagctggcccagcagagccctgaatgctcttttatgtttgccttttgactcccaaggacttgtctgagtgaccctgcgattattttccctccttaggggaaaagtatgaattgcacgcagcgactgacaccactcccagcgtggtggtccatgtatgtgagagtgatcaagagaaggaggaagaagaggaaatggaaagaatgaggagacctaagccaaaaattatccagaccaggaggccggagtacacgccgatccacctcagctgaactggcacgcgacgaggacgcattccaaatcatactcacgggaggaatcttttactgtggaggtggctggtcacgacttcttcggaggtggcagccgagatcggggtggcagaaatcccagttcatgttgctcagaagagaatcaaggccgtgtccccttgttctaatgctgcacaccagttactgttcatggcacccgggaatgacttgggccaatcactgagtttgtggtgatcgcacaaggacatttgggactgtcttgagaaaacagataatgatagtgttttgtacttgttcttttctggtaggttctgtctgtgccaagggcaggttgatcagtgagctcaggagagagcttcctgtttctaagtggcctgcaggggccactctctactggtaggaagaggtaccacaggaagccgcctagtgcagagaggttgtgaaaacagcagcaatgcaatgtggaaattgtagcgtttcctttcttccctcatgttctcatgtttgtgcatgtatattactgatttacaagactaacctttgttcgtatataaagttacaccgttgttgttttacatcttttgggaagccaggaaagcgtttggaaaacgtatcacctttcccagattctcggattctcgactctttgcaacagcacttgcttgcggaactcttcctggaatgcattcactcagcatccccaaccgtgcaacgtgtaacttgtgcttttgcaaaagaagttgatctgaaattcctctgtagaatttagcttatacaattcagagaatagcagtttcactgccaacttttagtgggtgagaaattttagtttaggtgtttgggatcggacctcagtttctgttgtttcttttatgtggtggtttctatacatgaatcatagccaaaaacttttttggaaactgttggttgagatagttggttcttttaccccacgaagacatcaagatacacttgtaaataaagctgatagcatatattcatacctgttgtacacttgggtgaaaagtatggcagtgggagactaagatgtattaacctacctgtgaatcatatgttgtaggaaaagctgttcccatgtctaacaggacttgaattcaaagcatgtcaagtggatagtagatctgtggcgatatgagagggatgcagtgcctttccccattcattcctgatggaattgttatactaggttaacatttgtaatttttttctagttgtaatgtgtatgtctggtaaataggtattatattttggccttacaataccgtaacaatgtttgtcattttgaaatacttaatgccaagtaacaatgcatgctttggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttacagaaaagttgtcattttatttctagaataaatctgtgaaccttctaaa

SEQ ID NO: 12173 - DNA, 10503 bp, Homo sapiens; identical to SEQ ID NO: 12172

SEQ ID NO: 12174 - DNA, 10503 bp, Homo sapiens; identical to SEQ ID NO: 12172

SEQ ID NO: 12175 - DNA, 987 bp, Homo sapiens
cacatctcatcttccactggaacgtttagataaaggagtgtggggtgtaataaagaactaagctagagcgagagaaacactgaaaaactaattacgaaatgtcacacaagtaccacaaagagagtgattacttgattaattaatgataggaaccctacatttaagtctttcagttatacttgcatcagtcctctttgcctatcagaatgcggtttgtttctgccaacgaataactatcaaaccactgaggcctaactgatgtgtgattaatgtgggctccattaattgtgtggctgagttttatgcatgaagctgtatccttgatttttcacctttaatttcctcctgtttaactgctggtcataaaattgtttcaaatgtatctgctgagtctgagagcaagttttgcaacttgaaaagtgcctgagtcagtttgggcatcttgtttggtaaaaccgacttgggggaactcttaacgctgtaagatgaattgctacttggcttccactcccagccctgctggctcccttcctgccactgctcactggcactgcatctcatctattatcattaagcacatgcatagcattgataatggcaaaaggcttaataactttctttctgatagcccatcatatgtggctctattcaaccttattttagacagctagagatgatgacatctgtctttctggtctttttcacattcatttaccatctctgttaatatcacctgattttcttttggggcagcaccccttcccatctctgcttttattttctgtgtttcaagtagggctggtctcatttccctggctccggagctaggcctggacaattagaattccagtgattggttcggggataggcatgtgacccaagctcggtcaactctcggtcaactagagagacaacctaggtcaactagacaggcaaccctaggactttagcaggaactattaggaggaaataaaaaaaaaaaagctc

SEQ ID NO: 12176 - DNA, 987 bp, Homo sapiens; identical to SEQ ID NO: 12175

SEQ ID NO: 12177 - DNA, 2530 bp, Homo sapiens
tgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttcctgtgttgcccaggctggagtgcggtggctattcacagatgctatcatagcacactacagcctacaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaactcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaacttttctacgttgaattc

SEQ ID NO: 12178 - DNA, 7314 bp, Homo sapiens
agctcgggaagcagagctccgccagcttcgcaaatccaacatggagtttgaggagaggaatgcagccctgcaaaagcacgtggagagcatgcgcacagcagtggagaagctggaggtggatgtgatccaggagcggagccgcaacacagtcttacagcagcacctggagaccctgcggcaggtgctgaccagcagctttgccagcatgcccttgcctggtaagtcctcctgcctgagaactgtcagtgacaggggtgtgtgtgttgtgtggagtggggtgctgtttatgttagtactggtgtggagagattgaaatctcctccagaggaaaattaattaaactacattttttcttctctggatataatagaatgtcagtattggctaaaatcgtccaatgtttcaggctctctggtcattcaaatttttgtccatttatattttaatatctattttcccctcttttaagcttaatttgctattcagaacactggaaactgagtagtaaatcttgagagtgtttcttcttatgtatgtttgtttgctttttagttgtttttgttttaacgggaaggaagggagaatgaacactggtatttcttatatactctttcattttgaagatagtcatagcagaaagctgagcgagtctaaccttctgttacatgcagctgctcatatatactatacagcaattatatagcccatctgtttatttagagtatgtggactaatttcatttctttgagatctaaaagtctctcctctaaaattaaaagcatgtctgtggagcagaccacattagaatcactgtttctttgaaattgtgttttatggtacaactgaatagggaggattttcttactttcttcttatctcacttcaggaagtggagagacacctacagtggacaccattgactcatatatgaacagactgcacagtattattttagctaatccccaagacaatgaaaacttcatagctacagttcgagaagttgtgaacagactcgatcgttagggaatggtgagtgctcactgataaatatttatatgccagcacatcatcaaaaataagatgtcatcagactttatcaatactactaaaaccctgggattacattggatgaacaagttggagacttggttaagattcctgttgcatggttgttaaatgtagtaaataatattagaaaagagaatcactgtagtcccagctacttgggaggctgaggtgggaggattgcttgagcccagcagttcaagtccagagagatcctgtctctaaaaataaaagaaaacagactcaagacagttttttcttatgcttgcttcagaatggtttaatgggaaaagcatggtttttgtggcttgacctcatttctagctttgtcacttattagctgtattcttgggcattagtttcccaaaaggttttgaaaagtgagtgggaaacttagaagaaatcatccccaaaacagcactcagaacaaaataaatataacttaatttttaatcttccttttctctggaaaatactaatgataatttagaagtagtcagtgagacattgtatgtatgtgagcctacataagtaggaagcttttatattcaccactcaataacacagtgactgttgtctgttaaatgttgatgtggactcaccatacaaacaggtaactccctggttttgatagattaaaaaataaactcttcagccaggtgcaatggctcacacctgtaagcctagcagtttgggaggtcaaggcaggcagatcgctggagtccaggttcaagaccagtctgggcaacatgacaaaaccccgtatctacaaaaaatacaaaaaattagccaggcatggtggtatgcgcttgtggtcccagctgcttgggaggctaaagtgggaggatcacttgggcttagaaggtcaaggcgaggctgcagtgagccattatcagaccactgcatgccagcctgggtgacagagcaagacactgtctcaaaaatttttttaaataaaaaataaataaactcttggtggggcacagtggctcacacctgtagtcctagcactttgggaggttgaggcagtattgcctgagcccaggagttcaagaccagcttgggcaaaatagtgagacccctgctttaaaaaaaaatgaaaaaaattagctgagcatgatggcgcacacctatagtcctagctactcaggaggctgaggcaggaggatcacttaatcccaggagttcaggtttcagtaagctagggtcacactagtgtattctagccagggtaacagagcaagattctgtctcaaaaaaaaaaaaaacaaaataaaaatataaaattctcaataagcaaaaaagagagagaaaataagtttttaaaaaatatgttcaacaaatgagcagtagtatgtatccttttttttttttttttccaaaaaaaatctacccatgacactttttggtactaatggtcatttctcaaatggaattggtatttattcattcaaattcctagagataggatacccctttactatgccatcccacaaaactggcatccctttgctctattggttaagttattccatacctgcagacatataaactgtgtggaaattttaagattagactctacaatgaggtggccatatatggatactaaaataagagtcaacagcaggatatgttccttagaatggtcatgggtttgaatctttatttgtcctgtgagtacatgagcacactcatatacataatttatattctggtttggtttggactttgagcaacatatataaagataaatgcctagtaaagacaaaggcagaagtctttatacttcttggtgatgcccttggatggtaactgtacaaggcaatgcattatattttagcctcagccatgctctgatggggaaaggattactatccttctagggagtagccagatggaatggactgtacttcttagagatggctggactccctgcagaataaagaagtggcattactgctgctgcttatgaagggaacagcttgtaaatctaggcctgggatattcaggagctcatcatccttcccattttcgtacagtgttttcaattagcactcttgtaggcttgaaaagtgagagctgggagaaacagtgtggaagattgtgaaagaaaacattaattgataacatcgtgtctcttcacatagatacagggcagctaattaagtattgacccaaaagtggttttccattttgagcattttgccagtaagactctcctaaagcttttttcatctcaagagtataaactatattatttgttttctgatgagtctttgaaaacttagaatattactattatccttgattttaacctacaaatattttgcccctgaaaaaatagctaaaagtgtgaactgttatattactacagattcttacagtctagccatgcaaacataactaacaatagatggttccccacacccccaaaactgtcaaaggaaacaattacaaagactgtgattaatactggtttggcctcattatacaaatatgtacagacagcgaggctgatgtccccagcactcatgatgcaattaattactctgacaagagtttggcaaagttttcatccactgtcaggagccagtgagtgaagggaagctaatggtctacaagtttcagaggagcatattagggacctttagaaatctaacattttatatatgaagaaactgaatcccagagaggagaaacatcttgcttgaaaatatctgcgtagatgagtacagaatccaagactagaaccacagatatctaaactctctcattcactgggtttctaaaacattgctctaaggaagaggtggatgggggaaggggaaagcactaaaaaatcctgaaatagagcattaagatacataggaagtaaacagataaaaattgtaatccaggaattataatgttatagaattttagctcattttaaaattattttgataaatatacagtggaagaattaccctacctgtctgtcacctttcttgtagctgagtagtacctagagacaagtggagctaggaggaggccatgagggtgattttaagttgaaaggtgactaccttatataaactattaaaatgcatatgttgcctgatttcaatgataatatttggctgtttgagtttagggaaaaaaaatcttatgtgactgtatttttattaatatgagaaatgttcttgattatatgcacataatacatctctatacatgcagatatccttagttaacacttgaagaaaattggttttgattgaccatacattcttcagactaaagtagggtactcattttccctcctcaggtttgtccctgatagttgcttttctgtgtttagctgatgattttcctacctcccattgttgctgaactggaacagggccatgtttctcattgaaatgttatgtaaaacatctcaatgaggttgcctgcttacagctttatgagttcttcagtttacatacaccctgcactcactttaacgcttatgaaaccaaagcatttttaaaatccatagcgctaaccccttccattcaatacttactttcttggtgttattttccttgtttgtttttgtttttgttttgttttgttttcctgattctacaggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttcctgtgttgcccaggctggagtgcggtggctattcacagatgctatcatagcacactacagcctacaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaactcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaacttttctacgttgaattc

SEQ ID NO: 12179 - DNA, 327 bp, Homo sapiens
aaatatacagtggaagaattaccctacctgtctgtcacctttcttgtagctgagtagtacctagagacaagtggagctaggaggaggccatgagggtgattttaagttgaaaggtgactaccttatataaactattaaaatgcatatgttgcctgatttcaatgataatatttggctgtttgagtttagggaaaaaaaatcttatgtgactgtatttttattaatatgagaaatgttcttgattatatgcacataatacatctctatacatgcagatatccttagttaacacttgaagaaaattggttttgattgaccatacattct

SEQ ID NO: 12180 - DNA, 99 bp, Homo sapiens
acaggggacttagttctcagaagaaattcattgctcaaaagcaatggtagtgttatccctccttaggactactcaaagaccagtgaaggaaagctaggg

SEQ ID NO: 12181 - DNA, 163 bp, Homo sapiens
gggattacaggcgcctgccaccacacctggctaatttttgtatttttagtacagacagggtttcaccatgttggccaggctggtcttgaactcctgacctcaggtgatctgcccgcctcggcctcccaaagtgctgggattacaggcgtgagccaccgcgccc

SEQ ID NO: 12182 - DNA, 125 bp, Homo sapiens; identical to SEQ ID NO: 9085

SEQ ID NO: 12183 - DNA, 1208 bp, Homo sapiens
  misc_feature (1186)..(1186): n equals a,t,g, or c
caaggtttcaccattttgggcaggctggtcttgaactcctgacctcaggtgatctgcctgccttggcctcccaaagtgctgggattagaggcgtaagccaccgcgcccagcccctatcctttttgttttttattataaaagtaatatctgaatacatgattgtttaaataaatgctgtgtaagtgtataaaatgaaaagtaaaaggcccccatgaatggacattaagatacttccgatgtgttttgttttctattgctgcagtatttgttactgtacttgtgatggtacatgtgcatatattgctctaaaacaaatttctagaagttgaattccaaacagtgactgttccagatgtcttattttttaggaccccaagcctcttaaatttaggtctttccgttattcccttaccttctcccttatcccttcaaatctttgcccactgccatcacattaatgccttctttgaccttattttatctgttatagtaatgagctgccctgttctttctatctttaatctccccactccaccttgtccttattatctcagctagtttaattcttaaaagtgagtatattaatccttggaatctttcttttttatatatatatatagtactgatatttttcagttagtagcttctgattataactttcccaaattgaggctttcatttccttagaacaaggaactgccctggctgggcagtttagtcaaaggcttgtcagggtgtttagtagacagttgtgcaagtggagctattcacagggactgtattactatgttcctttgttactaaaaaaaaattcttgcagtccctgtagttcgcaacagatactctgactcatatttctctacataggagaaagagtatggactttggagtgatacatctatagctcggttaggatctagactctgctcccaaactggtagtgtattttggggtgcactgctatgtttctgagccttcatttcttccttataaagagtttattagtttgtagccaggcgcagtggctcacacctgtaattccagcactttgggaggctgaggttggtggatcacctgaggtcaggagttcaagaccagcctggccaacagggtgaaaccccgtttctactaaaattacaaaaattagccggacgtagtggcacatgtttgtaatcccactactcangaggctgaagtgagagaatcgc

SEQ ID NO: 12184 - DNA, 1322 bp, Homo sapiens
caaggtttcaccattttgggcaggctggtcttgaactcctgacctcaggtgatctgcctgccttggcctcccaaagtgctgggattagaggcgtaagccaccgcgcccagcccctatcctttttgttttttattataaaagtaatatctgaatacatgattgtttaaataaatgctgtgtaagtgtataaaatgaaaagtaaaaggcccccatgaatggacattaagatacttccgatgtgttttgttttctattgctgcagtatttgttactgtacttgtgatggtacatgtgcatatattgctctaaaacaaatttctagaagttgaattccaaacagtgactgttccagatgtcttattttttaggaccccaagcctcttaaatttaggtctttccgttattcccttaccttctcccttatcccttcaaatctttgcccactgccatcacattaatgccttctttgaccttattttatctgttatagtaatgagctgccctgttctttctatctttaatctccccactccaccttgtccttattatctcagctagtttaattcttaaaagtgagtatattaatccttggaatctttcttttttatatatatatatagtactgatatttttcagttagtagcttctgattataactttcccaaattgaggctttcatttccttagaacaaggaactgccctggctgggcagtttagtcaaaggcttgtcagggtgtttagtagacagttgtgcaagtggagctattcacagggactgtattactatgttcctttgttactaaaaaaaaattcttgcagtccctgtagttcgcaacagatactctgactcatatttctctacataggagaaagagtatggactttggagtgatacatctatagctcggttaggatctagactctgctcccaaactggtagtgtattttggggtgcactgctatgtttctgagccttcatttcttccttataaagagtttattagtttgtagccaggcgcagtggctcacacctgtaattccagcactttgggaggctgaggttggtggatcacctgaggtcaggagttcaagaccagcctggccaacagggtgaaaccccgtttctactaaaattacaaaaattagccggacgtagtggcacatgtttgtaatcccaactactcaggaggctgaggtgagagaatcgcttgaatccaggaggcagaggttgcagtgagctgaaattgtaccactgcactccagcctaggcgacagagtgagactccgtgtcaaataaaaaataaaaaaaaaacgaaaaaaa

SEQ ID NO: 12185 - DNA, 285 bp, Homo sapiens
ttttttttgagacagagtctcgctctgtcacctaggctggagtgcagtggcgcgatcttggctcactgcaagctccgcctcctggattcacgccattctcctgcctcagcctcccaagtagctgggactacaggcgcccgccaccacggccggctaattttttgtatttttagtagagatggggtttcaccgtgttagccaggatagtctggatctcctgacctcatgatccgcccgccatggcctcccaaagtgctgggattacaggcatgagccactgtgcct

SEQ ID NO: 12186 - DNA, 143 bp, Homo sapiens
gaccttttttttttttttttttttttttgagatggagtctcgctctgtggcccaggctggagtgcagtggcgcaatcttggctcactgcaagccgcctcctgggttcatgccattctcctgcctcagcgtcctgagtagctgg

SEQ ID NO: 12187 - DNA, 285 bp, Homo sapiens; identical to SEQ ID NO: 12185

SEQ ID NO: 12188 - DNA, 1322 bp, Homo sapiens; identical to SEQ ID NO: 12184

SEQ ID NO: 12189 - DNA, 143 bp, Homo sapiens; identical to SEQ ID NO: 12186

SEQ ID NO: 12190 - DNA, 285 bp, Homo sapiens; identical to SEQ ID NO: 12185

SEQ ID NO: 12191 - DNA, 2393 bp, Homo sapiens
aattccagaaagggaactaaattctgcttaaaaagagaaggcttctcaaagggagtaatgtttgacttgagacccagagaaggagaaaggaaggaagcttgcagaggagccttggtgacaagaggcatgctctattgtggggacagtaggaataggggagaagccttggccttgtcactttctgctttttggtttatgcagttgtctctgcctaagatttttttctacctttgtttctgcctccagttactccccctggaagtgtcactctcttttaaattcagagagccttgtttatggcactgatgtggtgcccagtgcattctgctttgtactaaatatgctgtatctcacctttgtgtcagcaccaaactgtgttctttataattctgcagcttctagtacatttgtgcatagtagcaactcaatgcacatttgttgaatgttgaatgaatgctagtcaaggcaagacaagcaaaattctcaaataagtcaaaataatccctaattatttccagatggaatggtaatcaatttgcttcaggaataaattagccaatggatgtttgataacataaccgaccctaagtaactcgatttagctgctgaagccagcttttaaagatgcagtttatccactggccatgggatatcggccatgattactggagcaagccctagtaatacaatctttatataataaatataatcttactaaatgtcagtgagaattatctttatataataaatacagtctttaaaattgtatttatatttggcatttatgcctctcagcactatgtaatttcttattagaagtacactttaacttgagaattccattagaatcattaaattttctgaatagaaagcttaacagtgtttaaaaataaatttttagtggcttcatgatgtcaaaacaatcacttgaaagctgaaaaatatgttaaacctacttttgtatttatgtcccagtttgcttttttcaattcacaaaaaaagatttgacttgattacaaagaagaaaacacagaaagagcaaaaaagaaaagaaagatgaaaggaaggaagaaagggagacaaaaaaagaaacaaaaagaaaaaaagagaaagactgattatctagttgttttgtgattaggtagacataactcgagaatcttggagccatccttatctcttccctctccattacctgccacaaacaaccccccactaaatagtaaattcttactccaaaatgtctttgatattccttctttcttattcatttccatgtcactgcctgacttcaagcttttatgaagcttgaagttatatatcaaattgtaactgatctcctaattctcattttgtgtgtgcattccccaaatcattcttgacatatctgtgcaaatctcagcatgtcactttcccagtagtaggtatccatcagctccctgttaatctccatgaccagagattctgtccacctctccagcctcatcttgtgagcttctttccaatcacctcatcctttgcctccttagcttttgcctcggctggcctgataaacctctacctgcctgccaagtttcagttcaagccttagctctctgtcaagctcccgcagtccctcacccggactcacatgctccttgcacctgcagtgggtcagctgctttacatatattgtactctttacttctcacgtagctgtttaaggtgggtggtctttgtctccactttgcaggtgagaaaagtgaagctcagagagcttaagtaatttgctgacagtcacacagtaagaaaatcagtggcaaactgaaatacaaagaacctgagctcactcctcaacatgttgctccttggctttagctttgcccacacctgcttttattttgttacgacgtttgtcacatttactgtgtttgcaattctccatttctgctacactcgttgaaagcatcagccccacctttcatctttatgtctccaaagacctgcacagtgtctggctcatgagaggtagttaagaaatatttattaaggtgatgaatgaaccaagcaatatacaaacaatatacatattcttttctttgtggtggtgtggagaagaaagggagaagtaataagttccactttctggagtggaagggttctagtgggacaatagaagattgtatgacctccagaaccatcttaagagtgattttaggattagctactaagggccaggcacaatggcacacacctatagtcccagctagttagaggctgaggcaggagcattgcttgaacccagaagttaaaggttgtagtacactgtgattgcatctatgaatagccactgcactccacctgggcaacatagcaagaacctgtctctcaaaaaaaaaaaaaaaaaaaaaaag

SEQ ID NO: 12192 - DNA, 2452 bp, Homo sapiens
aagtgattcttaaatattaagtgataaatgcatttaaaatgtgtccggaatgggctttgtgaattccagaaagggaactaaattctgcttaaaaagagaaggcttctcaaagggagtaatgtttgacttgagacccagagaaggagaaaggaaggaagcttgcagaggagccttggtgacaagaggcatgctctattgtggggacagtaggaataggggagaagccttggccttgtcactttctgctttttggtttatgcagttgtctctgcctaagatttttttctacctttgtttctgcctccagttactccccctggaagtgtcactctcttttaaattcagagagccttgtttatggcactgatgtggtgcccagtgcattctgctttgtactaaatatgctgtatctcacctttgtgtcagcaccaaactgtgttctttataattctgcagcttctagtacatttgtgcatagtagcaactcaatgcacatttgttgaatgttgaatgaatgctagtcaaggcaagacaagcaaaattctcaaataagtcaaaataatccctaattatttccagatggaatggtaatcaatttgcttcaggaataaattagccaatggatgtttgataacataaccgaccctaagtaactcgatttagctgctgaagccagcttttaaagatgcagtttatccactggccatgggatatcggccatgattactggagcaagccctagtaatacaatctttatataataaatataatcttactaaatgtcagtgagaattatctttatataataaatacagtctttaaaattgtatttatatttggcatttatgcctctcagcactatgtaatttcttattagaagtacactttaacttgagaattccattagaatcattaaattttctgaatagaaagcttaacagtgtttaaaaataaatttttagtggcttcatgatgtcaaaacaatcacttgaaagctgaaaaatatgttaaacctacttttgtatttatgtcccagtttgcttttttcaattcacaaaaaaagatttgacttgattacaaagaagaaaacacagaaagagcaaaaaagaaaagaaagatgaaaggaaggaagaaagggagacaaaaaaagaaacaaaaagaaaaaaagagaaagactgattatctagttgttttgtgattaggtagacataactcgagaatcttggagccatccttatctcttccctctccattacctgccacaaacaaccccccactaaatagtaaattcttactccaaaatgtctttgatattccttctttcttattcatttccatgtcactgcctgacttcaagcttttatgaagcttgaagttatatatcaaattgtaactgatctcctaattctcattttgtgtgtgcattccccaaatcattcttgacatatctgtgcaaatctcagcatgtcactttcccagtagtaggtatccatcagctccctgttaatctccatgaccagagattctgtccacctctccagcctcatcttgtgagcttctttccaatcacctcatcctttgcctccttagcttttgcctcggctggcctgataaacctctacctgcctgccaagtttcagttcaagccttagctctctgtcaagctcccgcagtccctcacccggactcacatgctccttgcacctgcagtgggtcagctgctttacatatattgtactctttacttctcacgtagctgtttaaggtgggtggtctttgtctccactttgcaggtgagaaaagtgaagctcagagagcttaagtaatttgctgacagtcacacagtaagaaaatcagtggcaaactgaaatacaaagaacctgagctcactcctcaacatgttgctccttggctttagctttgcccacacctgcttttattttgttacgacgtttgtcacatttactgtgtttgcaattctccatttctgctacactcgttgaaagcatcagccccacctttcatctttatgtctccaaagacctgcacagtgtctggctcatgagaggtagttaagaaatatttattaaggtgatgaatgaaccaagcaatatacaaacaatatacatattcttttctttgtggtggtgtggagaagaaagggagaagtaataagttccactttctggagtggaagggttctagtgggacaatagaagattgtatgacctccagaaccatcttaagagtgattttaggattagctactaagggccaggcacaatggcacacacctatagtcccagctagttagaggctgaggcaggagcattgcttgaacccagaagttaaaggttgtagtacactgtgattgcatctatgaatagccactgcactccacctgggcaacatagcaagaacctgtctctcaaaaaaaaaaaaaaaaaaaaaa

SEQ ID NO: 12193 - DNA, 298 bp, Homo sapiens
ccttggaaagcttgctccttcactctccaggggatcaaaacctgggagactgtctgctgctgaaactacactcccggaatctgtgagttctcctgttgttctttttccctcaggatcctccatttccagcatctatcatagtccaagcagagcacataagcactcttttggagtacatatggctttcatggtctggtgatggaatctgggaacacagttatgtttggatgaggtcagttctgagtggcaagctcatgttacttaattagtttagcataagtgtaaacctttcaataga

SEQ ID NO: 12194 - DNA, 298 bp, Homo sapiens; identical to SEQ ID NO: 12193

SEQ ID NO: 12195 - DNA, 39062 bp, Homo sapiens; identical to SEQ ID NO: 10929

SEQ ID NO: 12196 - DNA, 5417 bp, Homo sapiens
atggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggtacagatgcagcctggctaggcagagaatcccttgtagaaaggtgggggagaatcataggatattataactgtaaggaacatgcaagattttccagattatacccttgatagaatagataagttccttaaggctcagatcttgcttaaagtcgtccagcctgttagagacaagtagaacacgaagctggcctctggagtctttattgagtactttgtacaattggtgtagactgggagagccctcctcacttcccctttcttgtgctgtaatttcctgtggggcagaacacctcagaggtttctgtgcatcaaaataagatgcagcaaagacatggaaaaaggataacgagacaaattcccagcaataagtagatgaggttgtgttttttataaaagataacgaggcattccttccagaaatgtggagcctttgtagatttcagtgcataaaaccaagccatgatttcctgcagtgatcacagagcagagaagggagaaagcccttttatcacaaaccagcaggaagtctctgtaaaattggtaaggattctggtttagtgtgaagaaccacattttttgtgtatgtttctgggcccatgggaaggaacagatcatatttgacatacaagaatcaaatgattcaggccaggcatggtggctcactcctgtaatcctagccctctgggaggctgaggtgggaggattgcttgagcccagaagtttgagaccagcttgggcaaaatagcaagacttcatctctatttaaaaaaaaaaaaaaaaaaaaaaaaagaatcaagtgattttgctcttatctggagttgagacaagccagatgttctcgtgttgttttcataagcaaaagaggctaaactgatggccagaaagtactcctgctcatagggacctattcattggtctccagggtttacactgacctttaagtctaatcacagggggtgggtggttttgggataggaatgaggaacctccaaggccatgttcttagctccagctaaaaataggtctttcctttgctcttaagcctgaggtgtggaacttcctggtgctactcactgcagctatggtccctgtctagggcacttggaagtctgaagggaggcggaggagggcaggaggggttatttaaccacccagcccctcctgtccgttccgtggcttcactccatcacctcactcctgtacttcctgttctcattcactgatgagtcttccttccttcattcatttcaagggccactgtcagctttctcccttaaaatgcttctctggcctccatgctttgctgctcactttcctccctgggtcccctgagccaccccatcccatcaaatccttcctgagcccttccacagttggaaccaacaacctctgaagctttgctcgcagtccagatgaaccaagtcgctgtgctttcctgcctgtgcctgtgctccaggtgtgtctgtcctctgcctggtgtgaccatctccctcttctgcccttctccaggatcaggcattccccagtttcccctggtaatcactccaccctgtgcatctgtaggactttgaaatgctcttatcagggtctgtctcattgcactgttatttatgtacctgtcatatgttccttactctccagtgtcagctgcaaggagggatcattctggttaatctttatgtgcttcaccatctctctcttttttttttttttttgagacagagtctcgctctgtcacccaggctggagtgcagggacataatcttggctcgccacaagctctgcctcccaggttcaagcaattctcctgcctcagcctcccgagtagctgggattacagacgtgcaccattatgcccaactaatttttttgtgtttttagtagagacggggtttcaccatcttggccaggctggtctcgaactcctgacctcatgatccgcccgcctaggccttccaaagtgctgggattacaggcatgagccaccgtgcccagccacgatctcttaaataaaggcgtttaagtgtttgttcagcaaattgggcccataaatttggtgggaaataaatgaattgctttgaactgcattcatgatgattgcatgtgtttatccttgtttcccaagcctttggttttccccaaatacacagaaaacagttgctcatcaatcctgcctcttcccaatgaaaatgatacaaatatatacatattttccttgtcaggcagttgaaataggtaaatccccagtgagattcactctaggtacacccctggccagatctatatctgaaatgactggtttttatgactttttcttttttttttttttgtttgagacagagtcttgttctgtcgcccaggctggagtgcagtggtgcgatctcggctcactgcaagctccacctcctgggttcacaccattctcctgcctcagcctcccgagtagctgggactacaggtgcccgccaccacgcctggctaattttttgtatttttaatagagatggggtttcaccttgttagccaggatggtctcgatctcctgaccttgtgatctgcccacctcggccgcccaaagttctgggattacaggcgtgagccaccatgcccagcccatgacttttcaaatgtgcttttgaagtggtcctaggatgaggtggggctctggtgaagttctgaaaaggggcgtccctagtcatcatagttattcattcattcaaccaatattgtgtttgctttgtgcctggtcctaggcttgaggacctagtctctgtccctccaagaaacttaaggtctgctggagagacaggcaattaaatgggcaagatgtcacactgtgataagtgatacaatggggtgaacataggtgggggccccagtggtttaatttctcctgttcctccatttcaggttttgaagagacaggggacacgctctatgccccctattccacacattttcagctgcaggtaagtgatttttttctccctcttcatcaaaggcattagcacctcaggaacactgatcctttggaaacagacgatgttacctttctcatggcccctagatggccacttgaaggaatgatgggtcttctttcctctaagcggcctcacggggttagtgggtaagaatgagtgcttggcatagagaggacttgggggtgggaggcctgggagaaagggaaggaaatgagacttctgcccagactggagacctgttgaaatggcaggaactggagtgggtttcacgatatgactgtttccttttcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaa

SEQ ID NO: 12197 - DNA, 1752 bp, Homo sapiens
ggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcggtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggtacagatgcagcctggctaggcagagaatcccttgtagaaaggtgggggagaatcataggatattataactgtaaggaacatgcaagattttccagattatacccttgatagaatagataagttccttaaggctcagatcttgcttaaagtcgtccagcctgttagagacaagtagaacacgaagctggcctctggagtctttattgagtactttgtacaattcgtgtagactgggagagccctcctcacttcccctttcttgtgctgtaatttcctgtggggcagaacacctcagaggtttctgtgcatcaaaataagatgcagcaaagacatggaaaaaggataacgagacaaattcccagcaataagtagatgaggttgtgttttttataaaagataacgaggcattccttccagaaatgtggagcctttgtagatttcagtgcataaaaccaagccatgatttcctgcagtgatcccacagcagagaagggagaaagcccttttatcacaaaccagcaggaagtctctgtaaaattggtaaggattctggtttagtgtgaagaaccacattttttgtgtatgtttctgggcccatgggaaggaacagatcatatttgacatacaagaatcaaatgattcaggccaggcatggtggctcactcctgtaatcctagccctctgggaggctgaggtgggaggattgcttgagcccagaagtttgagaccagcttgggcaaaatagcaagacttcatctctatttaaaaaaaaaaaaaaaaaaaaaaaaaaaatcaagtgattttgctcttatctggagtt

SEQ ID NO: 12198 - DNA, 5425 bp, Homo sapiens
ggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggtacagatgcagcctggctaggcagagaatcccttgtagaaaggtgggggagaatcataggatattataactgtaaggaacatgcaagattttccagattatacccttgatagaatagataagttccttaaggctcagatcttgcttaaagtcgtccagcctgttagagacaagtagaacacgaagctggcctctggagtctttattgagtactttgtacaattggtgtagactgggagagccctcctcacttcccctttcttgtgctgtaatttcctgtggggcagaacacctcagaggtttctgtgcatcaaaataagatgcagcaaagacatggaaaaaggataacgagacaaattcccagcaataagtagatgaggttgtgttttttataaaagataacgaggcattccttccagaaatgtggagcctttgtagatttcagtgcataaaaccaagccatgatttcctgcagtgatcacagagcagagaagggagaaagcccttttatcacaaaccagcaggaagtctctgtaaaattggtaaggattctggtttagtgtgaagaaccacattttttgtgtatgtttctgggcccatgggaaggaacagatcatatttgacatacaagaatcaaatgattcaggccaggcatggtggctcactcctgtaatcctagccctctgggaggctgaggtgggaggattgcttgagcccagaagtttgagaccagcttgggcaaaatagcaagacttcatctctatttaaaaaaaaaaaaaaaaaaaaaaaaagaatcaagtgattttgctcttatctggagttgagacaagccagatgttctcgtgttgttttcataagcaaaagaggctaaactgatggccagaaagtactcctgctcatagggacctattcattggtctccagggtttacactgacctttaagtctaatcacagggggtgggtggttttgggataggaatgaggaacctccaaggccatgttcttagctccagctaaaaataggtctttcctttgctcttaagcctgaggtgtggaacttcctggtgctactcactgcagctatggtccctgtctagggcacttggaagtctgaagggaggcggaggagggcaggaggggttatttaaccacccagcccctcctgtccgttccgtggcttcactccatcacctcactcctgtacttcctgttctcattcactgatgagtcttccttccttcattcatttcaagggccactgtcagctttctcccttaaaatgcttctctggcctccatgctttgctgctcactttcctccctgggtcccctgagccaccccatcccatcaaatccttcctgagcccttccacagttggaaccaacaacctctgaagctttgctcgcagtccagatgaaccaagtcgctgtgctttcctgcctgtgcctgtgctccaggtgtgtctgtcctctgcctggtgtgaccatctccctcttctgcccttctccaggatcaggcattccccagtttcccctggtaatcactccaccctgtgcatctgtaggactttgaaatgctcttatcagggtctgtctcattgcactgttatttatgtacctgtcatatgttccttactctccagtgtcagctgcaaggagggatcattctggttaatctttatgtgcttcaccatctctctcttttttttttttttttgagacagagtctcgctctgtcacccaggctggagtgcagggacataatcttggctcgccacaagctctgcctcccaggttcaagcaattctcctgcctcagcctcccgagtagctgggattacagacgtgcaccattatgcccaactaatttttttgtgtttttagtagagacggggtttcaccatcttggccaggctggtctcgaactcctgacctcatgatccgcccgcctaggccttccaaagtgctgggattacaggcatgagccaccgtgcccagccacgatctcttaaataaaggcgtttaagtgtttgttcagcaaattgggcccataaatttggtgggaaataaatgaattgctttgaactgcattcatgatgattgcatgtgtttatccttgtttcccaagcctttggttttccccaaatacacagaaaacagttgctcatcaatcctgcctcttcccaatgaaaatgatacaaatatatacatattttccttgtcaggcagttgaaataggtaaatccccagtgagattcactctaggtacacccctggccagatctatatctgaaatgactggtttttatgactttttcttttttttttttttgtttgagacagagtcttgttctgtcgcccaggctggagtgcagtggtgcgatctcggctcactgcaagctccacctcctgggttcacaccattctcctgcctcagcctcccgagtagctgggactacaggtgcccgccaccacgcctggctaattttttgtatttttaatagagatggggtttcaccttgttagccaggatggtctcgatctcctgaccttgtgatctgcccacctcggccgcccaaagttctgggattacaggcgtgagccaccatgcccagcccatgacttttcaaatgtgcttttgaagtggtcctaggatgaggtggggctctggtgaagttctgaaaaggggcgtccctagtcatcatagttattcattcattcaaccaatattgtgtttgctttgtgcctggtcctaggcttgaggacctagtctctgtccctccaagaaacttaaggtctgctggagagacaggcaattaaatgggcaagatgtcacactgtgataagtgatacaatggggtgaacataggtgggggccccagtggtttaatttctcctgttcctccatttcaggttttgaagagacaggggacacgctctatgccccctattccacacattttcagctgcaggtaagtgatttttttctccctcttcatcaaaggcattagcacctcaggaacactgatcctttggaaacagacgatgttacctttctcatggcccctagatggccacttgaaggaatgatgggtcttctttcctctaagcggcctcacggggttagtgggtaagaatgagtgcttggcatagagaggacttgggggtgggaggcctgggagaaagggaaggaaatgagacttctgcccagactggagacctgttgaaatggcaggaactggagtgggtttcacgatatgactgtttccttttcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaa

SEQ ID NO: 12199 - DNA, 776 bp, Homo sapiens
ctgagagcttcatgttggagctgaagttcaaggttcacttcctttgggtttgtacttgacccttcttcatgtgtctctcccgttccctctaaaacaagtgtgtttcccctcatttttgaggctgtcaatggtgtgagagccaggatcatcacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcaaaaggaaaaaccagcgtgaggcagaggcgagggaggtggaggtgagtggatgatgtgctgagttagggatgtttatatgccgcaaaggtttggttggtaggcttcgcgctaagattagcctggctttgtactgaaaagggggaaggacacatagtgacacagatccttctggtctttcccaggaggtgtgacctaatgaggtttgttgtgagaataaagcaatgtggtttcacatatattatctatcat

SEQ ID NO: 12200 - DNA, 89 bp, Homo sapiens
ggaggcggagcttgcagtgagccgagatcgtgccactgcactccagcctgggcgacagagcgagactctgtctcaaaaaaaaaaaaaaa

SEQ ID NO: 12201 - DNA, 129 bp, Homo sapiens
gctactctggaggctgaggcaggagaatcacttgagcccgggaggcggagcttgcagtgagccgagatcgtgccactgcactccagcctgggcgacagagcgagactctgtctcaaaaaaaaaaaaaaa

SEQ ID NO: 12202 - DNA, 160 bp, Homo sapiens
ccgggcatggtggcacatgcctgtagtaccagctactctggaggctgaggcaggagaatcacttgagcccgggaggcggagcttgcagtgagccgagatcgtgccactgcactccagcctgggcgacagagcgagactctgtctcaaaaaaaaaaaaaaa

SEQ ID NO: 12203 - DNA, 776 bp, Homo sapiens; identical to SEQ ID NO: 12199

SEQ ID NO: 12204 - DNA, 185 bp, Homo sapiens
cccaggctggagtgcagtggtgcgatctcggctcactgcacgctctgcctcccgggttccagcgactctcctgcctcagcctcccgagtagctgggactacaggtgcccaccaccacgcccagccaactttttgtatttttagtagagacggggtttcaccgtgttagccaggatggtctcgatc

SEQ ID NO: 12205 - DNA, 242 bp, Homo sapiens
gcctttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtga

SEQ ID NO: 12206 - DNA, 38771 bp, Homo sapiens; identical to SEQ ID NO: 9789
  misc_feature (29356)..(30880): n equals a,t,g, or c

SEQ ID NO: 12207 - DNA, 316 bp, Homo sapiens; identical to SEQ ID NO: 7788

SEQ ID NO: 12208 - DNA, 286 bp, Homo sapiens
tctttttttttttttttcttttcttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgccgggctaatttttggtatttttagtagagacggggtttcaccgtgttagccaggatggtctggatctcctgacctcgggatccgcccgcctgggcctcccaaagtg

SEQ ID NO: 12209 - DNA, 305 bp, Homo sapiens
tttcttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggtgcccgccactacgcccggctaattttttgtatttttagtagagacggggtttcaccgttttagctgggatggtctcgatctcctgacctcgtgatccgcccgcctcggcctcccaaagtgctgggattacaggcgtgagccaccgcgccc

SEQ ID NO: 12210 - DNA, 316 bp, Homo sapiens; identical to SEQ ID NO: 7789

SEQ ID NO: 12211 - DNA, 186 bp, Homo sapiens
tcagcctcccgagtagctgggactacaggtgcccaccaccacacctggctaatttttttgtatttttagtagagacggggtttcaccatgttagccaggatggtctcgatctcctgacctcatgatctgcctgcctcagcctcccaaagtgctaggattacaggcgtgagccaccgcgcccagcaa

SEQ ID NO: 12212 - DNA, 303 bp, Homo sapiens
ggtttttttttttttttttttttgagatggagtctcgctctgtcgcccaggctggagtgcagtggtgcaatctcagctcactgcaagctccacctcctgggttcacaccgttctcctgcctcagcctcccaagcagctgggactacaggtacccgccaccacgcctggctaattttttgtaatttttagtagagacggggtttcaccatgttagccaggatggtctcaatctcctgacctcgtgatccacctgcctcggcctcccaaagtgctgggattataggcgtgagccaccgcgcctgg

SEQ ID NO: 12213 - DNA, 283 bp, Homo sapiens
tttttttttttttttttttttgagatggagtctggctctgtcgcccaggctggagtgcagtggcgcgatctcggctcactgcaggctccacctcccgggttcacgccattctcctgcctcagtctcccgagtagctgggactacaggcccccgccaccacgcctggctaattttttgtatttttagtagagacggggtttcaccgtgttagccaggatggtcttgatctcctgacctcgtgatccggccgcctcggccttccaaagtgctgggattacaggcg

SEQ ID NO: 12214 - DNA, 203 bp, Homo sapiens; identical to SEQ ID NO: 7790

SEQ ID NO: 12215 - DNA, 3571 bp, Homo sapiens
aggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaagagaaatacgagaaaagaaagtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatggtctcgatctcctgaccttgtgatccgcccgcctcggcctcccaaagtgctgggattacaggcgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctattaatcgttttagttgctattcatattctcattcgttttttaaaaactgatatattctgaatttattcttccattgagaaaaaaatgttcagttacttgtaactactgagcagaatttaatcaatcctttattaaattcagaacattattgaactcattctttgtggtcaattttctttttttttgttttgttttgttttttttttgagacggagtctcgctctgtcgcccaggctggagtgcagtggcgcgatcttggctcactgcaagctccgcctcccggggtcacgccattctcctgcctcggccacccgagtagctgggactacaggcgcctgctaccacgcccggctaattttttgtattttttagtagagacggggtttcaccatgttagccaggatggtctcgatctcctgacctcgtgatccgtccgcttcggcctcccaaagtgctgggattacaggcgtgagccaccgcgcccggcctgtggtcaattttctatgtcaagtgagtgacattatttttacaagtattttcttcttcttaaaattataccagcaaatacagttaatgcagaaacctaagtaatttgagtgtagctattcacaatctatgtgaagaatataaaatagaatgaccagttttattataaattaaggggcttaattttctaaaaaagaaaaaaaatgagccttatctctgtgttttataattatta

SEQ ID NO: 12216 - DNA, 306 bp, Homo sapiens
attattattattttttttttttgagacggagtctcgctctgccgcccaggctggagtgcagtggcgggatctccgctcactgcaagctccgcctcccgggttcacgccattctcctgcctcagcctcccaagtagctgggactacaggcgcccgccactacgcccggctaattttttgtatttttagtagagacgggtttcaccgttttagccgggatggtctcgatctcctgacctcgtgatccgcccgcctcggcctcccaaagtgctgggattacaggcgtgagcccccgcgcccggcctaaa

SEQ ID NO: 12217 - DNA, 294 bp, Homo sapiens; identical to SEQ ID NO: 7791

SEQ ID NO: 12218 - DNA, 5794 bp, Homo sapiens
  misc_feature (34)..(34): n equals a,t,g, or c
tttttttttttttttttttttttttttttttttntgagacaagagtcttgctttgtcacccaggctggagtgcagtggtgcaatctctgctcactgcaacctccgcctcccaggttcaagtgattctcctgcctcagcctcccgagtagctgggattacaggtgtgtgcccaccatgcccagttagtttttatatttttagtagagagggggtttcgccatgttggccaggctggtctcaaactcctgacctcaggtgatccgcccactcagcctcccaaagtgctgggattacagatgtgaaccaccatgcccagctggcatcaaataatttaatagttctaattatcagaaaattctgaagagtgaagttgtttttgtttttgtgtttttgagatggagtcccactctgtcacccaggctggagtgcagtggtgcgatctcagctcactgcaacctccacctcccaggttcaagcgattctcctgcctcagcctcccaagtagctgggactacagatgcccaccaccacgcccagctaattttttgtatttttagtagagacggggcttcaccatgttggccaggatggtctcaatctcttgacctcgtgatctgcctgcctcggcctcccaaagtgctgggattacaggcatgagccaccgcacccggcctttgagtgaagttttgaatgaaagcttattggtaattagaagttattttcataggttccggcttatttggattgcttaatcctaacagtcaattaaaataataagcataaaataaaagaacacagaatggaaaagaagttcaattatagtaagccctcactgaatattaattcccttactccttttctccttcacccaacaacttctagttgtatttccactgttagtaaaatgtactggatttcacttccccaccccgcgagatggagtctcgctctgtcacccaggctggagtgctatggcgcaatctcggctcactgcaacctccgcctcccgttcaagtgattctcccacctcagcttcccaagtagctgggattacaggcacctgccatcatgcctggctcatttttgtagtttgtagagtcgtggtttcaccatgttggcaaggctggtcttgaactcctgacctcagatgatcacccgccttggcctcccaaagcgccaggattacagacgagagccactgtgcccggccagatttcacttatgaagatgacagtacctagttagatgaaaagctcagaaaacttccttttaagtattgagtttcaaagtaatgtcatgtagagttttttttaatagtttaaaaaatgtattttgagaaatcacttattcctcaaaaaaataactaaaaatctaaatagtaatgatttaaccccattacattttctttagagaatcatagactattttaaatatcattcctgattggttgataaagtttccaagagatacaagggatggcctgacttgcaggcagggaaggaaggtgatgcgggagataggacgtgaggtgaggttgctggcttagtgagacactatcaggaagaatttggaaaaggaggcattttgctgtcctgtgataagatggggtgaactgctgatcagggggttgaggaaggggggattacaaaggaatacaagaaaggaactatgtgtaatatcttgaagaaagtcaaacaggtaatattagataaggaaactttcacagaagtaattcaatataaagttatgtagttggtatatttggcaaaaccaagactagaactttcttctgaattcctgttttaaagttctttcagacaggatcttgccaccattcctcagtaacccaagtttggtcattgttaaatgttaatattagaaagtaccagtacctcatagtagcaccctaaattcttattaatcaaatggggttggcttttgaagacattagtattaaaaataagatataagatggaatgaaaaattagacatgttaaaacatagattagcattttctaagctcttcttgatattctcatgtttaaaatttattttgttgctttgttaaaagaattgtttcactaaataatatactttgaatgagttagtggctagggggtttgttatgttttcctagtggtagttaggaccattgttctttaatgttttaatcttgtgtattaggtatggtgaaccgtgaagtactagaacaagtggagcgaggatacaggatgccgtgccctcagggctgtccagaatccctccatgaattgatgaatctgtgttggaagaaggaccctgatgaaagaccaacatttgaatatattcagtccttcttggaagactacttcactgctacagagccacagtaccagccaggagaaaatttataattcaagtagcctattttatatgcacaaatctgccaaaatataaagaacttgtgtagattttctacaggaatcaaaagaagaaaatcttctttactctgcatgtttttaatggtaaactggaatcccagatatggttgcacaaaaccacttttttttccccaagtattaaactctaatgtaccaatgatgaatttatcagcgtatttcagggtccaaacaaaatagagctaagatactgatgacagtgtgggtgacagcatggtaatgaaggacagtgaggctcctgcttatttataaatcatttcctttctttttttccccaaagtcagaattgctcaaagaaaattatttattgttacagataaaacttgagagataaaaagctataccataataaaatctaaaattaaggaatatcatgggaccaaataattccattccagttttttaaagtttcttgcatttattattctcaaaagttttttctaagttaaacagtcagtatgcaatcttaatatatgctttcttttgcatggacatgggccaggtttttcaaaaggaatataaacaggatctcaaacttgattaaatgttagaccacagaagtggaatttgaaagtataatgcagtacattaatattcatgttcatggaactgaaagaataagaactttttcacttcagtccttttctgaagagtttgacttagaataatgaaggtaactagaaagtgagttaatcttgtatgaggttgcattgattttttaaggcaatatataattgaaactactgtccaatcaaaggggaaatgttttgatctttagatagcatgcaaagtaagacccagcattttaaaagccctttttaaaaactagacttcgtactgtgagtattgcttatatgtccttatggggatgggtgccacaaatagaaaatatgaccagatcagggacttgaatgcacttttgctcatggtgaatatagatgaacagagaggaaaatgtatttaaaagaaatacgagaaaagaaagtgaaagttttacaagttagagggatggaaggtaatgtttaatgttgatgtcatggagtgacagaatggctttgctggcactcagagctcctcacttagctatattctgagactttgaagagttataaagtataactataaaactaatttttcttacacactaaatgggtatttgttcaaaataatgaagttatggcttcacattcattgcagtgggatatggtttttatgtaaaacatttttagaactccagttttcaaatcatgtttgaatctacattcacttttttttgttttcttttttgagacggagtctcgctctgtcgcccaggctggagtgcagtggcgcgatctcggctcactgcaagctctgcctcccaggttcacaccattctcctgcctcagcctcccgagtagctgggactacaggtgcccaccaccacgcctggctagttttttgtatttttagtagagacgcagtttcaccgtgttagccaggatggtctcgatctcctgaccttgtgatccgcccgcctcggcctcccaaagtgctgggattacaggcgtgagccaccgcgcccagcctacattcacttctaaagtctatgtaatggtggtcattttttcccttttagaatacattaaatggttgatttggggaggaaaacttattctgaatattaacggtggtgaaaaggggacagtttttaccctaaagtgcaaaagtgaaacatacaaaataagactaatttttaagagtaactcagtaatttcaaaatacagatttgaatagcagcattagtggtttgagtgtctagcaaaggaaaaattgatgaataaaatgaaggtctggtgtatatgttttaaaatactctcatatagtcacactttaaattaagccttatattaggcccctctattttcaggatataattcttaactatcattatttacctgattttaatcatcagattcgaaattctgtgccatggcatatatgttcaaattcaaaccatttttaaaatgtgaagatggacttcatgcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacttaatgtgtattcattttaaattgttctgtatttttaaattgccaagaaaaacaactttgtaaatttggagatattttccaacagcttttcgtcttcagtgtcttaatgtggaagttaacccttaccaaaaaaggaagttggcaaaaacagccttctagcacacttttttaaatgaataatggtagcctaaacttaatatttttataaagtattgtaatattgttttgtggataattgaaataaaaagttctcattgaatgcacctattaatcgttttagttgctattcatattctcattcgttttttaaaaactgatatattctgaatttattcttccattgagaaaaaaatgttcagttacttgtaactactgagcagaatttaatcaatcctttattaaattcagaacattattgaactcattctttgtggtcaattttcttttttttttgttttgttttgttttttttttgagacggagtctcgctctgtcgcccaggctggagtgcagtggcgcgatcttggctcactgcaagctccgcctcccggggtcacgccattctcctgcctcggccacccgagtagctgggactacaggcgcctgctaccacgcccggctaattttttgtattttttagtagagacggggtttcaccatgttagccaggatggtctcgatctcctgacctcgtgatccgtccgcttcggcctcccaaagtgctgggattacaggcgtgagccaccgcgcccggcctgtggtcaattttctatgtcaagtgagtgacattatttttacaagtattttcttcttcttaaaattataccagcaaatacagttaatgcagaaacctaagtaatttgagtgtagctattcacaatctatgtgaagaatataaaatagaatgaccagttttattataaattaaggggcttaattttctaaaaaagaaaaaaaatgagccttatctctgtgttttataattatta

SEQ ID NO: 12219 - DNA, 316 bp, Homo sapiens
tattctttttttttattttattttatttttttttgagacggagtctcgctctgtcgcccaggctggagtgcagtggcgggatctcggctcactgcaagctccgcctcccgggttcacgccattctcctgcctcagcctcccaagtagctgggaccacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgccggctga

SEQ ID NO: 12220 - DNA, 257 bp, Homo sapiens
tctcgctctgtcgcccaggctggaatgcagtggcgcgatcttggctcactgcaagctctgcctcccgggttcacaccattctcctgcctcagcctcccgaagtagctgggaccacaggtgcccgccaccacgcccggctaattttttgtatttttagtagagacgggctttcaccgtattagccaggatggtctcgatctcctgacctcgtgatccacccgcctcggcctcccaaagtgctgggattacaggtgtga

SEQ ID NO: 12221 - DNA, 318 bp, Homo sapiens
tttttttttttttttttttttttgagacggagtctcgctctgtcacccaggccggactgtggactgcagtggcgcaatctcggctcactgcaagctccgcttcccgggttcacgccattctcctgcctcagcctcccgagtagctgggactacaggcgcccgccaccgcgcctggctaattttttgtatttttagtagagacggggtttcaccttgttagccaggatggtctcgatctcctgacctcatgatccacccgcctcggcctcccaaagtgctgggattacaggcgtgagccaccgcgcccgcccgtgagtc

SEQ ID NO: 12222 - DNA, 3471 bp, Homo sapiens; identical to SEQ ID NO: 7793

SEQ ID NO: 12223 - DNA, 259 bp, Homo sapiens
gtctcattctgtcgcccaggctggagtgcagtggcacgatctccgctcactgcaagctctgcctcccaggtttacgccattctcctgcctcagcctcccgagtagctgggactacaggcacccgccaccacgcctggctaattttttgtatttttagcagagacggggtttcaccgtgttagccaggatggtctctatctcgtgatcttgtgatccgcccgccttggcctcccaaagtgctgggattataggcgtgaaa

SEQ ID NO: 12224 - DNA, 230 bp, Homo sapiens
tggtgcgatctcggctcactgcaagctccgcctcccgggttcacgccattctcctgcctcagccttcggagtagctgggactacaggtgctcgccaccacacctggctaattttttgtatttttagtaaagacggagtttcaccgtgttagccaggatggtcttgatctcctgacctcgtgatccgcccgcctcggcctcccaaaatgctggattacaggcgtgagccac

SEQ ID NO: 12225 - DNA, 277 bp, Homo sapiens
tcttttttttttttttttttttgacggtgtctcgctctgtcgcccagactggagtgcagtggtgcgatctcggctcactgcaagctccgcctcccgggttcacgccattctcctgcctcacctccccagtagctgggactacaggtgcccaccaccacgccaggctaattatttgtatttttagtagagacggggtttcaccatgttagccaggctggtctggatctcctgacctcgtgatccgcccgcctcggcctcccaaagtgctgggattaca

SEQ ID NO: 12226 - DNA, 296 bp, Homo sapiens; identical to SEQ ID NO: 9806

SEQ ID NO: 12227 - DNA, 301 bp, Homo sapiens
attctcttttttttttttttttgagacggagtttcactctgtcacccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcttgagccaccgcgcccggc

SEQ ID NO: 12228 - DNA, 6141 bp, Homo sapiens
ctcccgagtagctgggactacaggcacccgccaccatgcccggctaattttttgtatttttagtggagacggggtttcaccatgttagccaggatggtctcgatctcctgacctcgtgatctgcccgcctcggcctcctaaagtgctgggattacaggcgtgagccaccgtgcctggcccagtgttgagcttttcttaaaggctgtactcagtgatacagtgataacgtgttagagtcagttagccttatgttcaaatcctatttctctgatattgggaaagtcatttctagaaggtcagctttccttgtctgtaaaatgaggctgacagtgtgcaagattgaggatgcaatgagatactgatcataataaagggtttaatacagaatgcaatttcttaaataatagcttcattgtatgctcggtcacagggagaagttgaccctgtggggaaaatgtttaaaatttgaaaattctttttttttcaaccttttgagtcagggtctctctctgttgcccaggctggagctggaatgcagtggcgggatcacatctcaatgcagccttgacttcccaggctcaagtgatcctcccacttgaggatcctcccacttggccctacaggcgtgtgccaccaggcccagctaattttttttttttttttttttttttttttgtagagacgggggctcaccttgttgcctaggctggtcccgaattcctaagctcaagcaatccacctaccttggcctcccaaagtgctgggattacaggcatgagccaccatgcccggctgtgaaaattatatacattattatattaattatatagtacaaattattatatccctgagcactggcctaactgttctggattaacatctttgtacttttttttgttttagatctttcaagacatttttcccgctccttggcaacttctctcaaccagaggttcagctctgggcactatgggctatgtatcatgtctgcagtaaaaatcgtatgtattcaacatatattcaaaacataatagttttccagctatttttctgtgtaatgattaagttcaagatggatgtgcaaaaattgtctacctctgtcctctgaatttaggtgtgtttaaaaagaaactgaaaaaagatattactagcttaaagcaatgcttcagaattagtaatctatttgggggtagatagcaagcaaaataaaaagtaaaagtttgctcctacttgtattccccacagacaagcaccgttaataatttgatacctaatctcccagatacttttctatatccatgctatatttagtatgtgctgtatatatgaaatatattttttaacaaagtgggctcattctgtgcatgctgtcctatagcttggtcttttcactcaacagtttattgctgacactcttcctttagtaaaacatggacctgcttctgtgtaatggtctctgggagactgggaggccaggagtcaggggttatttcccagacagattaaatatttctgcatgttttgcaatttaaaatcccttttgaggccaggtgaggtgtctcccaaagtgctgggattacagcactttgggaggccgaggcaggagatcgcttgaggccaggagtttgagaccagccagggcaacatagcaagaccccacccatgttttttacattaaaaaaaaaattagccaggtatgtgtggcatccatctagtgaagccaaagtggaagtatcccttaagctcagatttcgagtctgcagtgatctatgttagtgccactgcactctgtcttaaaaaaataaatccccttgagattttccgttgatatcccttgttgagactgttatacaatttttcattgtatataggagatatagctatttattttacacaagaaaacccaagagacactttttagaattaaaagtttagcttgttgactagctgtaaagcaagtgtataaaacccaatagttttataatgccagcaaaaatcagaaaatgtaataagggaaaatataccaccactcactttattaacaaaaacataaagtattttaaaatgcctttaacaggtaatgagacatgcagtaaactatgagataatttaaaagcctgaaataattatgagaccattccattttctaagatggaatgacctattagatatatagatgtcatttcttttcagtttattaatgtaatataattcaactgaataggtaagagatggaggatctgaaaattattctaaagtttatctgacagaatcaacaggaaagaactaacaaaaatgtttgtttgtttttttctgagacggagtttcactcttgttgcccaggcgggagtgcaatggtgctatcttggctcactgcaacctctgcctcctgggttcaagcaattctcctgcctcagcctcccgagtagctgggattacaggtgcccaccaccacacctggctaatttttgtatttttgttagagacagagtttcaccatgttggccaggctggtctcgaacttgtgacctcaggtgatctgcccgcctcagcctcccaaagtgttggaattacaagcatgagacactgcatctggccagaaaaatgttttttatgggctcagcctggtggctcagacttgtattcccagcactttgggaggccaagataggaggatcacttgtgcaggaattcaaggccacagtgagccatgatcaggcaactgcctacttccagcctggggaacagagcaagactcctgtctctaagataagaaagaaggaaagaaatgtggtttttaggagcttgcacatagacttctcttaacattgtaaaatggtgccatgagtggttctgacgtatgaatagatagatagcagatgattggatcagaatagccctgaaacagactcatacagttataacaggagaaactaaccgaaactagaattcagttgagtacttattatgtgccaggcaatgttgtaagcactttatgaataactcatttaatcttcacaacaactagaagggtaagcatcttattttattttatttttaaaatttatttaattttaatttagtttaatttattttatttttgagacagggtctcacttcattgccaaggctgaagtgcagcggcttgatcacagctcactgcagtctcagctcaggtgatgctgtcacctcagcctcccaaatagctgggactatgggtatacaccaccatgcctggggttctccccaaaaagagcaacccttacagtatttttatcagcatcatgttagatttataagtcaacctaaagataattcccatccctatgacaaatgagtatttctttaaaaaaagtatttaattttttttcttttaaattaaaaaaaaaaacacctcaaaacaaaaagcaacagggtcttgctatgttgcccaggctggttgtgaactcctgggcttgagtgatcctcttgcatcagcctcccaaagtgctaggattacaggcatgagccaccatgttcagccacaaatgagtatttctatccaagaacatgactaataaatatattttagttctaccttgttttcatatccttaaagatagtttaggtgttactattttacagtcaaggcttatttcaatttgctaaataccattttttttttttttttgagatggagtctcgctctgtcacccaggctggagtgcagtggtgcactcttggctcgctgcaagctctgcctcccgggttcacgccattctcctgcctcagcctcccaagtagctgggactacaggcgcccgccaccatgcccggctaaatttttttgtatttttagtagagacggggtttcactgtgttagccaggatggtctcgatctccggacctcatgatccacccgccttggcctcccaaagtgctgggattacaggcgtgagccacggcgcctggcctcaatttgctgaataccattttctttgctcatcactgcttgttttttttttttttttcttttttttaacccccaccactccttttctggattcaggttttgatagtgcattactgacaaaatctctttgtcaccccacccctattcttactcttaaataataatatagctggatgtagaattccagatagttacttactttattttagcatttgggagaaaaatattttcttttagttttttttttttttttttttttttggagacagtctctgtcgcccagactggagtgcagtggcgtgatctctgcctcataggttcaaggggttcccctgcctcagcctcctgggtagctgggactataggcatgcaccaccatacctggctaattttttgtgtatttttagtagaaaccgggtttcatcatgttggccattctgggtctcaaagtcctgaccttagatgttcgcctcagcctcccagagtgctgggattacaggcatgagccacgacacctggccattttcattattttctattgttgctgttggggtctactgtcagcctaattatcatttcttgataggtaatttttcttttacttttttttttgaaacagggtctcactctgtcgcccaggctggagtgcagtggcacagtcacagctcactgctgcttcaacctgggctcaggtgactctcccacttcagcctcctgaatagctgggactatgtagcatcacacccagctaatttttttattttttgtagacacatggtctcactacattgccttgatcctcctgcccaggcatcctaaagtgcttagattacaggaatgaaccactatgtctggcctatttctctttaactgggtctaaatctttttcttttcttttcttttttgagacagtttcgctcttgttgcctaggctggagtgcagtggcatgatctcagctcactgcaacctctgcctcctgggttcaagtgactctcctgcctcagcctcctgagtagctgggattacagaggcccaccactatgcccgtctaagtttttgtatttttagtagagaagggatttcaccatgttggacaggctggtctcaaactcctgacctcaggtgatccacccacctcagccttccaaagtgctgggattataggtgtgagccaccgtacccagccaactgggtctaaatctgctcttggactgtctttaatttcagtgatacatttttaaatgtctgaactttttatttgcttcttttccagatattcctattttttttcttctttaaaagtaattattttgtggtctttatctgatcttattatgtgtgttatgttgagtgggggcagttttggattgtgaagtcaactttagcagggcttatttttctgagaattcattttagaatggattggcgtgtccctgaggcggttttgtattcgcttctgtgaagtgctccagaggtttccataggcttgtgctcgtttttttatattaatttctcagcaatattcaggtagtgtaaactcaaaccttattacccacttgggattgtggtcatgagaagatttctcctctcctactcccgtatacccctacagccccatccatgacagagatgcttcagtatcttatcccttttcttatctagccctttgtgggtctacttttatgtaggaatattgcctccaactctgcaagctgaaattgaaatgcctcaattactaagaccgccagtttctttctgccgcaggctaagctgcaggttagcttacactagctgaagtgctctttgtttccagctcctggaaaattcctttagtttgtacattcatctatgcattaaaaaatttgtgaattatattttatttaacatctggtgttttttattttgagacagagtctcgctctgtcgcccaggctggagtgcagtggcgtgatctcggctcactgcaagctcacctcccaggttcacgccattctcctgcctcagcctcccgagtagctgggactacaggtgcccacgaccacgcccagctaatttttttgtatttttagtagagacggggtttcaccgtgttagccaggatggtctcgatctcctgacctcatgatccgcccgcctcggcctcccaaagtgctgggattacaggcgtgagccactgcgcccagccact

SEQ ID NO: 12229 - DNA, 299 bp, Homo sapiens
ttttttttttttttttttttttttagatgtaatctcactctgtcgcccaggctggagtgcagtggcgagatctcggctcactgcaagctctgccccctgggttcacgccattctcttgcctcagcctccccagtagctgggactacaggtgcccaccaccatgcctggctaattttttgtatttttagtagagacggagtttcaccgtgttagccaggatggtcttgatctcctgacctcgtgatccgccggcctcggcctcccaaagtgctgggattacaggcgtgagccaatgcacc

SEQ ID NO: 12230 - DNA, 288 bp, Homo sapiens
ttttttttttttttttttttttttgagacggagtctctgtcatcacccaggctggcgtgcagtggcgcgatctcggctcactgcaagctccacctcctgggttcacgccattctcctgcctcagcctccggagtagctgggactacaggcgcccgccaccacgcccggctaattttttgtatttttggtagagacggggtttcaccgtgttagccaggatggtctctatctcctaaccttgtgatccacctgcctcggcctcccaaagtgctgggattacaggcgtga

SEQ ID NO: 12231 - DNA, 275 bp, Homo sapiens
tttttttttttttttttttttttttttgagacggagtctcactctgtcgcccaggctggagtgcagtggtgcgaggtcggctcacagcaagctccgccttcctggttcacgccattctcctgcctcagcctcccaagtagctgggactacaggcgcccaccaccacacctggcatttttttttgtatttttagtagagacggggtttcaccgtgttagccaggatggtctcgatctcctgacctcatgatccgcctgcctcggcctcccaaaggg

SEQ ID NO: 12232 - DNA, 254 bp, Homo sapiens; identical to SEQ ID NO: 9808

SEQ ID NO: 12233 - DNA, 311 bp, Homo sapiens
ttttttttttttttttttttgagatggaatcttgctctgtcgcccaggttggagtgcaatgtggcacgatctcagctcactgcaagctctgcctcctgggttcacaccattctcctgcctcagcctcctgagtagctgggactacaggtgcccgccaccacgcccggctaattttttgtatttttagtaaagatggggtttcaccgtgttagccaggatggtctcgatctcctgacctcatgatccgcctgcctcggcctcccaaagtgctgggattacaggcgtgagccaccgcgcccgtcaatggaata

SEQ ID NO: 12234 - DNA, 181 bp, Homo sapiens
tcagcctcccgagtagctgggattacaggtgcccaccaccatgcctagctaattttttgtatttttagtagagacggggtttcactgtgttagccaggatggtctcaatctcctgacctcgtgatctgcctgcctcggcctcccaaagtgttgggattacagtcatgagccaccatgccca

SEQ ID NO: 12235 - DNA, 183 bp, Homo sapiens
tcagcctcccgagtagctgggactacaggtgcccaccaccacacctggctaatttttttgtatttttagtagagacggggtttcaccatgttagccaggatggtctcgatctcctgacctcatgatctgcctgcctcagcctcccaaagtgctaggattacaggcgtgagccaccgcgcccag

SEQ ID NO: 12236 - DNA, 301 bp, Homo sapiens
  misc_feature (204)..(204): n equals a,t,g, or c
cgaagaataacttttttttttttttttttgagacggagtctcactctgtcgcccaggctggagtgcagtggcacgatctcggctcactgcaagctccgcctcccgggttcacgccattctcctgcctcagcctcctgagtagctgggactacaggcgcccaccaccacgcctggctaattttttatatttttagtagagacggngtttcaccgtgttagccaggatggtctcgatctcctgacctcgtgatccgcccgcctcggcctccccaagtgctgggattacaggcgtgagccaccg

SEQ ID NO: 12237 - DNA, 182 bp, Homo sapiens
tcagcctactgagtagctgggactacaggtgcccgccaccgcgcctggctaattttttgaatttttagtagagacggggtttcaccatgttagccaggatggtctcgatctcctgacctcgtgatccgcccgccttggcctcccaaagtgctgggattacaggcgtgagccaccatgcccag

SEQ ID NO: 12238 - DNA, 192 bp, Homo sapiens
ttctgcctcaccctcccgagtagctgggactacaggcacccgccaccacgcctggctaattttttgtatttttagtagagatggggtttcaccttgttagccaggatggtctcaatctcctgacctcgtgatccgcccacctcagcctcccaaagtgctgggattacaggcgtgagtcaccgcgccagcccc

SEQ ID NO: 12239 - DNA, 292 bp, Homo sapiens
agagtttgttttgttttgttttgtttgagatggagtctggctctgccacccaggctggagtgcagtggcgcgatctccgctcactgtaagctccgcctcccgggttcacgccattctcctgcctcagcctcccgagtagctgggactacaggcgcccgccaccacgcccagctaattttttgtatttttagtagagacgaggtttcaccgtgttaggcaggatggtctcgatcttctgacctcgtgatccgcccacctcggcctcccaaagtgctgggattacaggcgtcag

SEQ ID NO: 12240 - DNA, 263 bp, Homo sapiens
ttttttttttttttgagatggagtctggctctgtcgcccaggctggagtgcagtggtgcagtctcggctcactgcaagctccgcctcctgggttcacggcattctcctgcctcagcttcccgagtagctgggactacaggcacccgccaccacgcctggctaattttttgtatttttagtagagacggggtttcaccgtgttagccaggatggtctcgatctcctcatctcgtgatctgcctgcctcggcctcccaaagtgct

SEQ ID NO: 12241 - DNA, 3905 bp, Homo sapiens; identical to SEQ ID NO: 9811

SEQ ID NO: 12242 - DNA, 153 bp, Homo sapiens
tcagcctccccagtagctgggactacaggtgcccaccaccacgcccggctaattttttttgtattttttagtagagacgaggtttcaccgtgttagccaggatggtctcgatctcctgacctcatgatccacccacctcggcctcccaaagtg

SEQ ID NO: 12243 - DNA, 275 bp, Homo sapiens; identical to SEQ ID NO: 9812

SEQ ID NO: 12244 - DNA, 248 bp, Homo sapiens
gctgatctatttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacc

SEQ ID NO: 12245 - DNA, 264 bp, Homo sapiens; identical to SEQ ID NO: 9813

SEQ ID NO: 12246 - DNA, 237 bp, Homo sapiens
gagatggagtctcgctgttgcgcaggctggagtgcagtggggcgatctcggctcactgcaggctctggcccgcggggttcacgcctttctcctgcctcagcctcccgagtagctgggactacaggcgcccgccacatcgcccggctaattttttgtatttttagtagagacggggtttcaccgtgttagccatgatggtctcgatctcctgacctcgtgatccgcccgcctcggtct

SEQ ID NO: 12247 - DNA, 310 bp, Homo sapiens
ttttcttttcttttttttttctgagacagagtctcactctgttgcccaggctggagtgcagtggcgtgatctcagcttactgcaagctccacctcccgggttcatgccattctcctgcctcagcctcccgagtagctgggactacaggtgcccaccaccatgcccggctaatttttttgtatttctagtagagacggggtttcaccgtgttagccaggatggtctcgatctcctgacctcgtgatctgcccgcctcggcctcccaaagtgctgggattacaggcgtgagccaccacgcccggccctcagt

SEQ ID NO: 12248 - DNA, 188 bp, Homo sapiens
cttccgggttcacgccattctcctgcctcagcctcccgagtagctgggactacaggtgcccgccaccgcgcccggctaattttttggtatttttagtagagacggggtttcaccgtgttagccaggatggtttccatctcctgacctcgtgatccacccgcctgggccttccaaagtgctgggattac

SEQ ID NO: 12249 - DNA, 280 bp, Homo sapiens
tttttcttttcttttttttttttttttttttttttttatttatttttttttttttgagacggagtctcgctctgtcgcccaagctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccg

SEQ ID NO: 12250 - DNA, 278 bp, Homo sapiens
attcttttttttttttttttttttgaaacggagtctcggtctgtcacccaagctggagtgcagtggcgcaatcttggctcactgcaagctccgcctcctgggttcacgccattctcctgcctcaacctcccgagtagctgggactacaggcgcccaccaccacgccgggctaatttttgtatttttagtagagatggggtttcaccttgttagccaggatggtctcgatctcctgacctgttgatccgcccgcctcggcctcccaaagtgctgggatt

SEQ ID NO: 12251 - DNA, 176 bp, Homo sapiens
tcagcctcccgagtagctggaactacaggcgcccgccaccacgcctggctagttttttgtatttttagtagagatggggtttcaccatgttagccaggatggtctcgatctcctgacctcatgatctgcccaccttggcctcccaaagtgctgggattacaggcgtgagccactgc

SEQ ID NO: 12252 - DNA, 237 bp, Homo sapiens
tcttttttttttttttttttttttgagatggagtctcactctgtcacccaggctggagtgcagtggcgcgatctcagctcactgcaagctccacctggattcacgccattctcctgcctcagcctcccgagtagctgggactacaggcgcctgccaccacgcccggctaattttttgtatttttagtagagacggggtttcaccatgttagccaggatggtctccatctcctgacct

SEQ ID NO: 12253 - DNA, 238 bp, Homo sapiens
gtttgtttttgtttttgttttttgagacagagtctccctctatcacccaggctggagggcagtggcactatctcagctcactgcaagctccacctcccaggttcacgcctttctcctgcctcagcctcccgagtagctgggactacaggcgcccgccaccacgcctggctaattttttgtatttttagtagagacagggtttcaccgtgttagccaggatgatctcgatctcctgacc

SEQ ID NO: 12254 - DNA, 300 bp, Homo sapiens
ttttttttttgagacagagtcttgctctgttgcccaggaggctagagtgcagtggcgcgatcttggctcactgcaagctccacctcccaggttcacgccattctcctgcctcagcctcccgagtagctgggactacaggtgcccgccaccacgcccggctaattttttgtatttttagtagagacggggtttcaccgtgctagccaggatggtctcgatctcctgaccttgtgatccgtccgcctcggcctcccaaagtgctgggattacaggcgtgacccaccgcgcccagccaaaaat

SEQ ID NO: 12255 - DNA, 294 bp, Homo sapiens
agcttttttttttttttttttgagacagagtctcgctctgttgcccgggctggagtgcagtggcgcgatctcggctcactgcaagtccgctcccgggttcacgccattctcctgcctcagcctcccgagtagctgggactacaggcgcccgccaccacgcctggctaattttttgtatttttagtagagacagggtctcaccgtgttagccaggatggtctcgatctcctgaccttgtgatccgcccgcctcggcctcccaaagtgctgggattacaggcatgagcctccaagc

SEQ ID NO: 12256 - DNA, 281 bp, Homo sapiens
tgttgtcctttttctttttcttttttttttttttgagacggagtctcgctctgtcgcccaggctggagtgcggtggcgcgatctcggctcactgcaagctccgcctcccgggttcgcgccattctcctgccccagcctcccgagtagctgggaccacaggcgcccgccaccgcgcccggctcattttttgtatttttagtagagacggggtttccccgtgttagccaggatggtctcgatctcctgacctcgtgatccgcccgcctcggcctcccaaagtg

SEQ ID NO: 12257 - DNA, 277 bp, Homo sapiens; identical to SEQ ID NO: 9818

SEQ ID NO: 12258 - DNA, 221 bp, Homo sapiens
tttttttgagacagagtctcactctgtcgcccaggctggagtgcagtggcacgatctccgctcactgcaagctctgcctcccaggtttacgccattctcctgcctcagcctcccgagtagctgggactacaggcacccgccaccacgcctggctaattttttgtatttttagcagagacggggtttcaccgtgttagccaggatggtctcgatctcgtgac

SEQ ID NO: 12259 - DNA, 309 bp, Homo sapiens
ttttattttttatttttattattattttttatttttatttttattttttgagacggagtctcgctctgtcgcccaggctggagtgcagtggcgggatctcggctcactgcaagctcagcctcccgggttcacgccattctcctgcctcagcctcccaagtagctgggactacaggcgcccgccactacgcccggctaattttttgtatttttagtagagacggggtttcaccgttttagccgggatggtctcgatctcctgaccttgtgatccgcccgcctcggcctcccaaagtgctgggattacagg

SEQ ID NO: 12260 - DNA, 310 bp, Homo sapiens
attttttttttttttttttttttttttttgagacggagtctcgctctgtcgcccaggctggagtgcagtggcgggatctcggctcactgcaacctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccgtcc

SEQ ID NO: 12261 - DNA, 277 bp, Homo sapiens
  misc_feature (50)..(51): n equals a,t,g, or c
  misc_feature (58)..(58): n equals a,t,g, or c
gagacagagtctcactctgtcgcccaggctggagtgcagtggcgcgattnnggctcantgcaagctccgcctcccgggttcacgccattctcctgcctcagcttcccgagtagctgggactacaggtgcccgccaccacgcccggctaattttttgtatttttagtagagacggggtttcactgtgttggccaggatggtctcgatctcctgacctcgtgattcgcccaccttggccccccaaagtgctgggataacaggcatgagccaccgcgccc

SEQ ID NO: 12262 - DNA, 273 bp, Homo sapiens; identical to SEQ ID NO: 9819
  misc_feature (256)..(256): n equals a,t,g, or c

SEQ ID NO: 12263 - DNA, 279 bp, Homo sapiens; identical to SEQ ID NO: 9820

SEQ ID NO: 12264 - DNA, 225 bp, Homo sapiens
ctccgcctcccgggttcacgccattctcctgcctcagcctctcgagtagctgggactacaggcgcccgccaccaagcccggctaattttttgtatttttagtagagacggggtttcaccgtgttagccaggatggtctcgatctcctgacctcgtgatccgcccgcctcggcctcccaaagtgctgggattacaggcgtgagccaccgcacccagcctacaatga

SEQ ID NO: 12265 - DNA, 295 bp, Homo sapiens
ttttttttttgagacagagtctcgctctgtcacccaggctggagtgcagtggtgtgatctcggctcactgcaagctctgcctcccgggttcatgccattctcctgcctcagcctcctgagtagctgggactacaggtgcccaccaccacgcctggctaattttttgtatttttagtagagatggagtttcaccgtgttagccaggatggtctctatctcctgacctcgtgatccgcctgcctcggccttccaaggtgctgggattataggcgtgagccaccgcgcccggccggca

SEQ ID NO: 12266 - DNA, 243 bp, Homo sapiens
aattttttttttttttttttttgagacggagtctcgctctgtcgcccaggctggagtgcagtggcgtgatctcggctcactgcaagctccgcctcccaggttcctgccattcttctgccttagcctcccgagtagctgggactacaggcgcccaccaccacgcccggctaattttttggatttttagtagagacggggtttcaccgtgttagccaggatggtctcgatctcctgacctcgtga

SEQ ID NO: 12267 - DNA, 320 bp, Homo sapiens; identical to SEQ ID NO: 9822

SEQ ID NO: 12268 - DNA, 311 bp, Homo sapiens
  misc_feature (11)..(11): n equals a,t,g, or c
ttttttttttnttttttgagacggagtctcgctctgttgcccaggctggagtgcagtggcgccatctcagctcactgcaagctccgcctcccgggttcacgccattctcctgcctcagcctcccaagtagctgggaccacaggtgcccaccaccatgcctggctaatttttttgtatttttagtagagacggggtttcaccgtgttagccaggatggtctcgatctcctgacctcgtgatccacccgcctcggcctcccaaagtgctgggattacaggcgtgagccaccgcacccagcctcttcctcttct

SEQ ID NO: 12269 - DNA, 274 bp, Homo sapiens; identical to SEQ ID NO: 9823

SEQ ID NO: 12270 - DNA, 308 bp, Homo sapiens; identical to SEQ ID NO: 7794

SEQ ID NO: 12271 - DNA, 300 bp, Homo sapiens; identical to SEQ ID NO: 9824

SEQ ID NO: 12272 - DNA, 279 bp, Homo sapiens
tttgttttgttttgttttttatttgagacggagtcttgctctgttgcccaggctggactgcagtggcccgatctccgctcactgcaagctctgcctcctgggttcacaccattctcctgcctcagcctcccaagtagctgggactacaggcgcccgccaccacgcccggctaattttttgtatttttcatagagacagggtttcaccgtgttagccaggatggtctcgatctcctgacctcgtgatctgcccgcctcggcctcccaaagtgctgggatt

SEQ ID NO: 12273 - DNA, 266 bp, Homo sapiens
tttcttatttctttttttttgagatggagtctcgctctgtcgcccaggctggagtgcagtggtgcgatctcggctcactgcaagctccgcctcccgggttcacaccattctcctgcctcagcctcccgagtagctgggaccacaggcgcccaccaccacgcccgggtaatttttttgtatttttagtagagacggggtttcaccgtgttagccaggatggtctcgatctcctgaccttgtgatccgcccgcctcggcctcccaaat

SEQ ID NO: 12274 - DNA, 322 bp, Homo sapiens; identical to SEQ ID NO: 7795

SEQ ID NO: 12275 - DNA, 5125 bp, Homo sapiens
accccaccgtgaaggacctcatcagctttggcctgcaggtagcccgcggcatggagtacctggcagagcagaagtttgtgcacagggacctggctgcgcggaactgcatgtgagagtccagagtagctggggtgaagcaaaaggacagggcatgagggtgtgcggtgctcaaggccgcctcagggaagggcccactccagccttgtcctcccctctctgcaccttactttttttgtctgcccagtgcagacttggactggacactgtggctttgaaatttggccaggcgcggtggctcacgtctgtaatcccagcactttgggaggctgaggaaggcggatcatgaggtcaggagatcgagaccatcctggctaacacggtgaaaccccgtctctactaaaaatacaaaaagattagccaggcgtggtggcgggcccctgtagtcccagctactcaggaggctgaggcgggagaatggcgtgaccccaggaggcagagcttgcagtgagcggagatcgcgccactgcactccagcctgggtgacagagcgagactccgtctcaaaaaaaaaaaaaattctgtaagggcctagaacaggtgggttcagggcctggtaagggccagtcctaagtgtgatcctctccctacccctaaggctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtggtgaggccccacctgccctacagtccacatggctttggcacccaagaacactgggcctcacccattcagctctgaatgatctgagcccagggagtccccagggtagatgacccccacagcccatctgctcacctcttgggcagatgtaagatggaatctgacacctgccagggctagaggaggctgggaactcactggctcctcacagataatccagggcctgcccagccccaactctgggtaggatgaggtagtgggaggagacagaggaaagacacaggtgatgtattgaggaatgagctctcagtggagggtagggtcttccatttccagctgaaggactctgggaggtagaagcccctgggggacccacctgcccccaaatttggggtgagttgagtcccctcacctccccctttccacagtggtcatttggtgtgctgctgtgggaactgctgacacggggtgccccaccataccgccacattgacccttttgaccttacccacttcctggcccagggtcggcgcctgccccagcctgagtattgccctgattctctgtgagtatgtggaggtggtagtggggagggaactgggccccagagacatggaagagacaggagacagagctcctgcctggcttcctgactgaacttctggttgactaggaaagggactctcgctgggcctcaatttcctcatctgtgaactggtcccaccctcatgcagagtaggaccctgggaggacctcacagttgccatggtaacagcattctgagctcagagttggggttgaggcccgtggtttgattttcccagtgctcctcctacccgactcccactaacggggtctgctttccaccttttcctctcatttaatctcgaggaaagattccataacccccacagcaaccccctctggatctccaggtcaggttttttcactgtatgtggtttcagattccccattcctggagggatggcggcagctgcattgtcctcagtgcctacggggtgggttcggtgctgaggttcagcttcatacgtagcaggtgtgcctgagctgtggctaggtctgctgggttagaacagagagaaccaggacataggtaaaagtagttaacgcctcctgtctcaggctgtgctccaagaaggatgcgagtagcccttcctcacagtcctacctgccttgggtttgctcttactattcacttctttaattcactgcctacccatatccagattgggctcctggaaacagactcagctggagatttatgtacggggatttactgagaggttgggggcaagggaagaaggactgggcaggagaaatgtcacagaaactgcagcccatcccacagggactgcttgaactgggatgacccaccacagttttctgaaattgagaccaacaggccaggtctttgtaccaggcattaatcagttactagtcacaggctgtccctggtgaggggatgtgagcttggcagaggcagttctcttctgcctagggcaattcctagagagagcctcagtcaagaaccatcagcaggcaacactcctagccactgggaaagtaaaggggtatctgggtggcacaccatagggtccacttcagcagtccagcccttctcctctctgggcctcaatttcctcatctgtaaagtggagacaacagtaccaccttccgagagtctgagaattatatgagatattgtgtgtagggtagagtattatttcaggcaggaatgacatccccaagataatggggcaggcactaggacccagcaggtaaacctggggaacctctgcttcaggaccagggtgccactggtgctgccccaaatgctcttgcttcagaatttttttttttttttttgagacagagtctcactctgatgcccaggctggagtgcggtggcgcaatgttggctcactgcaacctctgcctcccaggttcaagtgattctcctacctcagcctcctgagtaactgggactacaggcgtgtgccaccacgcccagtaattttttttttttttttttgagatggagtctcgctctgttgcccaggctggagtgcagtggtgcaatctcggctcactgcaagctccgcctcccgggttcacgccattctcctgcctcagcctcccgagtagctgggactacaggcgcctgccacgacgcccggctaatattttgtgtttttagtagagacggggtttcactgtgttagccaggatggtctcgatctcctgacctcgtgatccacccaccttggcctcccaaagtgctgggattacaggcgtgagccaccacgcccagctttgcccagttaatttttgtatttttagtagagatggggtttcactatgttggccaggctggtctcgaactcctgacctcgtgacctgcccacctcagcctcccaaagtgctgggattacaggcatgagccactgcccccggccacttcaggatttttaattcctgctttgctggacccaggcttccttcctggaagaactgtgatgatgaccattgtacctcgtgagctgggccttgtgcctagcacttcacaggcatcagcctatatgcctacttctctgtgatcagaggaggacccagaggcacagagaagttaaggaacttatccaagatcacatagcccaggccacagggcacaggagcccaagctcttaacacctgaggtagttcgacctctgccagggtgggaaggcaggactggaacagtaatcatagggatgagaagagctgcccctgattgggtagtgctaggtactaggtcctgtcatctatcctcatccctgtgtggcctgccagaggtttaacagcaagtgggtggcccagaatccttgggtggaaattgccttaacctgacatccctttcccccaacaggtaccaagtgatgcagcaatgctgggaggcagacccagcagtgcgacccaccttcggagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaagctgcctctgggccatgccaggccagagggcagtggccctccaccttgttcctgccctttaactttcagaggcaataggtaaatggggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaattgtagcaaacagtgtgaaagaatgacaggaggctgctataaatagctgaatagagaggcaagggaagcctcccaggaggtgacattttgctgaggccttatcaaccggggaaaaaccaccagaaacagtgttgaggaaagagggtttttggcagagagtcacacatgcaaagaccctgaggctggaaaggagttggatcagcaagaaggattttgagaacagggagggtgagcaaggcccagatccaggtcctagggctctggggactgttagatggaaccaaggaagtaggctgagtacccaagcatgcagtgaccaggatggtttcttccatggctcaggctgcctcctcccctttccccagccctagcacttctccagggctccctgctcgatctgcagtgcccaccgtcacaccatccaggatggaatggggcctgccatctggggcatagaggcttgggtcccagcaacactgccagcattgattgcgcttgtagccttaagagagataagccagcagcaaggcctcaactccacactttctttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgtccgccaccgcgcccggctaattttttgtatttttagtagagacggggtttcaccttgttagccaggatggtctcgatctcctgacctcatgatccacccgcctcggcctcccaaagtgctggga

SEQ ID NO: 12276 - DNA, 41 bp, Homo sapiens
tcctgcctcagcctcccgagtagctgggactacaggcacct

SEQ ID NO: 12277 - DNA, 4727 bp, Homo sapiens; identical to SEQ ID NO: 9828

SEQ ID NO: 12278 - DNA, 270 bp, Homo sapiens; identical to SEQ ID NO: 9829

SEQ ID NO: 12279 - DNA, 296 bp, Homo sapiens
tttttttttttttttttgagacggagtctcgctctgtcgcccaggccggactgcggactgcagtggcgcaatctcggcttactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccg

SEQ ID NO: 12280 - DNA, 160 bp, Homo sapiens
ctgcctcagcctcctgagtagctgggactacaggcgcccaccaccacgcctggttaattttttgtatttttagtagagacggggtttcaccatgttagccaggatggtctcgatctcctgacctcgtgatccaaccgccttggcctcccaaagttctggg

SEQ ID NO: 12281 - DNA, 237 bp, Homo sapiens
tttctttctttctttttttcttttcttttttttttttttgagacggagtcctgctcagtcgcccaggctggagtgcagtggcgcgatctccgctcactgcaagctccgcctcccgggtccacgccattctcctgcctcagcctcccgagtggctgggactacaggcgcccgccaccacgcccggctaattttttgtatttttagtggagacggggtttcaccgtgttagccaggatg

SEQ ID NO: 12282 - DNA, 186 bp, Homo sapiens
tcagcctcccgagtagctgggactacaggtgcccaccaccatgcccagctaattttttgtatttttagtagagacttggtttcaccgtgttagccaggatggtctcaatctcctgacctcatgatccacccgcctcagcctcctaaagtgctgggattacaggcatgagccaccgtgcccagccaa

SEQ ID NO: 12283 - DNA, 307 bp, Homo sapiens; identical to SEQ ID NO: 7796

SEQ ID NO: 12284 - DNA, 306 bp, Homo sapiens
agtctttttttttttttttttgagacggattctcactctgtcgcccaggctggagtgcggtggcgcgatctcggctcactgcaagctccgcctcccgggttcacgccattctcctgcctcagcctctctgagtagctgggactacaggtgcccaccaccacacccggctaattttttgtatttttagtagagacagggtttcaccgtgttagccaggacggtctcgatctcctgacctcgtgatccgcccgcctcggcctcccaaagtgctgggattacaggcgtgagccactgcgcccggcccca

SEQ ID NO: 12285 - DNA, 5775 bp, Homo sapiens; identical to SEQ ID NO: 9834

SEQ ID NO: 12286 - DNA, 738 bp, Homo sapiens; identical to SEQ ID NO: 9835

SEQ ID NO: 12287 - DNA, 214 bp, Homo sapiens; identical to SEQ ID NO: 7797

SEQ ID NO: 12288 - DNA, 129 bp, Homo sapiens
ccgggcacggtggctcatgcctgtaatcccagcactttgggaggccgaggcgggtggatcacgaggtcaggagatcaagaccatcctggttaacatggtgaaaccccatctctactaaaaatacaaaaa

SEQ ID NO: 12289 - DNA, 126 bp, Homo sapiens
gatcctacgacaggacccagatgccagtgaaagtgaccacagccctgctctagtcaccccggaagctgaccagtctacgcacggccgaagcttcgtcaaggaagtaaatgtagttagaaatcttaa

SEQ ID NO: 12290 - DNA, 1669 bp, Homo sapiens
  misc_feature (7)..(7): n equals a,t,g, or c
gtgtganagactgggtcttgctctgttgcccaggccggaatgcggtggcaggatcagtgctcactgcagccttgacctcctgggcctacatatcctccagcctcagcctcccaggtagttgggaccacagtcatgagccaccatgcctggcaaattttttacaattttttttttttttggtagagataggatctcccatttccctatgttgtccaggctggtctcaaactcctgggctcaagtggtcctcctgctttgtttggccttctaaagtgctaaaatttacaggcgcggccactgtgcctggctttttctacacttgtttctttccttagctagagctattagaaatgaagagctgcttgctggtgggagcacagtaaatgtgagctgccatctacttactactggatccaagatgcttgaaagcaaaactcttctgttcagggatgacctgaggatgtaagaataattaagagtgatggaactttttcttttttgaagagttggagtctcactctgtcatgcaagctaaagtgacacacgatcatggctcactgcagccttgaactcctgagctcaagcagtccttctgtctcagtctctctagtagctaggactgcagatgtgaatcaccacacctagctaactaaaagaaaatctttttttaagagacagggtctcactatgttgcccaggctgaaagaactttaatatttatgtgtacttgtttatgtagtgtagaaccttccctcccatgttgatattattaatttgggaaagaaagggggtcgatgaccacttgtaaagaattgtgcccttggaattttgtgtggttcttttttgtttttgacttgttagggagaatgtcaaacatatataaaagtagactaaacagtgagatgaacatccaaatatccattattcaaagattgcttctgtaataaactcacagccaatgcggtttcatctgtacccacacccctttcttcttttcatatattttttttcattttaagcatttgcaataacttatttacctaaccacctattggtagatatttgagtattaaaccattaaaaaatttttgtaattaataccctttcttgctttgtggtcttgtgtgagttttttaaagataaattccctagaaggggtgttgggtcaaaggacatgcattaggcatgttttagtttttgtaattttcttccaattttgagatgtcatcacattgctttccaacaaacctgtactaatttacgtttttgctgagttctcactttgtctttcacctagaatcactgtttgctttctctctttgtcttttatatatgtgtatatatgtaatatatgtatatataggcatatatatgtatttatatagtcccctgtgaaacatttgaggctctattgcagacattataactcagtactcttaatactttaatgtacatctctaagaataagacattttcctaatgtaattgtgtgatcacaatacagtgaccacacttttaaaacttaaaaaaattccaaatatcagtttgttttattggtaaatattttagtgtgccagacattaagtcctctttgttgttgttgaaacataaacaaaatactgtttttttaatgctttcaaagaggaaggcattgcaaaaaaaaaaaaaa

SEQ ID NO: 12291 - DNA, 315 bp, Homo sapiens
ctgggctgggtgatttctttttttttttttttttttattgagacggagtctcgctctgtcacccaggctggagtgcagtggtgcgatcttggctcactgcaagcttcgcctcccgggttcacgccattctcctgcctcagcctcccaagtagctgggactacaggtgcccgccaccacgcccggctaattttttgtatttttagtagagacaggtttcgccgtgttagccaggatggtctcgatctcctaaccccgtgatccacctgcctcggcctcccaaagtgctgggattacaggcgtgagccactgcggcc

SEQ ID NO: 12292 - DNA, 122 bp, Homo sapiens
cacgcctgtaatcccagcactttgggaggccggggtgggcggatcacgaggtcaggaaatcaagaccatcctggctaacacggtgaaaccctgtctctactaaaaatacaaaaaattagccg

SEQ ID NO: 12293 - DNA, 1238 bp, Homo sapiens
ttaagtggtctgcccttccactgaaagtgtagctttttgacagtctcagccatataaacaggatctcagtttcatccttccatccatccattagaggcacaaggtctcatctcttttccttttgggcattaaaaccaaagttcatacattattgagacaggccgactctgctaaggcagcctgtttggcctttaagttttattgcttattttttgagtatgtatttatttttttgattattattattttttttttgagctttaagccttcaagtttcctttttattcttgacccctagacatttcctttgcttgtggactcgggtatttgtttttaggtaatattttttttccctatgacacagccctcaggagatcctgagaacatgtgccctcatttttaggtaattttaattaggaagggttttaggttgtctgatctgccttgttgctagaaacagaaattctcctattgattgatttttcaaaccacttcttagtggcctctacaactactccagtcaggtcaagaatggctctcacattgccaagtcagtgggtatttttagtcttcatcttagatgacctttatgcacatttgtctttgtctaggaacttctgttggaaacatcttctattttaatgttattttaaatttttttgcttttgtaacattatgcttagcatgtgtgtccaactctttgacaatttctttttagttttctggtggcttccctttatccaaatttagtattgaaattcctcgagccgctgcttttctcactccataattctggccagaatttggtacttaaaatattttgtctaaaatattacaatagctacttaagtcatctccctgactccactctgttgtctttcagggcgtcgtccacactgtagccaaagtgatcttataaaaacataattctaatcatggcactcttctgcttaaaaatgttttaatggctttccgttaggttaaaatttaaaagtcctttgtagcctgtgagactctacatgagttgactccctagcttcatctttgagcatcttatttctttacttattataccatcagttagagttgattgttatataatccacagaagtgaattctgtctgatttaagcaaaaaaaaaaaaaaaaaaaaaaagagggagaatttattaggtgtgtatagttacagttaatttagggaattaaaagacagaaataggccgggcatggtggctcatg

SEQ ID NO: 12294 - DNA, 1112 bp, Homo sapiens
ttaagtggtctgcccttccactgaaagtgtagctttttgacagtctcagccatataaacaggatctcagtttcatccttccatccatccattagaggcacaaggtctcatctcttttccttttgggcattaaaaccaaagttcatacattattgagacaggccgactctgctaaggcagcctgtttggcctttaagttttattgcttattttttgagtatgtatttatttttttgattattattattttttttttgagctttaagccttcaagtttcctttttattcttgacccctagacatttcctttgcttgtggactcgggtatttgtttttaggtaatattttttttccctatgacacagccctcaggagatcctgagaacatgtgccctcatttttaggtaattttaattaggaagggttttaggttgtctgatctgccttgttgctagaaacagaaattctcctattgattgatttttcaaaccacttcttagtggcctctacaactactccagtcaggtcaagaatggctctcacattgccaagtcagtgggtatttttagtcttcatcttagatgacctttatgcacatttgtctttgtctaggaacttctgttggaaacatcttctattttaatgttattttaaatttttttgcttttgtaacattatgcttagcatgtgtgtccaactctttgacaatttctttttagttttctggtggcttccctttatccaaatttagtattgaaattcctcgagccgctgcttttctcactccataattctggccagaatttggtacttaaaatattttgtctaaaatattacaatagctacttaagtcatctccctgactccactctgttgtctttcagggcgtcgtccacactgtagccaaagtgatcttataaaaacataattctaatcatggcactcttctgcttaaaaatgttttaatggctttccgttaggttaaaatttaaaagtcctttgtagcctgtgagactctacatgagttgactccctagcttcatctttgagcatcttatttctttacttattataccatcagttagagttgattgttatataatccacagaagt

SEQ ID NO: 12295 - DNA, 294 bp, Homo sapiens
atcagcactgaatacttatgtatttcttacaaacaaggacattctcctacaatatcacagtatagctattaagaacagaaaattaacactgctatattactaccatctagttttcaaatgccattcaagttttggcagttgtcaatgtttttggagatcacagcgtagttgttttggattttatttttcattactaaattcagattatgttttggggggcaggaattttatagaaattatctttgcagtgcatattatcaataacacataatcaggctttcccaatgtaaaggt

SEQ ID NO: 12296 - DNA, 140 bp, Homo sapiens
gtctctactaaaaatacaaaaattagccaggcatggtggaaggcgcctgtaatcccaactactcaggaggccgaggcaggagaatcgcttgaacctgggaggtggtggttgcagtgagctgagattgtgccattgcactc

SEQ ID NO: 12297 - DNA, 294 bp, Homo sapiens; identical to SEQ ID NO: 12295

SEQ ID NO: 12298 - DNA, 299 bp, Homo sapiens
gggaaaataggcagcatgctaggtgtctttcagtgtctgggggctcgtgaggaccacctgttgttggacagtgagaaaggctaatgtttcttgttcttggttgaatcttgtatttaaaaaagtcattcaaaaacaatgtatttttatagttttgatgtaagtctaagaaaagtggaaaaatatgatatggaataggagtcttcttttggccatttactttctgtgtggccttagacaagttacctatttttctgaatctcctttcttgaacctttttgtaaattaaaaaaaaaaaaaaa

SEQ ID NO: 12299 - DNA, 277 bp, Homo sapiens
ccagcactttgggaggctgaggtgagtggatcacttgaggtcaggggttcgagaccagcctggccaacatggtgaaaccctgtctctactaaaaatacaaaaattagcccggtgtggtggcaggggcctgtaatcccagctactcagggggctgaggcaggagaatcacttgaacccgggaggtggaggttgcagtgaacggaggttgcgctactgcattccagtctgggtgagaaagtgagactctgtctcaaaaatttaaaaaaaaaaaaaaaaa

SEQ ID NO: 12300 - DNA, 2297 bp, Homo sapiens
tataatctgtgttataataggttctttcactttattgcttattgtaaacactttggccatagcaaatgttagtttttaaataaccgtaattcaaaactttcacatcctatactatttttccccaagaagcatcatctatgaaaacaatcagtgaactccaacagtctatactggtaatgtgcacattgatgctattatgacacttaatacaaatagtaaaaatactcatctattgtaggcttatgggtttgtaaaatgccttaagggaggccataaacaactcaaagaagagatggtgtggactgaactggcttctatttggggaaaatttgcagaatataggaggtacgcaataaatgtttattgatggtgaagatgagaaaaccctatttctgctgatctttcctttccgttttccttaaagaatataaggtatatttgtattcagcattctcagaatcatcacagaaaccctggcactttgagagtcttagccacagtgtaattgggtctgaccacacgcagaagaaaaataaattaaagcatatgtactattaaaattgcactgaaaactttatgtaagtcagggagcccctcaccagaacaggctgaaactcttgaatgctttgcatcctcatatataagaaaatcatcagtgcttaaagatcaaggaactcattcaaaacaaattcagcctttggaccttactggcaggtaggttatatttcagtcagatcaatatctttctaatataggtatttgaaagtaatatatgctacttataataatgatatagtaagcttcttatctgcaagtacaggtactataacttacaccttaaaatgctttgtttgattgtttcattcagcaaaattcttggcactgttttgggatttcactgaattttgatgatgatattggattaagcattttagatttaattgtaaaatgacacaaaaatctaatcatctatttccaatgttcaatatacaatttttataaatacatgaaacaattcatataaaaatataaatgttaaggtcactcacagcaaaatatggcacattagaattatttattaaatgctttatacatataaaggtaggcacttcataaaatttgcattttggtaaaaggcaacaatttgatgtcagtatcttaattgtgtcattaacttttttaagagaacagattatcaaaattttacgaagaagaaaaaaataatagttttaaggaaatctacagaagggaatctgaacttcatttcccactttatttttgcgagtctgttgtgtatcttcatggtcaagttctgagatttttgctccctgacctaaaatcctgtgggaataattgatttctcatcttttacttggaagtgaagtgtctgctacctgtggaacttgatacaattttttttttctccccacagttagaataacctttattctgatccactataaagccagatgatttttaggtggcagtagctggcattgaagagttcttggcttcaagcggctgttgagtctttttggtcttgttttaactccctaattaaataaataagatccaactctttctgttgtattcactcctggacatatagaaattcacttcacacccacctaaaatacgagcagaacttctgaggcccaatgaacccatctactatttgattttgttatcccttctggagcgtgtctctaccaagagcttcacaaagcaatctagtcattgctctttcttgtactaaaaccagagtacccgtcctgtaacttccatcaggacctcaaacagtgctaggcacatagtaaactcttaggcactcaaaatacatttattgatgaatgaaagaatgaacaattctagttctgacttttaaagctatatagaataaagttgcttccttgtgtgggccaaatcattctcccatcctacttagatcttctttttttccaggatcaatactgaaactttcttcacctagcccttaaacaacatgattatcagatattttgtcaattacattactcttccctgaatgtgcttaggtggatcagcagatctcttaaaatgtggttccatagaaccaaacattaatactccagatggggtcagctttgagcagagtagaaatcctatatctcctagcagggatattccacctgacacattatctgaccccaaaaagtattccttggagcaattctttcctgcctgtttctgagtagaggcattttattccaggcaagatcgcccattggcacatgttctgttctgggagatagattatt

SEQ ID NO: 12301 - DNA, 2293 bp, Homo sapiens
tataatctgtgttataataggttctttcactttattgcttattgtaaacactttggccatagcaaatgttagtttttaaataaccgtaattcaaaactttcacatcctatactatttttccccaagaagcatcatctatgaaaacaatcagtgaactccaacagtctatactggtaatgtgcacattgatgctattatgacacttaatacaaatagtaaaaatactcatctattgtaggcttatgggtttgtaaaatgccttaagggaggccataaacaactcaaagaagagatggtgtggactgaactggcttctatttggggaaaatttgcagaatataggaggtacgcaataaatgtttattgatggtgaagatgagaaaaccctatttctgctgatctttcctttccgttttccttaaagaatataaggtatatttgtattcagcattctcagaatcatcacagaaaccctggcactttgagagtcttagccacagtgtaattgggtctgaccacacgcagaagaaaaataaattaaagcatatgtactattaaaattgcactgaaaactttatgtaagtcagggagcccctcaccagaacaggctgaaactcttgaatgctttgcatcctcatatataagaaaatcatcagtgcttaaaaatcaaggaagtcattcaaaacaaattcagcctttggaccttactggcaggtaggttatatttcagtcagatcaatatctttctaatataggtatttgaaagtaatatatgctacttataataatgatatagtaagcttcttatctgcaagtacaggtactataacttacaccttaaaatgctttgtttgattgtttcattcagcaaaattcttggcactgttttgggatttcactgaattttgatgatgatattggattaagcattttagatttaattgtaaaatgacacaaaaatctaatcatctatttccaatgttcaatatacaatttttataaatacatgaaacaattcatataaaaatataaatgttaaggtcactcacagcaaaatatggcacattagaattatttattaaatgctttatacatataaaggtaggcacttcataaaatttgcattttggtaaaaggcaacaatttgatgtcagtatcttaattgtgtcattaacttaagagaacagattatcaaaattttacgaagaagaaaaaaataatagttttaaggaattctacagaagggaatccgaacttcatttcccactttatttttgcgagtctgttgtgtatcttcatggtcaagttctgagatttttgctccctgacctaaaatcctgtgggaataattgatttctcatcttttacttggaagtgaagtgtctgctacctgtggaacttgatacaattttttttttctccccacagttagaataacctttattctgatccactataaagccagatgatttttaggtggcagtagctggcattgaagagttcttggcttcaagcggctgttgagtctttttggtcttgttttaactccctaattaaataaataagatccaactctttctgttgtattcactcctggacatatagaaattcacttcacacccacctaaaatacgagcagaacttctgaggcccaatgaacccatctactatttgattttgttatccctgctggagcgtgtctctaccaagagcttcacaaagcaatctagtcattgctctttcttgtactaaaaccagagtacccgtcctgtaacttccatcaggacctcaaacagtgctaggcacatagtaaactcttaggcactcaaaatacatttattgatgaatgaaagaatgaacaattctagttctgacttttaaagctatatagaataaagttgcttccttgtgtgggccaaatcattctcccatcctacttagatcttctttttttccaggatcaatactgaaactttcttcacctagcccttaaacaacatgattatcagatattttgtcaattacattactcttctctgaatgtgcttaggtggatcagcagatctcttaaaatgtggttccatagaaccaaacattaatactccagatggggtcagctttgagcagagtagaaatcctatatctcctagcagggatattccacctgacacattatctgaccccaaaaagtattccttggagcaattctttcctgcctgtttctgagtagaggcattttattccaggcaagatcgcccattggcacatgttctgttctgggagatagattatt

SEQ ID NO: 12302 - DNA, 2293 bp, Homo sapiens; identical to SEQ ID NO: 12301

SEQ ID NO: 12303 - DNA, 1265 bp, Homo sapiens
ttctcgaatctgctggcagcatgtcagtattgcaatggctctagcctcattctccatttctctgcacaggatgttacttcccccatgaggtctggcttattacatgagcctgtatttataaaactgcaacttccgattccccaaccccgttgtttcttctccccagaacactaggcaccatctgatctaccatgccttttccttattgtcagatactgaactctcagatacagttccccttcctccctccaggggggcgccatggaacgcaggccctcactggccctggggactgggtgacgacagggggagcctctggtgattggctccctcaccctgcgtaagatcaaagggactaaaggacagccccgacacccggagccattgtggctcaggccggttgcgcctgccctcgggccctcacggaggcgggggttccagggcacgagttcgaggccagcctggtccacatgggtcggaaaaaaggattttttttatcgttcccaatataacgacaaaacataaagggaggacgccttgataggaagaaatgacatcttcctaagtgtttttaaattacttccatgtgtcttttttttttttttttttgggagaccgagccttgctctgttgcccaggctggagtgcagtggtgtgatcttcgctcactgcaacctccgcctcgtcggttcaagggagtctcctatctcagcctcctgagtagctgggattacagtcgcctgccaagagatggggtttcgccatgttgaccaggctggtcttgaacacctggcctcaaatgatccactcgccttggtctcccaaagtggtaggatgacaggcgtgagccaccgcggccagcctcttctattcttttagagacagggtctcactccgttgcccaggctggagtgcattgatgtgatgtgtgatcatagctcattgcagccctgaccatccgagctcaagcaatccttctgcctcagcctcctgagtagctggggccgcagatgtgcaccactgcacctggctaatttttaacctttttgtggagccagagtctgtataaaataaagtgtaaatagtaccatcaataaagaatacatagtaccattttatagtagtataaaacggacattagaaactctggacttaaaggttaaaaaaatacacaaaagtagttctcaagttctagagacttggagaatccaggaatcaacaatgtcgtggaactcctacagcctttcataaagaatggccctcga

SEQ ID NO: 12304 - DNA, 1892 bp, Homo sapiens
ggggctcctcactgttcccgtagcagcaggcatgtgcccccactgggcctctgtactggctgttcccactgcccgaacaccctcatgcaccatctgcactgtccaatacggccgcctctggccacacatggctactgagcagttgaacatggctggtccaaaccaacatttcccagacgtcgtatggtaaaaaataacataaaatcttgcaaaaatgtttctattgattatgttaaaattatgatgttttaggtatattaggttaaatcagctattttatccaaatgaatctcgcctgtttgtttttgctttttttttttttttttttttttttgagatggaggctcgctctgtcgcccaggctagagtacaatggcgtggtctcggctcactgcatcactgcaacctctacctcccaggttcaagcgattctcctacctcaccctcccaagtggctgggattacaggcgtgtgccaccacacccagctaatttttgtatttttagtagagacagggtttcaccatgttggccaggctggtctcgaactgctgacctcgtgatctacctgcctcggcctcccaaagtcctgggattacaggtgtgggccactgcgccggccatgtttctcgacttctgctggcaagcatgttccagtatttgcatggctcctagccctcatctccatttctctgcacagatgttaccttccccatgaggtctgccttatacatgaggcctgtattataaactgcaactccgcattccccaaccccgttgtttcttctctccagaacactaggcaccatctgatctcctatgccttttccttattgtcagatactgaactctcagatacagttccccttcctccctccagggggcgccatggaacgcagggccctcactggccctggggactggttgacgacaggggggagcctctggtgattggctccctcaccctgcgtaagatcaaagggactaaaggacagccccgacacccggagccattgtggctcaggccggttgcgcctgccctcgggccctcacggaggcggggttccagggcacgagttcgaggccagcctggtccacatgggtcggaaaaaaggattttttttatcgttcccaatataacgacaaaacgtaaagggaggacgccttgataggaagaaatgacatcttcctaagtgtttttaaattacttccatgtgtcttttttttttttttttttgggagaccgagccttgctctgttgcccaggctggagtgcagtggtgtgatcttcgctcactgcaacctccgcctcgtcggttcaagggagtctcctatctaagcctcctgagtagctgggattacagtcgcctgccaagagatggggtttcgccatgttgaccaggctggtcttgaacacctggcctcaaatgatccactcgccttggtctcccaaagtggtaggatgacaggcgtgagccaccgcgcccagcctcttctattcttttagagacagggtctcactgtgttgcccaggctggagtgcattgatgtgatgtgtgatcatagctcattgcagccctgaccatccgagctcaagcaatccttctgcctcagcctcctgagtagctggggccgcagatgtgcaccactgcacctggctaatttttaacatttttgtggagccagagtctgtataaaataaagtgtaaatagtaccataaataaagaatacatagtaccattttatagtagtataaaacggacattagaaactctgaacttaaaggttaaaaaaatacacaaaagtagttctcaagttctagagacttggagaatccaggaatcaacaatgtcgtggaactcctacagcctttcataaagaatggccctcga

SEQ ID NO: 12305 - DNA, 1594 bp, Homo sapiens
tttttgcttttttttttttttttttttttttttgagatggaggctcgctctgtcgcccaggctagagtacaatggcgtggtctcggctcactgcatcactgcaacctctacctcccaggttcaagcgattctcctacctcaccctcccaagtggctgggattacaggcgtgtgccaccacacccagctaatttttgtatttttagtagagacagggtttcaccatgttggccaggctggtctcgaactgctgacctcgtgatctacctgcctcggcctcccaaagtcctgggattacaggtgtgggccactgcgccggccatgtttctcgacttctgctggcaagcatgttccagtatttgcatggctcctagccctcatctccatttctctgcacagatgttaccttccccatgaggtctgccttatacatgaggcctgtattataaactgcaactccgcattccccaaccccgttgtttcttctctccagaacactaggcaccatctgatctcctatgccttttccttattgtcagatactgaactctcagatacagttccccttcctccctccagggggcgccatggaacgcagggccctcactggccctggggactgggtgacgacaggggggagcctctggtgattggctccctcaccctgcgtaagatcaaagggactaaaggacagccccgacacccggagccattgtggctcaggccggttgcgcctgccctcgggccctcacggaggcgggggttccagggcacgagttcgaggccagcctggtccacatgggtcggaaaaaaggacttttttttatcgttcccaatataacgacaaaacgtaaagggaggacgccttgataggaagaaatgacatcttcctaagtgtttttaaattacttccatgtgtctttttttttttttttttttgggagaccgagccttgctctgttgcccaggctggagtgcagtggtgtgatcttcgctcactgcaacctccgcctcgtcggttcaagggagtctcctatctaagcctcctgagtagctgggattacagtcgcctgccaagagatggggtttcgccatgttgaccaggctggtcttgaacacctggcctcaaatgatccactcgccttggtctcccaaagtggtaggatgacaggcgtgagccaccgcgcccagcctcttctattcttttagagacagggtctcactgtgttgcccaggctggagtgcattgatgtgatgtgtgatcatagctcattgcagccctgaccatccgagctcaagcaatccttctgcctcagcctcctgagtagctggggccgcagatgtgcaccactgcacctggctaatttttaacatttttgtggagccagagtctgtataaaataaagtgtaaatagtaccataaataaagaatacatagaaccattttatagtagtataaaacggacattagaaactctgaacttaaaggttaaaaaaatacacaaaagtagttctcaagttctagagacttggagaatccaggaatcaacaatgtcgtggaactcctacagcctttcataaagaatggccctcga

SEQ ID NO: 12306 - DNA, 1346 bp, Homo sapiens
tgctgacctcgtgatctacctgcctcggcctcccaaagtcctgggattacaggtgtgggccactgcgccggccatgtttctcgacttctgctgggaagcatgttccagtatttgcatggctcctagccctcatctccatttctctgcacagatgttatcttccccatgaggtctgccttatacatgaggcctgtattataaagtgcaactgccaattcgccaaccccgttgtttcttctctccagaacactaggcaccatctgatctcctatgccttttccttattgtcagatactgaactctcagatacagttccccttcctccctccagggggcgccatggaacgcagggccctcactggccctggggactgggtgacgtcaggggtgagcctctggtgattggctccctcaccctgcgtaagatcaaagggcctaaaggtcagccccgacacccggagctattgtggctccggccggttgcgcgggccctcggaccctcagagaggcgagggttcgagggcacgagttcgaggccaacctggtccacatgggttgaaaaaaaaatttttttatcgttcccaatataacaacaaaacataaagggaggacgccttgataggaagaaatgacatcttcctaagtgtttttaaattacttcaatgtatctttcttttttttttttttttgggagaccgaggcttgctctgttgcccaggctggagtgcagtggtgtgatcttggctcactgcaacctctgcctcgtcagttcaagggagtctcctatctcagcctcctgagtagctgggattacagtcgcctgccaagagatggggtttcgccatgttgaccaggctggtcttgaacacctggcctcaaatgatccactcgccttggtctcccaaagtggtaggatgacaggcgtgagccaccgcgcccagcctcttctattcttttagagacagcgtctcactctgttgcccaggctggagtgcattgatgtgatgtgtgatcatagctcattgcagccctgaccatccgagctcaagcaatccttctgcctcagcctcctgagtagctggggccgcagatgtgcaccactgcacctggctaatttttaacattttttgtggagccagagtctgtataaaataaagtgtaaatagtaccataaataaagaatacatagtaccattttatagtagtataaaacggacattagaaactctggacttaaagtttaaaaaaatacacaaaagtagttctcaagttctagagacttggagaatccaggaatcaacaatgtcgtggaactcctacagcctttcataaagaatggccctcga

SEQ ID NO: 12307 - DNA, 5985 bp, Homo sapiens
gcactgttcaattagtcaagcaattgtaaaattctcccagtcttagaaaagatacaggtgtgtgtccctctgctgtggctgtgcactgacgcttcagtaaaagttgccgtctaaaaccaccggcctgcccttgaattgttttgttttgttttgttttgttttgttttgtttttttgattcgcagcctcactctatcacccaggctggagtgcagtgacacgatctctgttcactgcaacctccgcctcccgggttcaagcgattcccctgcctcagcctcctgaacagctgggattacaggcacccgtccccatgcccgggtaatttttgtatatttagtagagatggggtttcaccatgttggccaggctggtctcgaactccttacctcaagtgatccatccgcctcagcctcccaaagtgctgggattacaggcgtgagccactgcgcccggcttcttgaattagtttctaggagaagccaagaacccccccgggctaagcctcaattttggggctcgcctgtgctgcatcagcttcacacctagagaagagagtgaaagagaagggagagccgtccttttgggctgccttgaaataaaggttgacccatgggttcatgtattgtcattcattctcattttctcttcctctctttctctctctcccctgccccttaagttagcttttctacaccctacctggataaggataagaaatagaaggaggggacactttaggatgctacaaaataaaatacaacaacaacaacaataacagcagcagcaacaacaacaacagcaacaaaaggggaagaaacaaatctggccactgcacattcctccttggcaacaaaaagccgcggatgcaaaaagctgcccttcactgcatagacagaagagggcgcgctcgagctatgaatctcggaaattactcaaaccatcagcctctgcaagaagcaaagtggacggccgggcgcggtggctcactcctggaatcccagcacttgggagcccgaggtgggcggatcacgaggtcaggagatcgagactgttctggctaaaccagtgaaaccccctctctactaaaaaaataacaaaagcgaagtgcatctcccataaacgaggtactgcaggaagaaagcagaaaatgagacccgagtacacacatgcacgcgggcgtgcgcacacacacaccagaagaaatgaaccaagaggaaaggaaatattttcaagtaagcatttggagatgggaaaaacaccttgaaacagaaattcataaagtacacacatgttttttttttaagttaaaagaggaacaataataaacaggcagaaaatgaataaaaaataaaatgtcatatcagaagtgaagataaattaaaagtggtcaaaggagaagagatctaaatgcaaacttaagaaggggcaatttttttttttttttttttgagacgcagcctcactctgtcgcccgggctggagtgcagtggcgtgatcttggctcactgaaacctctgcctcctggattcaagcgattctcctgcctcagcctcccaagtggctgggattacaggcatgagccaccatgcccggcctagagtcatcatggaaattaaacaacctgcttccaaatgacttttgggtaaagactgaaattaaggcagaaataaaaaaattatttgaaactaatgaaaacaaacatacaacatcccagaatctctgggacacagctagaacagtgctcagaggaagtttctagtgctatatggctacattaagaagctagaaagatctcaaatgaaccgcctaacatcacacctagaggaattagaaaaacaagagcaaatcaaccccaaagctagcagaagaaaaaaaaaaaaacaaaatcagagctgagctgaatgaaattgagatgtaaaataccatacaaaagatcaatgaaacccaaagttgatttttaaaaaaaattatttatttattatttattccataaattattggggtacaggtggtatgtggttacataagctctttagtggtgatttgtgattttggtgcacccatcacctgagcagtatacactaccccctatttgttgtcttttatccctcgccctcgccaactcgtccccctaagtccccaaagtccattgtatcattcttatgcctttgtgtcctcatagcttaggtcccacatatcagtgagaacatacgatgtttggttttccattcctgagttacttcacttagaataatactctccggtctcatccaggtcactgcaaatgctgttaattcatacaaagttgatatttttggaagcataaataacatggaaagaccactagctagattaataaagaaaaaaagacaagatccaaataaacacaatcagaaatgacagaggtgacattaccactgacccacagacatacaagaaaccctgagactattccacatgcctctatgcacaaaaactagaaaactagaagaaatagagaaattcctggaaacataaaacctctcaagattgaaccaggaagaaatggaaaccctgaacaaaccaacgatgagttccaaaattgagttagtcatacaagacctaccaaccagcgcaaaaaaccttagactagacggattcacagtcgaattctaccagatgtgtaaagaaaagccggcaccaatcctactgaaattattccacacaattgaggaggagcaactgctctctaactcattctatgaggtcagagtcattctgataccgaaacctggcagagacacaacgaaaaaaggaaaataggtaaagtaatacatatgttaatgatcttgatttagccattctacggtatatacatatttcaaaacaatatgtacatgataaatatgtacaatttgtcaattaaaaatatataaaaggaagaggaaaaaattcaaatggcgtagaatttgaaaggagaagatacagaacaaactccagtgtcttctttattcaactatatatacacacgttcaatggaccgggagcagtggctcaagcctgtaatcacagcactttgggaggtcaaggcgggcagatcacctgaggtcgggagttcgagaccagcctgaccaacagagagaaaccccagctctactaaaaatacaaaattagccgggcatggtgacgcatgcctgtaatcccagctactcgggagggtgaggcaggagaatcgcttgaactcaagaggtggaggttgtggtgagccgagatggcaccattgcactccagcctgggcaacaagagcgaaactcagtctcaaaaaaaaaaaaaaaaaaaaaaaaaaaggatttaatgaatgaatgatgagaccgttggtgacatctcccaccttctccctctcactccactgcagccacacggggctcctcactgttcccgtagcagcaggcatgtgcccccacagggcctctgtactggctgttcccactgcccgaacaccctcatgcaccatctgcactgtccaatacggccgcctctggccacacatggctactgagcagttgaacatggctggtccaaaccaagatttccaagacgtcgtgtggtaaaaaaaacaacataaaattttgcaaaaatgtttctattgattatgttaaaattatgatgttttaggtatattaggttaaatcagctattttatcaaaatgaatctcgcctgtttgtttttgcttttttttttttttttttttttttttgagatggagtctcgctctgtcgcccaggctagagtacaatggcgtggtctcagctcactgcatcactgcaacctctacctcccaggttcaagcgattctcctacctcaccctcccaagtggctgggattacaggcgtgtgccaccacacccagctaatttttgtatttttgtagagacagggtttcaccatgttggccaggctggtctcgaactgctgacctcgtgatctacctgcctcggcctcccaaagtcctgggattacaggtgtgggccactgcgccggccatgtttctcgacttctgctggcaagcatgttccagtatttgcatggctcctagccctcatctccatttctctgcacagatgttatcttccccatgaggtctgccttatacatgaggcgtgtattataaagtgcaactgccaattcgccaaccccgttgtttcttctctccagaacactaggcaccatctgatctcctatgccttttccttattgtcagatactgaactctcagatacagttccccttcctccctccagggggcgccatggaacgcagggccctcactggccctggggactgggtgacgtcaggggtgagcctctggtgattggctccctcaccctgcgtaagatcaaagggcctaaaggtcagccccgacacccggagccattgtggctccggccggttgcgcgggccctcggaccctcagagaggcgagggttcgagggcacgagttcgaggccaacctggtccacatgggttgaaaaaaaaatttttttatcgttcccaatataacaacaaaacataaagggaggacgccttgataggaagaaatgacatcttcctaagtgtttttaaattacttcaatgtatctttcttttttttttttttttgggagaccgaggcttgctctgttgcccaggctggagtgcagtggtgtgatcttggctcactgcaacctctgcctcgtcggttcaagggagtctcctatctcagcctcctgagtagctgggattacagtcgcctgccaagagatggggtttcgccatgttgaccaggctggtcttgaacacctggcctcaaatgatccactcgccttggtctcccaaagtggtaggatgacaggcgtgagccaccgcgcccagcctcttctattcttttagagacagcgtctcactctgttgcccaggctggagtgcattgatgtgatgtgtgatcatagctcattgcagccctgaccatccgagctcaagcaatccttctgcctcagcctcctgagtagctggggccgcagatgtgcaccactgcacctggctaatttttaacattttttgtggagccagagtctgtataaaataaagtgtaaatagtaccataaataaagaatacatagtaccattttatagtagtataaaacggacattagaaactctggacttaaagtttaaaaaaatacacaaaagtagttctcaagttctagagacttggagaatccaggaatcaacaatgtcgtggaactcctacagcctttcataaagaatggccctcgaggaaagtggaattgtcagtgggcattgtgttcgtgcctcagctaaacacggcaggaatttatttataacctagtgtaacatcctcgaggcactgttcaattagtcaagcaattgtaaaattctcccagtcttagaaaagatacaggtgtgtgtccctctgctgtggctgtgcactgacgcttcagtaaaagttgccgtctaaaaccaccggcctgcccttgaattgttttgttttgttttgttttgtgtttttgattcgcagcctcactctatcacccaggctggagtgcagtgacacgatctctgttcactgcaacctccgcctcccgggttcaagcgattcccctgcctcagcctcctgaacagctgggattacaggcacccgtccccatgcccgggtaatttttgtatatttagtagagatggggtttcaccatgttggccaggctggtctcgaactccttacctcaagtgatccatccgcctcagcctcccaaagtgctgggattacaggcgtgagccactgcgcccggcttcttgaattagtttctaggagaagccaagaacccccccgggctaagcctcaattttggggctcgcctgtgctgcatcagcttcacacctagagaagagagtgaaagagaagggagagccgtccttttgggctgccttgaaataaaggttgac

SEQ ID NO: 12308 - DNA, 747 bp, Homo sapiens
gcactgttcaattattcaagcaattgtaaaattctcccagtcttagaaaagatacaggtgtgtgtccctctgctgtggctgtgcactgaggcttcggtaaaggttgccgtctaaaaccaccggccggcccttgaattcttttttttttttttcagacggagtcgcactctatcacccaggctggagtgcagtgacacgatctctgttcactgcaacctccgcctcccgggttcaagcgattcccctgcctcagcctcctgaacagctgggattacaggcacccgtccccatgcccgggtaatttttgtatatttagtagagatggggttttcagcatgttggccaggctggtctcgaactccttacctcaagtgatccatccgcctcagcctcccaaagtgctgggattacaggcgtgagccactgcgcccggcttcttgaattagtttctaggagaagccaagaacccccccgggctaagcctcaattttggggctcgcctgtgctgcatcagcttcacacctagagaagagagtgaaagaagaagggagagccgtcctttgggctgcttgaaataaaggttgacccatgggttcatgtattgtcattcattctcattttctcttcctctctttctctctctcccctgcccctgaagttagcttttctaaaccctacctggataggataagaaatagaaggaggggacactttaggatgctacaaaataaaatacaacaacaacaa

SEQ ID NO: 12309 - DNA, 553 bp, Homo sapiens
ctatgaatctcggaaattactcaagccatcagcctctgcaagaagcaaagtggacggccgggcgcggcggctcactcctggaatcccagcactttgggagcccgaggtgggcggatcacgaggtcaggagatcgagactgttctggctaaaccagtgaaaccccctctctactaaaaaaataagaaaagcgaagtgcatctcccataaacgaggtactgcaggaagaaagcagaaaatgagacccgagtacacacatgcacgcgggcgcgcgcacacacacaccagaagaaatgaaccaagaggaaaggaaacattttcaaataagcatttggagatgggaaaaacaccttgaaacagaaattcataaagcacagaatttttttttaagttaaaaaaggaacaataatagacagaaaatgaatgaaaaattaaatgtcatatcagaagtgaagataaattaaaagtggtcaaaggagaagagatctaaatgcaaacttaagaaggggcaattttttttttttttttttttgagacgcagcctcactctgtcgc

SEQ ID NO: 12310 - DNA, 363 bp, Homo sapiens
gcactgttcaattagtcaagcaattgtaaaattctcccagtcttagaaaagatacaggtgtgtgtccctctgctgtggctgtgcactgaggcttcggtaaaggttgccgtctaaaaccaccggcgtgcccttgaattcttttttttttttttttctttttcagacggagtcgcactctatcacccaggctggagtgcagtgacacgatctctgttcactgcaacctccgcctcccgggttcaagcgattcccctgcctcagcctcctgaacagctgggattacaggcacccgtccccatgcccgggtaatttttgtatatttagtagagatggggtttcaccatgttggccaggctggtctcg

SEQ ID NO: 12311 - DNA, 756 bp, Homo sapiens
aagcaattgtaaaattctcccagtcttagaaaagatacaggtgtgtgtccctctgctgtggctgtgcactgaggcttcggtaaaggttgccgtctaaaaccaccggcgtgcccttgaattcttttgttttgttttgttttctttttttcagacggagtcgcactctatcaccgaggctggagtgcagtgacacgatctctgttcactgcaacctccgcctcccgggttcaagcgattcccctgcctcagcctcctgaacagctgggattacaggcacccgtccccatgcccgtgtaatttttgtatatttagtagagatggggtttcagcatgttggccaggctggtctcgaactccttacctcaagtgatccatccgcctcagcctcccaaagtgctgggattacaggcgtgagccactgcgcccggcttcttgaattagtttctaggagaagccaagaacccccccgggctaagcctcaattttggggctcgcctgtgctgcatcagcttcacacctagagaagagagtgaaagagaagggagagccgtccttttgggctgccttgaaataaaggttgacccatgggttcatgtattgtcattcattctcattttctcttcctctctttctctctctcccctgccccttaagttagcttttctaaaccctacctggataaggataagaaatagaaggaggggacactttaggatgctacaaaataaaatacaacaacaacaacaataacagcag

SEQ ID NO: 12312 - DNA, 680 bp, Homo sapiens
aagcaattgtaaaattctcccagtcttagaaaagatacaggtgtgtgtccctctgctgtggctgtgcactgacgcttcagtaaaagttgccgtctaaaaccaccggcctgcccttgaattgttttgttttgttttgttttgtttttttgattcgcaggctcactctatcacccaggctggagtgcagtgacacgatctctgttcactgcaacctccgcctcccgggttcaagcgattcccctgcctcagcctcctgaacagctgggattacaggcacccgtccccatgcccgggtaatttttgtatatttagtagagatggggtttcagcatgttggccaggctggtctcgaactccttacctcaagtgatccatccgcctcagcctcccaaagtgctgggattacaggcgtgagccactgcgcccggcttcttgaattagtttctaggagaagccaagaacccccccgggctaagcctcaattttggggctcgcctgtgctgcatcagcttcacacctagagaagagagtgaaagagaagggagagccgtccttttgggctgccttgaaataaaggttgacccatgggttcatgtattgtcattcattctcattttctcttcctctctttctctctctcccctgccccttaagttagcttttctacaccctacctggat

SEQ ID NO: 12313 - DNA, 105 bp, Homo sapiens
aggctgaggcaggagaatcgcttgaactcaagaggtggaggttgtggtgagccgagatggcaccattgcactccagcctgggcaacaagagcgaaactcagtctc

SEQ ID NO: 12314 - DNA, 727 bp, Homo sapiens
tgctgacctcgtgatctacctgcctcggcctcccaaagtcctgggattacaggtgtgggccactgcgccggccatgtttctcgacttctgctggcaagcatgttccagtatttgcatggctcctagccctcatgctccatttctctgcacagatgttatcttccccatgaggtctgccttatacatgaggcgtgtattataaagtgcaactccgcattccccaaccccgttgtttcttctctccagaacactaggcaccatctgatctcctatgccttttccttattgtcagatactgaactctcagatacagttccccttcctccctccagggggcgccatggaacgcagggccctcactggccctggggactgggtgacgaccaggggggagcctctggtgattggctccctcaccctgcgtaagatcaaagggactaaaggacagccccgacacccggagccattgtggctcaggccggttgcgcctgccctcgggccctcacggaggcgggggttccagggcacgagttcgaggccagcctggtccacatgggtcggaaaaaaggacttttttttatcgttcccaatataacgacaaaacgtaaagggaggacgccttgataggaagaaatgacatcttcctaagtgtttttaaattacttccatgtgtcttttttttttttttttttgggagaccgagccttgctctgttgcccaggctgga

SEQ ID NO: 12315 - DNA, 298 bp, Homo sapiens
aaaccatcagcctctgcaagaagcaaagtggacggccgggcgcggtggctcactcctggaatcccagcactttgggagcccgaggtgggcggatcacgaggtcaggagatcgagactgttctggctaaaccagtgaaaccccctctctactaaaaaaataacaaaagcgaagtgcatctcccataaacgaggtactgcaggaagaaagcagaaaatgagacccgagtacacacatgcacgcgggcgtgcgcacacacacaccagaagaaatgaaccaagaggaaaggaaatattttca

SEQ ID NO: 12316 - DNA, 23934 bp, Homo sapiens
ctccgctttcgcgggggctgctggggcgtaggtgtcggggacgcgcgcacgggcgcgcgcagctgttgacgcgcttcttagctggtgcgcgccggagcccaaattccaagtggaaactgcaggcgcacgagggaggaacgcgtggagcatgaaaaggcagggggcctcctctgagcgaaaacgagcgcggataccgtccgggaaggccggtgcggaaggtggcgggggaggggacggtcggccgaaggctccccggggcgggccggcgggagtcgtagtcagtggtgatttcttctggagtcgtttcctcagctccttccagccccttgggcggcaccttctatctttgaggcgttaaaggtgtggaaacggagggcgtgacgaggggcaggtagcgagaatggctcagctgtggagccaaggttcgagtcccggggtcccctcataacggccctgcgaccttgtgcaagttggttaacttcagcttcacgttttttccgtcgccacacgaggatgccagtaccgcccgcaccagcagccagtactccgctgggatagttaattgtcgagcgcggagcccagttcctaacctgcagttacctgtagctgccacggcggggacggggcttggtccccaaagtcacgcagctaccaagtggccgagcttgtggctgctccaagacccgagttcttcctgagtgccagggtagcatggcatggcaggtgccagagaatttggcaagtccctcttcctccgtgaagaggaaccttcctaaaagttatcaagaatcctcaaagattttttctttatgtggattacatctatctattttgactgtattagaaattaaaacaaatttttttttgggaggccgagggggacagatcatctgagctcaggagttcgagaccagcctggccagcatggtgaaaccccgtctctactaaaaatacaaaaattagctgggcatggtggcaggcgcctgtaataccagttactcgggaggctgaggcaggagaatcacttgaacccgggaggcggaggttgcagtaagccgagatcgcgccactgcactccaccctgggcgacagagcgagactccgtctcaaaaaaataaaaataaaattaaaacaaaattttaaaatattgattagaaaataaccatagtaaacccattacatattgacataatatttttttgaaaaagaaatattcctaaacaacaacaacaaaaaaagcaaaagagtggaaatatatttttgcaagtttcttcagtatatcttaatggaagacagctggattctcatgcccgctgcttcattcagtctaacatgtcaagtagcctcttgaaaacgcctcttcacggaggttgcagtaagccgagatcgcgccaatgcactccatcttgggtgacagagtgagactctgcctcaaaaaagaaaacgcctctcacttgtgagagaattaaagtgaaaaagtcaaataaagtgttagaattattaagaaaacggttgtagccctgcagactctgaaaagtctcagaggctcccaaagctctctggactactacactttgagaactgctgctgcttctcctttgatcctataactttgttgcttgggacaactgccttgctctgccttctgtcatagccttttttatacatctctccatcttctcctgcctagggtcctttcttgtgtgaggcaaatagtcccccggcagcatcagcatcggccagtgccactgatctgacagctggtctggtagctaccaggaaactcatggagttaataatgcagagctgttggttaagagcatagattgacacttaaccctttcacagtttgggactgatagtattttttttttttttttttttttgagacggagtctggctcttgtcgcccaggctggagtgcagtggcctgatctcagctcactgcaacctccacctcccaggttcaagcaattctcctgcctcagcctcctgaatagctgggattacaggcgcccgccaccacgcccggctaatttatatacttttagtagagatggggtttcgccatgttggccaggctggtctcaaaatcctgacctcagatccgcccaccttggcctcccaaagtactgggattacaggcgtgagccaccgcgccggacagggactgatagtcttaaataagtaaggcaattgcagtttgatgttagcagatgataggtttttgttttatttgtttttcaaagtaaaaattgcttttttaaattataaaagcaatattgggtagaaaaaataaagcaataaagaaaagtaaaaagaagaaaataaaaataatttcaaatcacaccccaccagaagtgaccattaccagtatgtgaggaacattctagtaagtgtcattacatgaagtgtgcattgtttcgttcatttttttaaattatgtgctcccggaaaaaaactcaaaactctgtttacatcacactttgtaatataaatacattaattttgttgtaattattcagcttttagtaaatatttgattattgtgtaccatggtagatactgtgcttggtgtgggtgatgataaagatttctcacataaagaccttacttaggaggccagacgtggtggctcatgcctataatcccagcactttgggaggccgaggctggcagatcgcttgagtgcaggagtttgagaccagcatgggcaacatggcgaaaccccatctctacaaaaaatacaaaattaaccaggtgttgtggcacatacctgtagtcccagctactgaggaggctgaggcacaagaattgcttgagcctgggaggcggaggttgcagtgagccgagatcatgccactgcactctagcctgggcgacagagcaagactctgtatcaaaaaaaaaaaaaaaaaaaaaaaaacaaacttaggaactctaagtcaagtagaagtgatcagatatttatctgcataaataataaaaggtagaaagtaattcatattttaagaaggaacaattggggtttcataactcatgaagagttaaatgagttcaaaagagggacataaaattttctactttgggagacagaaaaaatcatggaaatgttccttgaaaaattttattcagagatgaagccagaaggaactctgggttgaggagaaggcattggggagccagcggtagggactggagagatctggaagcataagaaggaatgagacagagtatcactctgtcacccaggctggagtgcagtagcacaatcttggctcactgcaacctccacctcctgggttcaagcgattctcatgcctcagcctcccaagtagctgggattacaggcgcatgccacgatgcctggctaatttttgtatttttagtagagacagggttttaccatgttggccaggctgatctccaattcctgacctcatgtgatccacccacctcggcctcccaaagtgctgggattacaggcatgagccatcacacccggccagataactaatactttttgattcttgagactatatactttacatgaattatctaatttaatcctcactactctgaggtacatactaaaatctaccttgttttatagaaaacttaagtaactaatctaggatctcacactaaatagttggtgggacatggatttgaagtctgtcctgcttttaaacctatattccttataaagaagtttaaatatattctgcaggcattgagaagcattgtaagaatctcagctggaatgtgatgatgaggtctatgttttaggaagattaatttggcattcgatagacattttcctcagtataattttttatacatctgtctgtgtacctatttcagtctataggcatcaattcaataattaatgtgatattttattgcattcatgggccctagtgtacttatctattacctgttattggacatttgcattttggcagcagaatgtaaaccctttgtggtaaattggtctggatggatagaacctttatgaactcttaccattctccatgtattttaggagcagcaaatggatttctcatggaagtttgtgttgattcagtggaatcagctgtgaatgcagaaagaggaggtaagagaaatcagatagtgaatgaccgttggctacccttttaagagtctgaaaattaatcctgtgtgcttatctcagaagcccttgtgatctctaagcatccctcataatgctttcagaaacaaccaattagaaaccctactggaaaattatgatctagtctctccctctccccaagtgggtcacattttaagtcaagtgtcgacaatagtacttactcaatgacttgattttttattgaacttagcaaaattttaatttttttaaaccattaacttaaagatgacttcagagacttcatcatgaggaattttatcttttttacttttgaacattatctatttttccctcaaagtttctgttgtactctgaacctgttttaatgggaagcacagacatttccatcatctcaggttcagaaaaattaaaaaaaaattttattatggaaaaataaacatatacaaaagtagagcaaataggataatgaagccccatgtatgcatcactcatcttcacccattttcaacacatggccagtttttcatttatttcaggggtcaataaactttttctgtgaagagctgcatagtatatatattttcagccttgctggacacatttgatctttatcacttattttatttttaaatcttttgaaaatgtaaacatcagccgggtgcagtggcttacacctgtaatcccagtaattggagaggctgaggctgccagatcacttgagctcatgagttcgacaccagcccaggcaacatggcaaaaccctgtctcaacaaaaaatagaaaaattagccaagcgtggtggtgagcacctgtagtcccagctacttgggaggctaaggtgggaggatcacttgagtccaggaggcagaggctgaagtgagccagtcacaccactgcactctagcctgggtgacacagccagatcttgtctaaaaaaaaaaaaaaagttaaaaaaatccttcttactttggcaatagaaaagaatgaagtactgatacatgctataatatagatgaatcttgaaatattattctaagtgaaagaaaccagtggaagaaaatacaacatatgattccatttatatatatccaaaataggtaagtttatgtagacagaaagtagattaatagttgcttagggctgagaggcatgagaagggtaggtgactgctaaagggtgtagggttgttttggggatgatgaaaatgttctaaaattacttgtggagatggttgcaaaactctgtgtatatactaaagagtactgaattgtacacttttaaatgggtgaattgtattagtgaattatatgtccataaagctgttgtttttcaaaaagaatacaaaaacattcttagtttgcaggccatagccaaaacaagctatgtgcccatagcccacatgccatggtttgctgacccctgatttatagtcctaccttcctctcccaacctcagattactttgaagcaaatcccagacatcatgttaattttaaatatttcagtgtgtgtctctaaaaaataaagactcttgccgggcgcggtggctcacacctgtaatcccagcactttgggaggccgaggcgggcggatcacctgaggtcgggagttcgagaccagcctcaacatggagaaaccccgtctctactaaaaaatacaaaattagctgggcgtggtagtgcatgcctgtaatcccagctactcgggaagctgaggcaggagaattgcttgaacctgggaggcggaggttgcgtgagccgagatcacgccattgcactccagcctgggcaataagagcaaaactccgtctcaaaaaaaaaaaaaataaggactctttttttgttgtttaagttctttattgttttcaaaggcctagtatgcatacatatataagaaatccataaataatgtggaattattaatgtatattgtttaagataaggtcccttttaaagaacaaaacaccacaatgtcactaacacacctttaaaaaaatcatttcttaatatcgtcaaataacccagttttcagatttctccagttgactcatacagggtgtgtgtgtgtgtgtgtgtgtgtgtgtgtgtgtgtgtacagttctttgaatcaagagccaaacatttcatttgttttatatgcctcttaagtctctttaaatctgtaagtttctcctgcttttttctttaattctttgtttactttcttaagatttatttgttaagcaactgtgatattcatcttttagagtatcccatactctcaattttgctaattatatgtgtgatatcgtttaacatagtcctctgaccactgtatttcctataaaggtagttagcccagaggcctaatcagattcagatttcagttttgacaaaatttatttatagataacattatatacttcctgttgcatcacatcaggaggacataacatgttggtttttttctgtttttgtgatattaagattgaacagggagttcaggtattgccagcctaatctatccttaaggttttctgtcagcttttcacctaataaatttagcaacccatattttagtaggggttgcaaaatggtgacatttatttttcacttatgaactagaatagttctgtaaagaactttccctcatcctctgtttggttatgctgaagtatggtttgtataagaaaggcagaataaatgcttgcttattttcccttatttattataatactttttagaataatgaatttgttctctgtcttcccttgaattgttttgtcattatgaatgtagatttagatatattttgtgtgttttaatccattgtagttattctgcttattgatgaacaaaatgttctatctttggctagtgagagcttcttcaaactggttcctgagatcttttgatgtgaccttggtagcctaataattcttttggtttcagcattttcttattcttgaaattatcttggtttagctactcaaaagtagctttgtgttttttaaagcttagaataataaagacccttttgggaaatattatgttattttcttatcaacaaagactcagtattccactatagtcagttttaagaaacatctttattctatgttactttcctgtacatagagaggcaaccctataatacaaaaatttaagagaactagcttaactttaattaatttttaaatttgagtatgagtaacacaatgtgggctgcagagtatagctgagttaaaaacagagttttactctagctttataatttgatttctctgagatgatttctaagactgttctatatttggaaaaaatatatataaacaggttgctgtttaataacagcttattttttaaaaatgtgttgagcaatgcttttatattacaggtgctgatcggattgaattatgttctggtttatcagaggggggaactacacccagcatgggtaagtgtccatttttcccaggttttctgattggagttcatagagcctggaagcaactgataatcagtttcgttggggtcctttactaatgtcatgttaactatgttatggatgttgtatcagaaatgtttatgattgtaaaaaaatcaaagatttgatcaaacatatttctttctcacatcaaaaagttgaaaggtaggtaggtaattgttaataccggttcagctgctctgtagtaacatcaaggattaggcttttataaaatctttccatgctggcatccttagtatattgaaatcccctcctggtctttgtgctattgttgtcatatattttactcatacatatatcaaaaactccatgctgtattgttagttttgtttgaagagtcaattatcttttgttaaataagagatttaaataataagaaaaaaatcatatatttacccacatgcaactaccatttctggtgttctttattcctttgtgtagatcccgtatttctgtctggtttcattttcattctgcctgaagtactttctttaactttttttgttaaaaagtatgctagtgattcattccttcagcttttatatgtctaaaatagctttttccttcatttttgaaaggtatttttgctgggtatagaattctaggttgacaggttttttttttctttgaagatgtttttccattgtcgtcttgcttgtattgtttctgacaaaaagctatcatccatatctttgtttttctctatgtaatatgtctcttttttctacctacttttaagatttttttattattggttttgaacaattttcttatggtgtacctgagtatagttttttcatgtttcttggacctgtgcatttatacttctcatcacatttggaaaattttcagcttgcagcttgttctccactccctcctttagagacttaagctattcttacattagactacttgaaattgtcccaaaagtcactgatgaacttctctatttaaaagaaaatctcctttctgtgttttcattttgcatagttgctattgttttgtccttgagcttactgaccttttcttctgcactatctaatctgctattagtctctcctggtatgttttcatctcatacattgtagtcttcatctgtagaaatttgagtctttttatgtctctgatgtctcttaacttttttgaacatgtggaataaagttatgatagctgttataatgaccttgtctgcgaattctaacatctatatcagttctgggtttgtttcatttgatttatcatctaataatatatcttattttcctgccttgtaattttttattggatgcaagacattgtgaattttactttattggttactagacatttttgaattcctacaaatgttccaaaacagtttggtccttttgggtcttgcttttaagatttgctgggcaagtctggagcagtggttaatacagagctaattattccttactactgagtcaggattcttctgtgaactctaccctgtgaccatgaattttgaaattttcctgtctggctggtggaataggcattattcacagcttggtatgaatgacaggcacattatttctaatcctttttattggttctgtcccaggccttgcgtagtttctttgcatgcatgcaccggtcagtactcagctgaatattaaaggaggttctctgcagacctccagagttatctgtcttcctttcttctttcattccttcctttcctttcttttctttccttctccttttctctctctttgctttccttccttcctttttttcttttgacagggtctcacctgttgtccaggcttgactgaagtggtgtgaccatagctccctacagcctcaaactcctgggctcaagcaattgtcctgcctcagcctctcaagtagctaggattacaggcatatgccaccatgtccagctacatttgtttgtttgtttgtttggtagagatggagtctcaccattttacccagactggtcttgaactccttgcctcaggcaatccacccatctcagcctcccaaagcactgggattacaggcatgagccaccgtaccaagcctatcttttttaaaaaaaatcctttttttaaaccattgagatagtctttgctactccagtgttatctttctgtcctccctgtactgtctcctataaactctagctacttcagtcttcctgaactctaagctttgtctccttaactcagggaattgttttggctccatgtgggtcccccatccctgtgctttggcctagaaactctcaaggcagtaaattgggtcaatcagaattgacttactaacttcattgtttaccattttcaaggatcattgcccttcactgcttaatgtccagtgtcttgcaaaccactgtttcatatattttgtctgtttttttattattattattattataggtgggagggtaaatccagtcactgttaccctgtcttggccaaaagcagaagtctgtgtatgaattgtggtctcctaagttatgctactctgaggttgataatagcattatttaatgtaaaaagtttgtatacacaacagccctttggaatcttcacatgaaaagagggcattcctggccattctaaaatccctagagcatgtctgtaaatttgagtacagtctgtttttgtaacaccaattatgattcattgcttagtattggacaactgctatcctatgcaaaattggagttcttttagcaagaaaaaagaaagaaattcatactgggtaaacaactgatggggcctgtcacagccttatactattgatggtttatgagctagccacttattatggcatatttaggtacttttatgcatagatctctgcataaaatcacaaataagtagaactttgctccctttcacgtatcttgtttaaaaaaaaaaaaaaaaggttttgctaaatgtctttgcccattaaaggaatatgaactttgaagctatttaaccatctctccagtaggttttaaatagagctgtaatgaattagaaagaagaaattggatcttggggaataatgtactggcagaacatcgagcctggtagttattgcactttcaaatgtcacctaccaataaaagggttctgagtcataaggatttttgttgagtcaactgacaagtgcttttaaattgtagcatcttctgttttctaaatcgttctatttaaccctttgctattacttaccttctaccatatatacatttttcttctcagtgtctgtcctaccttttagagccatctttgtctggtaaatgaccaataatatatcattggcttttagctcacatttgaattttaatctgctttcttttcttgtaggtgtccttcaagtagtgaagcagagtgttcagatcccagtttttgtgatgattcggccacggggaggtgattttttgtattcagatcgtgaaattgaggtgatgaaggctgacattcgtcttgccaagctttatggtgctgatggtttggtttttggggcattgactgaagatggacacattgacaaagagctgtgtatgtcccttatgggtaagaatttgtatctaagacgtaaaagcctctaatgataattgtatttatgctcacaatatagaaaaacaacatcacaaaactgactttgcggtcatagctacagacacttatactaacctaagtatttcaaatagtagttatttagatgtttggggtggggtgtatgtgtggcaaagccttcttaactctcctcaattgctatagattaggctccgctactgttcccatagaatagaaatttaagggaaatttaccatggttcctttaaccactgcaccaagaacttcaaaagtattatagttggtgaggatggaccaccaagttggaagatgcaaagaggacagaagcaaactacctatgttactaaaccaaagtacttattgaatgacctcagagggacaagtattagatgtaatgctgcccttatagttgtcagattaaatggttttcatttggtgataagccacgaccatttttttgtataaaaatcagagatttgtggaaagataagacttttgaatttgtaaggctgccattttattattatgtcagtttactgtcttgttaggcgaagaaagtattaaaaagtttcagctaacatggagaattctatatatagtaatcagtgatgacatcttcattcatgttgttatatgactttctttttatagctatttgccgccctctgccagtcactttccaccgaggtgagtcattttcattttaaaagttctattgaacagtgttagttttctaatttcaacaactgccaccacctttttatggaacacaattctgtagtgttccaaggttaccaattggttttttagatcctaggactaaaagttataaaagtagagatgtgcaatttctagaaaatttgaagccttagttatgaaaagttgttaaaagtgggtgtaggtggtggtgggatataagagagcgagggagagagcaagtattgccttcaagtgtgtgtacctatcatagcattccaagcaagaatcctgagactcattttaactgagactgtattaggtcatgtgcaaccccaaaagaataaattgttgtggctggtgaaatgaaaggtactgtctatcttaagccaggcaaaaccatccctggggctagcagtgaggtggggtttcacagatagagacttcttaaggggagagaaagttgggtatctggagaagaattgggtcttattaggaagggagaaaggagaaacagatgcaatctagtgttgactatctagtcaatgaacagatgtccacaatagtatacaaaattatttttcattatagcttgtctgcaccacagtgattttttaatgtgatactttcttgtaaagaaatatttcctgtaaaaaatcaggtagatataattttttttgtttgtttgtttgagacggagtctcgctctgtcgcctaggctggagtgcagtcgcacgatccggctcactacaacctctgcctcccgggttcaagcagttctctgcctcagcctcccgagtagctgggattacaggcgcctgccaccatgcccagctaatttttggatttttagtagaaacagggtttcaccatcttggccaggctggtctttaactcctgacctcgtgatccacccgccttggtctcccaaagtgctgggattacaggcgtgagccaccacccctggccaaaaaatcaggtagttataatttctatactcttaggctacaccttggtaaaatggaagaacaagtatctattttgccttcagagagcactgccattgcacatgaaaagaagtctacagtcaaaaaaaatttttttacttcaaatttctgttctgttctttattccaataggtttaacaaaaatattttcatattttcaaaatttgtagaatttttgggttccacatttttctcactaatgtatttaatgagatatcataatatagttttagtggtgagaaggtgctgccaccaaaatagggaaatcctctgtggtagatttagttgcctacatacactaaagggtgaaatgaaggggcctgtcccagaggaccactaccacctaatccactgcaggctagagcttcaatgtcatgtagcagtatgagaaccaaagcagaagtagattttctgttttcagtttcctgataccactttactctttgagggctctgaggaggggagaaatctcttagaaagtaggatggggctgggcacagtggcttacccctataatcctaccactttgggagaccgaggtgggtggatcacaaggttaggagattgagaccatcctggccaacatggtgaaaccccgtctgtactaaaaatacaaaaattagctgggcgtggtggcgcatgcctgtaatcccagctactcgggaggctgaggcaggagaatcacttgaatcagggagtcagaggttgcagtgagccgagaccgtgccactgcactccagcctgggcgacagagcaagactgcatctcacaaacaaaaaaaagtaggttggaagtgaaacttcatatagtctgttgaaaacaactacccttatgctatgaaccttgagtatgtggggttaatagattaatccaaaatattagtcagtaatgagaatgtgagccaaggctttttctagaactggtgagtacagtgtttcattctacctagtccaatatttctgaagccttagaacagtttcccaaatttgactcacctgcctatcacatttaaaattttaccatatatgagtgctacctgtgcacatttttatttaatcattttctttaaataaaatcttaagtatgcacccataaaaaagaacaagatcatgtcctttgcagaggcatggatggagctggagaccattatccttagcaaactaacataagaacagaaaaccaaataccacatgttctcactcataagtgggagctaaatgatgagaacacatagacacatagaggggaacaacacacactggggcctttccgagggtggagggtgggaggacagagaggatcaggaaaaataactatgagtactaggcttaataccttggtgatgaaataatctgcacaacaaactcccaagacacgggtttatctgtataacaaacctgcacttgtacccctgaacttaaaaaaaagttaaaaaaaagtaaatttattttaaatagaaacttttataattactttatattgaaaacttttcatttcttatctgcatttaagtaaatatactatttaaatgtgtaccattattaaaatgattatgcacagtggtatgtagactgtggtgtgctgatgaactggctcctagaaaaaagagccctgatttgtagcatttttaaatttctgtggtttaaatactctaccttcactgaatttttttattattattaattaaatttttatttttcttttgagacaagtcttgctctgtcgtccaggctagggcacaatggtgcaattggctcactgcagtctcgaccccttaggctcaggtgatcctcccatctcagcctctcgagtagctgggactataggtgcacaccaccatgcccagataatttttgtattgtagatatggggtcttgccacattgcccaggctggtctcaaactcctgcgctcaagtgatctccccacctcggcctcccaaaatgccaagattataggcacgagccactgcacctggccctaccttcactaatttcaggctgccagtggattaacaatctgacttgcagaattcttgagtgtttaataattggcctttgtaagccagtacaagctaggtccagcatgccactgcatgtatactacattttgggaaactctgcgttagagatacctgttcaaaattcacatcagttttatttatttcagcctttgacatggttcatgatccaatggcagctctggagaccctcttaaccttgggatttgaacgcgtgttgaccagtggatgtgacagttcagcattagaagggctacccctaataaagcgactcattgagcaggtacgtggactttatctttttttcccctaagactctgttgtggttactcctgacattctgctgtttagccagtttgtgagactatatattactgactttgtggttactctgtaggaaaagcaagcaggcaataatgtatataattcttatttctttcacacaagcctttttaataaccaaggctttcaagatcaaattacatatagatagtgcctaaagatctgatctaacttggataagcacagcaaattttaccttttctctgccatgggcattgcagttttttttactttttatttttattttttagtttagatataaggtcttgctgtgttgcccaggctggtctcgaactcttgggctcaagccatctgccttccttgccctcccagagtgctgggattacaggcatgaggcactgcgcccagccagcattgcagttttaagccacatcttttcattgtcagcccatgtatattcaggggatcccatataaaattatcatctggaggtaaattccaaaactaaaattataatcttatttcttctcatctgtcaatataagaggaaatatatttttctattttatgagttttcctggtgagctagcatcatttgtagagcactcagaaggtgactttgtaattaatagtatgtgtatttttctgatgtcagtccagaggcattataagttagtgagtacagactttgagatgagagagttgagcgtttgagactcgggtttgatacttgctatgtgatgttgagcaggttaatagtctttaagcctctctttccccctgtgtgaaactgagatgagtttaatacttattttagagtttctcagaagattgctaaagatgggatgtgttagaggcttagcacagtggttggcatatactaggtcttaataatgttaggttctgttattactgctattattaataatactaatgttcctgtgtagacatctgcttattttcacttttctatagccatgaaaataattttcagaaatttctcctaaagatctgatgtgactttgctattctgggatgtaatggtttcacagacatttattaaatatatattagatgcaggacatttgtactgtgggggtaaccaagggctaagtgtctgtgtgtagtcactatccttacaatttagtgcagaacaggcacttctaatagagcaggcaattttaatagagctctatttttaaaaggtactataggagtacattggagaggaattaaccccaaatttggggaaatgaaggttggcaataattagaggaagcttcccagaagaaaagacatccagactgcagtgttttactcatttgaaggatgtttgggagttatctgtgtaaaagttgggggcagtgggagtgagggtgaaggggatgttggtggaattgttccatacaaaacaaatagtataagcaagggctataaacaaaagcaagcataacttaaaacactgaggaatggccagaatattgaatgtggacagaatgatatccagagccttgaaaaccttattaaagtatttattttcatggtgcagcggggaggcctaaagtgttttaaaatagaagagttgatgagtcaggtttccagttttaaaaggttactcagtaaggagtagcaaataagatataaccgccatagtaatgtattgcatttcaaaatgtgtatgtgtgtgtgtatgtctgttatttgtatgttaatctattggttagtaggaagagctactcaaatattctcatacattaacttcactgaagtaactacctagtagtgtaacatactagttaaagcataggctttgtgattggacaggtctgtgtttaaaccctggctttgacccttactaatagtgaccatggatacattacctagccatcctaaacctcagctttgctcttctgcaaagttaggataataatagcacctacctcctagaatagttgtgagggatttcttcaggttatagcacttagtaattgttctatattattaaatctgacatttagtgactgctctatattattaaatcactttgatagccttagataagcatatacttctaaataatcttgtatggaaggcgaaaagaaatggtagaattcatttctttaaaaatattatttctctatgttttggaaagccttgatttggaagaaacaggcaaatatgacttttttccattctgaagtgatttcagctttttagatagtcaatgttttgttttatggatgctttgttcaggccatttgagaatatgaagcatccttgttccatttatttccctaacaatttttaaattatttgaaatagccactcccctctttcactctcttgttaactttattttttgctttatttattcacttgctttattttttctttgttatacttattgctacctggaattttattgtataaatatccctgtgcattgtctcgtctttcttgaatgtgtaagctccatgagagcaggaactttctcttactcaccatgtcagggaggaaaaacttttcttctatcctcagggtttgttattgggggcctgcaaattaaactgactaaagacagattagcaggagtaaaaagagattttatcacataagtacatatatatgtaagtacatacagaagttcacaaagaaatatgacttagaattgggggcttatataccatcttaataggtgaaggggaaggagaaaatggcacttattgggggggaaaatgactttttggaaagataattttctagagacaaatttactatgctggacatcttacttgtccaagatcccaaagaaatagagaagatctagtaaaaattaaacattaatagtaatttttaaaatttaatatattctgacttatgtttctattctcactgccttattatcccattcaagagaaagatattaaaattcacttgtttttttttttcttttttcaggcaaaaggcaggattgtggtaatgccaggtatttatttatctatcaattcactagcataacactgaactatagtggaggaagagcaaaggaggcaggaaaatgtgagagagagtattagtacattacatattagtacatgatctttaaagagaagaatatatagtttgattaaaatgtttaaaactgggagatctgtgctagaatttaaaagtttagataagaaggaaaatattgtaataggcattagctcaaagaggagcaaataaggaagcagatagagattgaggtttctccatatttgctctcccattatatagaactttatgaattcagatgttcatctctggtgaggcacatcaaatttgatgctaatcatattttgtttaggacaaatgtcctaataaacagggtttaagcaaaggtttaggcaacatccttgggtaaaatataatactgtctcagttcctgaaaatctctgattgccaaattatttcttgtaaccagaatttaatcatatgatcctgatgataaccataagatcagttaagttcataatggctaactagaaatgaacagttggagcagtttttaaagaattagataatacaacatagaagagtgagacaaatgtaaagacaatcttaatttttttaattaagtttctcaaacatataaaaaagtagaaaatagcataatgaatactcatatgctcattccctagatttaacattttgccaaatttgtctcatcttttttctatcctgaggtattttattaaagttaaattgaaagcatcatggcattttatctttatttatctctaaaaagggtgggatgttaccataatgacaattccattatcacatctatcacaataaacatttaatactcaactttctccaattgtccccacaatggtttttatagctgatatgttcaaactaggatccagtcaaggaacaagcattacatttttggttatcttttgtttgtttgtttgtttttagagatgaggtcttgctatattggccaggctggacttgaactcttagcctcaagcgatcctcctgcctcagccacccaagtagctgggactacagttgcacgctgccatgcccagttctattatcttttaaaatatctttaatatagatgtttttccttttatttttcttgctttaaaaaaaagttacattattaagtttgggctgggcccagtggctcacgcctgtaatcccagcactttgggagtctgaggcagccagatcacctgaggtcaagagttcgagaccagcctggccaacatggtgaaatcctgtctctactaaaaatacaaaaattagccggccatggtggcatgtgcctgtaatcccagctacttgggaggctgaggcatgagcatcacttgaaccaaggaggcggaggttgcagtgtgctgagattgcaccactgcactccagcctgggtgacacagcaagactccgtctcaaaataaaataaaagtttggatcacttaccctgtaaaatgtcctactttctggatttatcagattatttcctcatgatattgtttagcttgttcctcgtgcctctgtatatcctataaactaatagttaaatcatgaggtttgaatagactctgcttaaatatttttggtcagaatacttcatgggtgattctgcatacttacatcatatgacatcacatcagaaggtattcagtctctggtcatctcactactagtgatgtcaagactgaccagcgttcaaaatagtgacacctagataaagagtaacttttaaaaagaggccgtgaacctgggcaatatagtaagacaccatctttaccaaaacgtaaaaaaattagttgggcatggtggcgtgctcctgacgtcccagctactctagaggctgaggtgggaggatttcttgagcccgaggtcaaggctgcagtgagctatgatcgcaccactgcactgcagcctgggcaacagagtgagaccctgtgtcaaaagaaaaaaaaaaaaaggccatataaggggtattgtcagatatttaggaaggctttgacctataacaagcccttgaaacataagcagagagaaagtatatattatctgtcaaattgtggtcctttttggttaatcaaggaatgttaaagagactctgagtgtgatgcttttccatttagcactaaatatatatagttttgacaagtaatacttagacaattgttgacattaagagtacctttgtttaatatgcaattgttatcagctgtgtgcaaggcattacttgggatgcaaagctacacaagaaactacgttctcaagaagctgactcaggtcaaaagatgttacatacaaaaatatttgtgattaatttctttaacaaaccttatcaggtaaatgttaattgtgtgacaattatgtatattttatgctaattgtgtgatagatatgaaaacagaaataaagtaatcctacttgaggagctcacagaatagacttataaacacaaatgtattacaatttcatatgaataagtaccagcaagtaaaaactcctaggtaagtcattctgaatgcctaataagtattcatcattgagaaatataaagaggtagttgccctctaggaactttcataatgaaacctacaacatatttaggctctggtttcttcatctataaagagaagaatattaaactagttctgtgggatcctttttaaccatagagctgtgttagtctgagtctggaaagatgtattacctatgtacttaagttgctgataacttagcaacatgtgtttcagtggccagatgttttgttatttgttagaaggaatagaaggaaataatatatttgtctcttaatccttacaataagcttgtgaggtagccagtattatccctcttttattggcaaaaaagttgaggtcagtggatttaaataatttatctaagatcacatagctgtgaagagctacagtgataaagccaggatttcagtctaaatctactcagcctgtattttttctatttctttctttttttctgagacagggtctcactgtgtcgcccaggctatggtgcagtggtgcagtctcagcttactgcagcctctgcctcctaggctcaagtgatcctcttacctcagcctcttgaataggtgggtctacaggcacccaccaccacatccagctaatttttgtatgtttttgtagagacggggtttcaccatgttgcccaggctggtctcaaactcttgagctcaagtgatactcctgccttggcctcccaaagtgttggaattacaggtgggagccaccacactcagccttttttctatttcttaaggctcagtgatattactgtactactaaggaaaaaaagacaagttaatgagtctgaaagagtgtgtaaaaataggttatttcagcatctttaatggcttgagatacaaagtacatagttttaaaatattgagtacatcctatagggagataaggatataaagatgaataaactaatttcatatttatgatacactagtatcagttcagaatatgattctttatatataaatatttaaaagattgttcatcaaaacaaatgtcataaaatatttggtggtacagttttaataaagtagaatcagattcttctgtgaaatgaagtataaagctgatatcgtaactaataacctgtataataccttgcattattcctgtttccaatgaagtcagtgtagtctttacatctggggctagagacagaacagaggttctctttcagacacatctctgaggttgtgcttttgtagatttttttcctcaaacctatccttacctttctttttaatttgattttgctttaattgagggacaagcagggatagcattgttatattagccaatggacagataagattctatcatacatgttctataaacttaatggtacttccccagagtctgtagcctatatatcttttatcacttctctaatctcattctagctgggtagggagagactaatttttgaatcaatgagaaattcagtttggggattccaagtaaagtaagcagtcgttactattccttaaattttatgcaaaattctattttacttaatgtgttacttattctttgcaacaggaggtggtataacagacagaaatctacaaaggatccttgagggttcaggtgctacagaattccactgttctgctcggtctactagagactcgggaatgaagtttcggtaaaaatgtattcttcgattcaaataagaaggatgagattaatttttactttctcccaaatagaaaaactttggatgggggcatgattaatcaatggaatattgtgactactacataagtattgtagttgtttttgtagttgaaaaacatttctaaaatggttcttgtcctgtcttaaataaacaggctctttgaacataggtgaaccttgccttgtaaaggcattgctgaacttagaccagttaatagtaaacaaattctgcagttgagcttcaaatgagtcagatatgcacatgtgcccattcgcctatgatttcctgtagcaaagttaataactatggtgtaaggatggaagagtcagtcatttttctccctcctacctttagtacttagtcttccctcacatttgttctctgttttcagttattttgaaattatattaccattaagaaattgtgagtattatatggggttttttaaatacttaagaagactcttacaatttaatagtagttgaatatttctgtttataaattgggaaaaacacaatgtaaaagaagcaagatggctggctgggtgaggtggctcacacctgtaatcccagcgctttgggaggccaaggcaggtggatcacttgaggtcaggagttcgagaccagtctggccaacatggtgacaccccatctctactaaaagtacaaaaaaattagctgggcgtggtgatacatgcctgtaatttaaaaaggaaaaaaaaaaaaaaaaggaagcaagagccttagaacttacaattccagatataaaatcaagtatactgtccagtggattcagctgctggatgtttcaagtaattaattgatgaaaattatggaatatactagtccagcatacttgacctacccttgtatcatgaaatagtctataaaatgaagcggcagtaggagggcccatttaataacataattatctgttcctttattatttctgttacagaaattcatctgttgccatgggagcctcactttcttgctcagaatattccctaaaggtaacagatgtgaccaaagtaaggactttgaatgctatcgcaaagaacatcctggtgtagccagacctctctgagagacatggatatcacaggatgaaggtagaactataatctgcaattctctatgacacagctttaaccttcttctctggccaggacagtcgcaatctttgttttaagtttcacatggccatggagaatgtgcccaagaagaaaaagaatttgaaacagagatacagtcacttcctttgcttagtcttaccagtgattgtcatcatggttaaagctggtctgtgcttcttccatagacagaagcttagtctgttttcagtggaattaattgatgaactgggaaaattttaactgcatggtatgaattcagagtgtgacttaagggtcaattcaaagcagtattttgacttttcatttgtaaaataaaaatttccactattaca

SEQ ID NO: 12317 - DNA, 52845 bp, Homo sapiens
gctcgagtaggggagcttgaagctactgacactgaagacccaaatctgaattatggacttgttgttgactgtggcagcagtggttcccggatttttgtttatttctggccaagacataatgggaacccccatgacttgctggacatcaaacagatgagagaccgcaacagccaaccagtggttaaaaaaatcaagccaggtactaatcagaatatattttgttgtcagtctcttttaaggcatgaaagaggagacaaaagaagcagaaagcaagctacccctttcttcttgagagtctgggtaatgggagggatatctctttcattgtcaccccctacctctcaaataaataaatgtttaggaccttgaggagaactttatagggtatcagtttcctgagtcttatgtgagccgctttttaaagaaagttttgtctgtttgtttgttttaacttaaggaatctctgcaatggcagacactccagaacatgccagtgattaccttcgtcctctgctgagctttgctgctgctcatgtgcctgtgaagaagcacaaggagacccctctttacatcctctgcacagcaggcatgaggcttctccctgagaggtgagatgcagggtacaggaaacacaggaaaacggtggcacaagagatgaaaggccagtttcatgcactgtcctctgtggttccctggtctatacccctaaacccaattatgacacaatcattcattcccaacttcttgtcatttgctgctttgggatcagtatctatctgggatgactatagtgattcttagtttggattgagggttgggagtagtggtgatggtaatagatttggatcatcgggcacatagagaacataattacagaataaattaggaagagggtcacctgatgacctggatacttagggactagtcagagagctctggtaggaacactaccttttctgtaactctgcctagaaccctggcaataactgggggagtccctcttcttgctgctactgcaaagctcagtctccattgccttaggcctgttttctcagccccagccagtcacatcatttccacttgacctttgcaattcagcctgacaccttgccacctgatccctcttcctgcattagaggaagaggaagagaaggctgtatttaggccagactccttgtttgtgatttctctcctttggtaccaccttgatccgtccatacttacgtaggccgggggaagaatgagctccctgactttttttttaatgatttttattttattgtggtaagcatacaacatgagagctaccctctaaccagatttttttctttttttttagagacagggtctgctctgttgcccaggctggagggcagtggtgtgatcacagctcacttcaacctctgccccccaggcccaagtgatcctcccacctcagcctcctaagtagctgggactacaggtgggcaccatcacacccagctaatttttgtggagccaggtttcaccatgttgcccaggctggtttagaactcctgggctcaagtgatccgcttgcctcagcctcccagagcgctgggatttcaagcgtcagctaccatgtctggcccaacaaatttttaagtatacaatacgttattgttgactgtgtgtacagtgttgtacagtggatcttcagtgcttattcatcttgcttaactgaaattttgtgcctatttatttcccttagcatattgtcgttagtgttcatccaccttgtcacatattgcagaatgcccttttttatttaaaaaagtctaaatagtattccactgtgtgtatgtaccatgttttctttacatattcatctgtcagtgaacatttaggttgtttccacatcttggttattgtaaataatgcttcagtgaacatgggagggctcatatctctttgagatcctgattttaaatctttggaataattagccagaagtaggattgctggatcatatgacagtttgattatttatttatttatttatttatttactgagacagggtctcgctctgttgcccaagctggagtgcaatggcatgatctcggctcactgcaacttccacctcacaggctcaggtgattctcccacctcagcctcccaagtatctgggaccacaggcatgtgccaccatgcctggctaattttttgtatttttttttgtagagatggggtcttgccatgttgctcaggctgttcttgaagtcctgggctcaagcagtctgcacgtcttggcctcccaaagtgctgaattacaggcgtgagccaccgtacccggcctatatttttaattttttgaggaacctccatactgttttgcagagctgctgcaccattttatattcccaccagcagtatgcagagtttccaatttctccacagccctgccaacacttgttgtcttttgttttttggataacagccatcctgacaagtgtgaggtgatatgtcatcggggttttgatttgcatttccctgatgactagggatgttgagcaacttttcatatgcctgttggccatttctgtgaatggagaaatgtctattcaagtctttagcccatttttacattgggttaataggatttttgctgttgagttgtaggagtttctaaaatattttaaagataaaccccttaccaaggtatagttcgcaaatattttttcccattctgtagcttgcctttttactctgttaattttttcctttactgtacagaaatttttagtttgatatagtcttacttgtttatttttggttgcctgtgccttttggtgtcatatcaatgagaccattgccaaccttaactttagaattcatcctcctggaatgttcatggtctcataggcatcaggtatttccttattagcttaaatattttcctttggtcaacagcagtttttttttttttttacaacgtttaaattttatagttggctttctttccttaaatcaacagcaaacaacaaaaacctcagccatacatgtagggctccaaggcttatgtcagacatgtagacaacataacatatagcagcaatgcttctttcagtggactttttttcacagttactggtttactgactggtttactgttgagaagcagattatttatatagccatttgtcaacatgagaggttttttagttccttattgccccatacatttcagtctttaaaaaattttttgttttgtttttacttatctttaaaaccaaactttaaatattgtaactgcagccttaactccttaagggaaatcttaaaaatgaacaaaacaatacaatacaacttacaaccctgctaccctatcaaaactgtttcgttttgttgtattccctcctttctgttcacatatatgtaatttccacaaagttgcaatcatactgtgcatgcaattaagaatttttatttgacataggtgatattcatattgttcaaaaattttagaaaccctgggaagaatatagatgacacaagagcaggtgccacatcacaaagtctataaaaggccaaggaaaggggagggaggccagagaaaaagctgacctggaggttaaaaaggcagaattgaccagctgagctgggcagaggaacccacttggtagtttggctacctttagtgtgtttggaggaaaggagattgttgcctcacctcctggcactgttcggtattacctctgtcaaagaagtttccatccaaacaaaacccactgtgtagctccaccctttttgtctaagatgttagttgtcaatgtggaaactctgaatattaatatttattgtatctaaagaatttttaaagaaatttgccttttttttttctctttcaacttgttttctggtcacctctctaaataatgcatacatctgttctaggcttataaaatcattgctgcctctaagtccaagcgagttgttggcataaatgtgactatcagtataagaacctgttttgtatgattaaaggtttgctaatttattagcatttgtaagcagattcaaaatagggttgaaccatttagactatattttgaatttattagcatttggttttatttctttgccaaaggcctggactaacagaattttttctacctcccttttattttgcagttaaaaaaaatcccttaaaaattacaccataatacaaggtggtgtttaataaaataataatttttattttaggaaatttcacttgtgtataaaagtaaagagaacagtgcagtaaatccccatttacccactacccagctttaacaattatcaacatttcgccattttaaaagcattttaaataaataaacaatattgaattttagaagatgaaagctttatcctgtcactatgtatacatgaagaatgatttgggtttttgtttttttagcataaatggaatcacattatacatactgttttgtaaaatgtattggacatctcttatcttttcatgtctatacatgtagatataagtagacttcatttcttttaacatctgtatagtattacattgcatggctgtgccataagttatttaaccaatccctatggtatggtatttccagtttttcattgttataaataattttcattgttataaataatgctgcagtatttctcttctttattttattgtttgatgatttccttggaattaatttctaaaagtataacagctggatcaaaggttaaacacattgaaacattttgaagcatggtcctggattgccctttagaaaggttgtactagtaatttatttatttatttattggagatggagtctccctctatcgcccaggctggagtgcagtggcatgatctcggctcactgcaacctccacctcccgggttcaagcgattctcctgcctcagcctcccgagtgggattacaggtgtctgtcaccatgcctggctaatttttgtatttttggtagagatggggtttcaccatattggccagactggtctcaaactcctgacctcaggttatccatgtgcctcaccctcccaaagtgctgggattataggcatgagccactgcacccagcctgtactagtaatttgcataactaacagcaacatatgttgttgcccattcttccatatcattgccaaaaccaacgaaccctctctttgaggagtttagaagcatatccaatagggacagaagaataccccttcttggtccccatttgaaattcttattgcaagaatttaatatgtataacaatgaactttttttaagaaactatacttgacattatactggaagattattacttcaaatatagatcttcactttgaagtgctaacaacattcttcatcaagtagtactgacaactgtctgagccagcagaatatttttgtattgaatattttttaatccaagataacttgtcttattttaactaacattttctctagatgcatattattacttctagctttgtttctttgctttcctttgcttgataatattgattacatgcttaaaatgttagaggaaagacaaccctatagatacaaagtttcaagtgttttccccaaattggaaatgttgttatgtcctctggattttgatcctgatctagggttttcaaatggtaagattttcacaatgaaaaaaaaatcaacccttgaaatatggaaaaggagattaaaaagttaattgtggctgggcaaggtgactcacacctgtaatcccagcactttgggaggccgaggcaggtgaatcacctgaggtcaggagttcgagaccagcctgactaacatggtgcaaccccgtctctactaaaaatacaaaattagccgggtgtggtgatccatgcctgtaatcccagctacttgggaggctgaggcaggagaatcacttgaacctgggaggcagaggttgcagtgagccgagatcatgccattgcactccagcctgggcaacaagagtgaaactccgtctcaaaaaaaagttaattgttagcttatgtaaaggattacattaaaacttgtggaaccaacagtacatcttgtgtggtaatgtgaagcattgtttctatgttgtgtaagatttgaggatgagattgtgttccttaatttaacatctttgttttacagtagtgaggaataatgtaattacatcaattttatagtttatgcaacttggctgcagtttcctgtggcttgtttgtactcagcctgtgagagtcatagaaccgtagtctcatagcctcatcttttaacactctttgaataataacatcatataaggggaaagtattactattaccatgttgccttttaggtaggaggctatacctggaggcagtttaaacttttaaaatcaaaggcggtaccaaaaagaagcagggctggacaagtagatgaggtaggtgaacagtgaggtcatgacaaggctaagtagaaggacaagttgaggcagtttatgagaagagagtttagtgactaactttgggattttttgttctttcttgcaggaagcagttggctatcttggctgacctagtgaaagatttaccactggagtttgacttcctcttttcacagtctcaagcagaagtgatctctgggaagcaggaaggtactgggccttaaggggtgcagctggttaacctctaagccaaccatggcacagcctctctaacgggtgtttagaattattctatatatcggattttaatttttctgccaataattttcttgattctgctacatagttgatttgattatttgcatattttgcattggcatctgtttagaatgctggttctggaagtcaaaaatgtatatctctttttaacttagtactaagcaatatgtttataagaatgtattagtatttaatgatttcagttggatatttggttagctaactgtacttttgaaaacatatatagttctaggagttgtattgagtttgtcaaagtcaaatgtaaggtaaattattaaagtaaggagaaactttaattccaagggatgatcagaatgagttacttttgttttgttatgccttcattgcaattactatgcagtattgataattccctggaatctcacactattgggtttgtacttttagagtgaatatgtgttctcatgcagccaaattggccagtttgatgaattatatttccatttcttataaacgagaaggagatttatatgtcttctaattgcagacatatacatgggaaaagatttaccttttaaaatttcagtattgcatttttcagttgtaaaatttctattttgatcttcttaatattctatttcttttcttttctgtttctttgctgagaccttctatctttccattcattgtaggactgcccatatttcttggttatatggttgctctaatatctttgataattccaatatatgtgtcatctcagagttggcatcttttgattgtcttttctcttgtgagttgagattttcctggttctttgtatgccaagtatttttatattccatcctggacattttgaatattacattatgagactctgggtcctgtttaaatcaaagagaactttttttttttgttttaggaggcagttgatctcaagttctgagctgctttctgtaggctgtgaatctttttttttttttttttttgagacagagttgcactcttgttaccaacactgagtgcaatggtgtgatctctgcttactgcaatctccacctcctgggttcaagcgattctcctgcctcagcctcccaagtagcttggattacaggcatgcactaccatgcctggctaattttgtatttttagtagagacagggtttcaccatgttggtcaggctggtctcaaactcctgacctcgtgatccgcctgcctcagcctcccaaagtgctaggataacaggcgcaagccactgcggccggcccgtgattctattagttcatttttcttttctttctttctttctttctttttttttttttttttttttttttgagacagagtctcgctctgtcatccagactggagtgcagtgtcgtggtctcggcccactgcaacctccgctccctggttcaagcgactctcctgcctcagcctcccgagtagctgggactataggcgtgtgccaccacgcctggctaattttttgtatttttagtagagacggagtttcactgtgttaaccaggatggtcttgatctcctgacctcgtgatccacccacctcagcctcccaaagtgctggaattacaggtgtgagccaccgtgcccagcctattcattcatttttcaaagccttggccactgctatttggatttgtcctgtgtatcagccagtggctaatctggaacctgggcagtggcctagcctgtagttcagctctcagagctgtttggatattgtttagggtcagatccatgtatttgtagcttggaggtgagcccaggggttcatacacaactttgctccctactgtctgtgatccctctgccactttctggttccttggagctccctttcatgatcctcctgtcagaataccagggctttaatttgcccactctctgccatgcacttctcatgactgcatctgcatccagggccaagcggtaggaggacagagggagcctaaataaacaataggatttgtttcacagtcttgaagctacagcttctctggtcagagaaaagaattcaaagccctcagagttttaggtacctgctcaaattctacctctgttgcctaaggttagagagaacaaaataagaaagaaaaaaaaagcaggagatttcccttattttctctgaacttttggcattcctttttctgttctttggaccagaaaatgagttgaagttcctctgttcacacctggtgtttactttcatgtttcaagctgctcttaagtctagaccaggtaatatctgagggggaaaaaatgggacactcactactggcttggtggtagtttaaaccctggtctctttcccggtgtgctcattatcatttactttcagagtttccagaaagctgctccatgcattctatctagagtttatatttgtattcagtggggagacaagattgcccagaactagaactccaaaatttacattttttcttttttttcgatatcttcgtgacattcagatgatttatacttcttagacatttgttatacaattaatttctattcattgaggaaatttagaagatgcaaataattttaaaagggaaaaaaatcacaagatgaaagatttgaaattcctacattgagagtatggaataaaatactatgattactttttccaagaaaaagaggaaagagaagccctaagggagaggtgtatacatggcatagcagtagagaattaagtgagggcttttctgtttcttacttaggggtttatgcatggattggaatcaactttgttttgggaagattcgaccacgaggatggtgagtaatattgtctttttatgacagtttacctaagggctgaagatttaagttataacctatcagtagcatgtaaatgcaaattttgagttgtttttcttttttcaaacataagatgcttcattttccagtcctaatttgctttctttgatttctttttaactttttaatatggaaagtttcaaacattcacaaaagtagaataataaaatgaacctccatggacccattacccaggctcaatatttactaatgttttgccatttctcccccatatccccccatgtattaaaggtttttttttctcattgaatgttttaaaaagcaaaccccagacatgtaatttttattttcatgtatgtcagtatgtatctacaacagataaggggtttcaaaatgaacaaaaaatatatccataatgccatttttaaatttaatagaattaacaatttctaatatcatacaatacgtatctaataccctatccaggtatagattttcctgattttctcaagaatgtttattcgtagtgggcttgttcaaatcagaatctgaacaagggtcatgcattgcatttgattaatatgtctctttagtctcttttaatctataattgttaaccttaccacctcactcccctgcctttaaaagcaagaaaaaattggatcacctggtagaaagaatttgccacatgctagatttgattgactgcatctttgtggggttaacatgttttctttaacatgtttcttatcccctcatatgtcctttaaactggaggtcagatatagatgtttgattagactcagattcaattccatctgcaagactaaatcatagaaggcgctgtgtgttttccactactcacatcaggagttttgtaatgtctggttgactcactttttgtcatgctcagactgatcaggtattgagagttcaagtattatcagcctgatctaacttagtattaaaattccttatctgcctttcatggaattgtggtaatagccaattgtgatcattgcttggacatgtttttcattagagattgcaaaatggtgatatttctaattctgtcattccttctgcatttaacagctagaatttttatgtaatgaacttttcttgatcaactctttggttaccctgacatatagttcttatgggaaagacagaataaatccttgattctttttatttatcacatttctgaataatgagttggtgtctagcaacttccaaaggtaaccagtgaaaaaaaagttttaattattattatgaactcatggattttaatatattagatgcattagagcccatcacattattagtattttaaggagcatctttaggttggctgctgtatccttttaatatgaccccaatactcttttatattccccttgctatctggtacagcaatgtattccagggtcatcttgtatactttctaccctagacctggcattggcctgtttttaaaagagccctggtttcttttagtaaaagatggtatttagagattattggtccagataccacaggtggtcattactcctgggatatcattgcttctaggcctttcagtgaacacagctaggaaatatgtattttttagaaagagaaaaataaatgagttcatagtcatatttctgactcatatgtaagattatagggtgctattaatttatttgatttttatacctatatcctttttgttctgttatgctgaatctttgttcctaaagatattgacataaacatttatttgttttattccacaatatgtttcataattttttttttttttttgagacagtcttgctctgtcacccaggctggagtgcagtggtgcaatctcggctcactacaacctccgcctgtcgggttcaagcgattctcctgcctcagccccctgagtagttgggattacaggtgtgcagcaccatgcccggctaatttttgtgttttagtagagacagggtttcaccatgttggtcaggctggtctcgaactcctgaccttgtgatctgcctgcctcagtctcccttcataatttttaaataataaaaccaacaatattgttaacaagactactgcgatgtagcttaagatatttgtttcttttgtccttaggctatatcctactagggatacgtagtcaaaatgtcatgtttaagtaattcacaagaattattctttgtgtaatatatagttgattcagttagtatacttgtttgctttcttttttttattttgagacaggttctctgtcactgaggctagagtttagtggtgcgataatagctcactgcagcctcaaactcttgggcacaaatgatcctctggcctcagcctcctgagtagctgggactacaggtgtgcaccaccatgcccagctaattaaaaaaaattttttttttttatgagagtgtctcactatgttgcctaggctggtcttgaactcctcggctcacataatcctcccaccttggcctcccagtgttttgggattacaggtgtgagccatggcacctgcctgctttcaaattttcaagggattgctgttttgggggtttgacttaattttattttttaattactagggcctttttgttctcttatttatttcagaatcagatgctgaggctacccaggaattggcagcaggacggagaaggacagtagggatactggatatgggaggagcctctctccaaattgcttatgaagttcctacctcaacctctgtccttcctgcaaagcaggtactttaccttttagggaaatttagttgctaggaatgctagtatttgagaaggaaggacactgtctttggacttagaccaacctacctggctctaaatatttgttcagatacttgctagcttgcgttatcttgagtaggttacctctctgagcctcagcttcctcctgtgtgaaaaaggaataataatagtatctacctcataaagttatgaggatgaaataataccatgtttgtaaagcatttagcaaactgtccagcataagtgttcaatacattttaacaattataactatactaggtatctcctgccattgctgaggataaacatgataatgcatttacattctggagcacagtatttgatacatatctattgttcaataaatgttattccctttccccttactgatgattccattctgggccttctaataatccttaccccactagaatgtaaagaatgtattttgagggagaagtttcatcctacacagacactttttgtacagccattatgtacacctattatgtacacccattatgtgcaaggaatagacaatattatgtacaaggaatagacatgtgagttacactgtccctaaaaacttataatttatctgtcagtggagacagcttgtgatatcagggagactgtagcagtgcttaacttgatctaaaccagggcttctcatcgttggcactcttgacattttgggtcagataattctttgtcatcaggggttatcccatgcatcatatgatatctcttgcctataccagatgtcagtaacaaccctcccccttccagttgtgacaatcaaaagtgtctccagacattaccagatgtgtggggcagggtggaaattgcccatcattgagaacatctggtttaaacagagagctgtggcaatatggggactggcagccaacttagcttgcaaagttgaatgggagccattcttgcttcatggaaggtaaagtatttacctgggccttggatgagagtaggcttttttttttttgcagagtggaggctgagggaaggccacctgcatggagggaacactatatacaaaggcacagaaaaagcagcacagaggccagaatgtccagggaatgacgaatagccttttgcagtataggattttcaggtgtgctagtagttaagactgggaagataagatggagctaaatcatgagcagtattgagtgctatcataaggggactggcttttatttccatagatagtggaaaaccaccaaaagtttttgagtaaggcagtcacatgggcctcagtttcatttataaaataattaaactgtgaaggtccttctcagctctgaattttgtgatgatgtcagttgtgtgactgtgatctgatctttttgtagtgaaaaaatttttgtgtcagtaggagaaagaatataggtcacggaaccttgagtgagaagtaataaagggctgagttagacaaagtaagtggaaatgaaagggaggggacagatttcaggggatagtttggagtgaaaacccaatgtaattgagcgattgattgtggtagtgtgagtagggtgggaggatggccagcagtgctgaggatctatcctagataaccagaagactgaggaacccagtaactgagagaagagcaacaggggtaagggcaggggtgatattaagcaaacagtattgtcctgagagatctggatgagagcgtctatctggtcttctagttcagaagttgtaaaactaatgacttcaattttggatatattgagtttaagatacccaaggaacatatatgtcagaatatccacaggactgttggaaatgtgagtttagcagtcagcagagaatttcatgctggggttggaaatgtgggggactaactaggttgtgatactttttagtctatattcgttagtatgtatttaacaggtaaaacgaaggcatggatctgatactaagaaataggtgacaagcgggactggggcttcaagtcttaaagaaatgacttttgtgtgtgtgcagatttagaaaggaacatggttatggaaagcaacactggtacggaatgcatacttgcaagcaacaaattagatttacatatagcaggccgggcacggtggctgacgcctgtaatcccagcactttgggaagccaaggcgggtggatcacctgaggtcaggagtttaggaccagtctggccaacatggtgaaaccccgtctctactaaaaatacaaaaattagctgggcagggtgggcaggcacctctaaccctgctactcaggaggctgaggcaggagaatcgcttgaacctgggaggcagaagttgcagtgagccaagatcgcaccactgcattccagcctgggtgacagagtgagaccccatctcaaaaaaaaaaaaaatagtaactacacatagcaatataatggctcttcaagatgaatcttagtgcttggtaaaaatgaaagaaactgtgagacaatggcatttaaaacattttaaataatcctgaatgcctaatatatttttttgtacaactcacaaagttatgtacattcacaaagttgtgcagccaccactattgaattccagaacatttcatcgccccaaaaagaaaccccatattcactccccactcatttcccattagcagtcactcctcattctctcctctccctacccctgacaactattcatctactttctctctccagtggatttgcctattccggacattttgtataaatgaaatcatacaatatgtggtgttttatgtctggcttcttttatttagcaaaatgttttcaaggttcagccatctcgtggtatgggtatttcattcctttttaatggctaaacagcattccattgtatgaccaaccatgctgtattttgtttatccatttatcagctgatgaacatttcagtggttttccctttttggctattatgcacagtgctgctgtgaacattcatatacacatttttctatgtacataagtttttttgtttttttttttttttgagatggggtttcactcttgtcactcaggctggagtgccatggcacgatctcggctcactgcaacctctgcctcccaggttcaagcgattctcctgcctcagcctcctgagtagctgggattacaggcacccaccaccatgcctggctaatttttgtatttttagtagagacggagtttcaccatgttggccaggctggtctcgaactcctggcctcaagtgatccaccctccttggcctcccaaagtgctgggattataggcatgagccaccatgcccaccccagtttttggatctcttggtatgtaccttggagtgaaattgcagggcacaatggtatttttcacaaattaaaaagaaatacattcaaaacaagaatcctcattttataataatacatatatacaaaaattatacataacacattagaatggttgcccatggcagagaatggaatgagattaagtatgaagataaaagagaataaataaataaagcaaaagagaggctttgccatgataatgtggaatgagctgaggaatatgattaattcagcctctgcccttgaggttcaagaaaaaaatatagcaccttttcattggcggtacaataaaattgaactttcccaatccccaaacctgtcataaggaaccttagggcttcttggataatgttagaaaaggccacagaaccgggcacagtggctcacacctgtaatcccagcactttgggaggctgagaagggctgatcatgaggtcaagagatcgagaacatcctggccaacatggtgaaacccgtctccactaaaaatacaaaaattagctgggcatggtggcacgtgcctgtagtcccaactactcaggaggctgaggcagcagaattgcttgaacccgggaggcggaggttgcagtgagccgagagcatgccactgcactccagcctggtgacacagtgagactctgtctcaaaaaaaaaaagaaaagaaaaagaaaaggccacagaatagatcttatgatgatccacagagttccttaaatttatttttattaaaggatgttttcctattaaaataacacattcccattgagggaattggaaaatacagaaaaatacatgtgagaaaatgatatctgtagtaattctacctcctatataactacagatagtgttttgggtttctaatttcatatttagttcttaatttagtgtctaatttgtaccttttagtgcagtcttgtcattttgtgtctttgtttaaaataatgctatgaggatgaaagaatgcttaagatgttttaaagagtagtcatagaaatgaagcctcgtgtattagcaatgtcatagctttctagaaggcaaccaaaactaaaattccctttttctcttggtattgtattataggaagaagctgccaagatcctgctggctgagttcaacctgggctgtgatgtgcaacacactgaacacgtgtacagggtttatgtcacaacttttctgggtttcggaggcaactttgcccggcagcgctacgaagaccttgttctgaatgaaactcttaacaaaaacaggtacatttgatatgggatctgagtttctgaaatataatgtcaggctgcagatattagggagaaatactcacatcctcctaagacagataagtccctgcttcctccttctttctgactacccctgccaatggggtagcatctcttaaagacctctattagcagtcccactctgggtgagggtgcattctgatctttgttattaggactcataaagtacagtagcttattgtgatctcttgctgtttcccatattcagacctaacatcatgggaaaagggagatgaattaaattgccagtttaaaatgtacaatatatagtgtagctgctagcagttccttctgcatggaagtgttcaagacatgtttgttgaattacagtgcagttgcatcttttgtgagagttcagttctgtagtatgtctaaaagataaaaagcaagcatagttaaaattaacttttaaaatggtctctcatcaaattcataatagtcagtttttcctttagcattggacagatcacagattcttcatttgagtaccagatgaagtagttagaccttaatgtacaaacagtggtgggatttcttgtttcttttttgttttttaagtctgtaaaattatttattttatcattaagcacactgaaggaaagcataagagaaagcagagttcttttccatcattaaatttacacaaaattttggaatgaaaccagtttaagtaattgggtgattgattgtggtggcgtaggtagggcagggaggatggccagcagtgctgagggtctagcctaggtaaccagaagggtgagaaacccagtcacggagagaaggaccacagatgaaagggcagggctgatactaagcaaacaacacacttacctacgtatacttaaccatttagctacgaacactagcttgaagaagtactggtataccccgtttgtaataatttatccacagcaatcaattatcttatatttacggcatgttgaagaaaatattgtcccataagtctattttgtttttgtaagtcttagtctctaggagttcaaggtgctttgggagaatcctggtgccctggatgattgactaatgcattaaaatcaagtggtgtgtttgtattctgaaagtactcctaaatctatacaaacattgcttgggttgaggtgctcagatgtctcctgcaggcaccatgatgtttgaagatcatttgttttgaaagtttcacaccagttttggttttccttcttcattagctgctgtgcttccttttccattttcttcttttgttctactcctttcttttctgtctgctgttttctgctgcctccaaactacttcttgccagactgcatcttcttcccatgcgttggtattttcttgccaagtagctaagtcacctacatcaggtgactgatgagtaaaaggcatatcttgtgtagctgccagtctattaacctatttcctgagatggcaaaatgatcattgtctcttctcaataacaattttctgagttttccttacagttggtgtcacatccttaaaatagtcggttccagttgttgtaaagtgttctgttgtactgcctcattccattctcaccctcggtctttacacctgtgggcgcatcctcattctaagaagtccactcttcaacatctgtctgtttaggaactgatgaataattaactgcaattggcaaagttacttggaccccaacttaatttctgtccttggacagatcttcatactcatcattttgaggaatgagaatatggttgctaggcaagtataaactcaaaataactggacctgtgttacggccatggtgggaatcaaagctttccagtcttctccccactcagaggctccaggctctgcaggtggcttcctggagctggtgctgtgcctgttctgttccagcactgctcattcagaggcaggcatgggctccatcaccattgccagccattgcacatgggccactgccgtggtctgctcttcaggaatctctccccacagtccttcccacctcaccccctaccagttgtatttttaaacattagaaccacactccgcacgataaggtccttgcacttttaggaggtacgtgggaatgaagaccagatggagaacagcagattcacatctccaatttcactacagactaggaaatacacatgttgactaaaatgtcgaacagaattgatcaccatattcctctcttttttttctaaatttaacttgctgaagttaaatgtttatgtgatgaaattgcactccatcctcgtttctagagatatcatgaaaaccagtagtaagatatttctgatgcacattgtgtttcttagactaggttgaatacaggcatgacgtgtttgtttgtttgtttgtttttgtcattgtggcagattgcttggtcagaagacaggtctgagtcccgacaatccatttctggatccctgcctgccagtgggactcacagatgtggtggagaggaacagccaagtcttacatgtccgaggaagaggagactgggtgtcttgtggggcaatgctgagccccctgctggctcgctccaacaccagccaggcctcactcaatggcatatatcaatcgcctattgacttcaacaacagcgagttctacggcttctctgagtttttttattgtacagaggatgtgttgcgcattggtggccgctaccatgggccaacatttgccaaggctgctcaggtaaattattaatgataaacatggcttatgctggcagcagccatttattgaatgcctcactctgtgccaggtgctgtgcaaagggctttgcatacagaatctcacttgttctttgcaggagccctttgaacactcattttacagatgaggaagtggacagagaacttaaggatctagctatgctgtactgccttctaattaactaaatttattttccatggatgtcataccacccaaattattacccaggcataaaatttttgtgttggctaatggtttttcttccaactttccaatagtcttgtttaatgtttatgcccaagaaatgtcacctccagtatttttcctcttgctagctattttctgttgtaatgtgcttttggagatgatatcacccagaggggcaagcccatctttcttttgggttgaggtattaagaggcagagtggtatggggtccctgggaatattagatgttgtaaaaagcaatgatggtggaagtttgtttagatttaaaatagaggagtaaaaattcactctgagcatatataggacttaagcatcatataagtttaaatcattggtacctggacagatgaaagtttagccagctttctatcattttctgctttatttagggccatctctttgaattgttgcgtgtctctatctttttcatcagagaaacgaatgggagaatctgtcctcatatttctttttttcttgagatggggtctcgctctgtagcccaggctggagtgcattggcatgatctcagctcactgcaacctctgccttccgggttcaagtgattctcctgcctcagcctcccgagtagctgggattacagatgcccaccaccatgcctggctaatttttattatttttaatagagatggggttttgccatgttggccaggctggtttggaactcctggcctcaggtgatctgcccgccttggccccccaaagtgctgagattacaggcgtgagtcaccgtacccagcctctcctcatatttccctccctccctcccttccctccttcttccctgcctacctttctctttctttcttacaattctctagggttctcttagtgtaaggcttccagcaaaataatatctgcagtatctgtactgttctgttcccaaaagacagtccttaagaaatactgtgggacacctggtttgtatttgctcctttctctccagcctccaggacgaccttcacgctccctgtttttctggagcccagagctccctaactatccatggcctgactctttctcttatctcaaaacttcttcaaattctattcccttgaacaccaaaaggctcaagttattgggcttaacatattatcttttccaggtaaaagcgatttttttcccttacctttttaactttgactcaaacgttatcttcccagagccaccttctgggaccactctatccaaaatgacaacgctccccatattacctgttgccctttcctgctttatttttccctgagcatttatgttatccaacgtaccgtgtgtgtgtgtgtgtgtgtatgtgtgtgtgtgtgtgtgtgtgtgtgtgtgtttattgtctgtctcctaccactagaatgtaagcttcctgaggacaggaatttttgtctgttttatttactgcatgattccctggcatctagaacagcacctggcacatagcagacatacaaaccaaaaggaatgattattttggtgagaattacaacaccgagggaggccaatgacaggtttctaaccatcctcttccatctgctctccctgctcatgtcagtcctatgtggagtagaatgaaactatctttgtcttttgacgttgctatttgttagtcctaacctcagcccctctgaagcctaagaggctcagaagccacatcaagctggcttggtgctagacatgggatgacgggaataaacaggggtatgacgcagtgtttagtgaatgaacacaccatttctgttttcctttgtcagctggtagcccacaagtaactttagaaatggaacagctgtgactgtggggaaggtagagagtttgcctccaaattcatgttgcactatttctctgtggttgatccaggattactgtggcatggcttggtcggtactaactcagagattcaagaatggcctcttttcatcacatgcagatgagcatcgactcaagtaagttacttccctttcctccttagatgtggacttaaaatctagatggcagattataatggagagtgagcaataatgcagattagatttcatgttgagggagcatttgattattccagacttgattttctcagggataggggccaaaatagtgagcctattatagcaaagccagaagaaatcagtggttaccaaacagagttctcaacaagtgatttgacaacaaaagtgatttttttttttttttgagacagagtctcactttgttgcccaggctggagtgcagtggcatgatcttagctcactgcaacctccgcctcctgggttccagcgattctcctgcctcagccccccaagtagctgggactataggcacgtgccaccatgcctggccaatttttgtatttttttgtagagacggggtttcgcaatgttgccaggctggtcttgaactcctgagctcaagtgatccgcctgcctcgccctcccagagtgctaggattacaggtatgagccaccgggcccggccaaaagtgattttttttttaactttgtattatagataatatcaaacatatagaaaagtagagagaatagcaacataaaccctcatgtaactatcacacagcttcaacaaataacattttgccagtatggttcattggtcctttcatttttaaatgttttagttaaaaattgtttaaaattgccgggcatggtggctcacacctgtaatcctagtgctttgggaggctgaggtgggtggatcacctgagttcaggagttcaagaccagcctggctaacatggcgaaaccctgtctccactaaaaatacaaaaattagcagggtttggtggcaggtgcctgtaatcccagctactcgggaggctgaggcagggagaattgcttgaacccaggaggtggaggttgtagtgagctgagatcgcgccactgcactccagcgtgggtgacagagtgagactctgtctcaaaaaaaaacaaaaattgttttaacataaacaaaactagaatagtgtaatcaactcctgtgtacctgtcaccctgctttcctactaacatttatcagctcctggcccatcttgtttttatctgttttcccatccacaatccccctcttacttcaactgggttgttttgaagctaatcccaaacatcctataattacatttgtagatattttaatatgctctctgaagatagggactcttaaaaaaaagaaaaagaaaaacacagccacagtatcattattgcctttgtggtaaacacaagataagtaggctgacttagaaataacccacttagaggtgaggaaggtgaagcgggaggaggtaggtcttttaataacttgtgggaatacggagtggcttattgcaaaggaaagtattagaattcttttctctttttttaaaatttaattatttttgtcacacagatatcagtgttttaaatcggcttggatgtaccaagtcttacatgaaggattccactttccctatgactacccaaacctgcggacagcccagctggtgtatgaccgagaggttcagtggacgctgggagccattctatataaaacacgattcttaccactcaggtaaagtaagactgaccaatctggtatcttgagctcagaggatatcagttgatgcctcagaatcggtttctttctttttttttttaaccagcttagaataggtcttaagtgaccttcctctctaccccctcacaaaaacaaactcctttacttccatgtgagccactgttactaccaggcatgctcgaacagaaagaaggttgagcattactggtctggagtctcagctttgctgtttcagaaatccagctttatttgtttactcacaacaaaccagtctttaggactgagctcttactaatcacttccaagatactgacaagctaaaatgtcattcttgggttaccctggaaaacacatctgactaaagaacaggggtaggatgtctagagcaatctttcataacatacagaggcactccagacattgtgtcattgacttagaaggctttttggtgggtcagaattagaataaaggacgtgagatgtttttagtggggctactttcatcaaactctggtagcctgataccttacttttatgtactgtcagatatttgggacaatttttaggtacctgtaccctggactatttcagataaactcagatgaattttgtatctttgatgtctgttcctctaaactcaataccgtcagcagccaggcaggcgacagaagtgagggaagtgggctaggtgggggttgcccacaactggagcatgtatcccagttaatgggctggttactgtcacacacaagcactgtcccagcatttgccagttctcatctgtccagaaaagtcagaaatccatattttttatgaagtctttcagtttagagattcgcattctagaagaacactgcaggtcaaaccagacaaaactagatctggatctggactgctgaagagtggcttctgttctagccaggtggaccattacacttggttttcatatcgccttatttttatctgactgtaatacagttgatcaggtaacagctttatttagatatatcctagatcctaaggaaacatagtacctttattttttattatttttttgagacagggtcttgctctgttgcccaggctgagtgtggtggcagtgccgtgttcatagctcactgcaaccttgaactcctgggctcaagtgattctcctgcctcagccttctgagtagctgggaatacaggtgctcgccaccatgcccagctaattttttgatttttcttttgcagagatggggtcttgttatgttgaccaggctggttttgaactcctggcttcaagcaattctcctggcctggcctcccaaagtgctttgattacaagcatgtgccactgcacttggctgcatagcaactttaaaaaaaggatttagacacacacactctgatttctttattggattcaggggataccctattctcattagtactgtatttataagccatattttaagacttatgttacaggtgatcaatctagcctttctgttcattttttgggattcaatttcaaaggccttcccatcttggcttagattctggagggtgtaagcctggaggtcccttctgggggccgtgggaaggaagacacagaagggctcctggggcgggggatgttcttcagctttgcctgctctgtggagctggtgtcataaaatgtttatgtggatggaataaatgtgataacactactgggcctttcaaatcagtaaatgtctccctttgaaacttaacagttttttccacctacaaattcttaattcttccctagggatcttcggcaggaaggtgtccgacaagcccatggtagctggttccgtctctcctttgtatacaaccactatctcttctttgcctgtatcctggtggtgctactggccatcttcctataccttctgcggctacgccgaattcaccaccgacaaacacgagcctcagctccattggacttgctgtggcttgaagaggtggtgcccatgatgggagtacaggtggggccgtgaggctggaccaggactagagaagcttgagcacccccgagttgctgctcattgaattcctccactttcttatatagcctcagatgctgtgatgtctgaccttgtggatatttgcccttggaatttctactttactttctaccgtaattccttctccgtacccaggtcttctctgagagaagctataatttaatctgtgaggaactaaatgacaggagattggtgctaatacgggggaccaagctttgtccaagtgaagcaggcttcgactccttctgagaggtctggtgtgttcctagaatctcaccttttcttcccttgctaaagcatgaagtttggcatttggcacactggaagcctggttgaaatgaaatttgtagcatctgatacaaagccagagacattctagcaagtgcagcagccccttctttctctgtaacagagatatcatttatgtggagatccacaacctttaacagggatccaagatctttgcagttcaatcgaccacataggaatttccaggcaccaaaatgatataacttccttgcttccttgacaaagaagccatcatgggtgtgatccaagatccctgtcgtagtgttgatgatgttagtacatgattttaaaggttagaaccccttctaaatgaatggtctgtggaagattttagtatcttatctgatgcctggtatgatgaggatagaaaatttttccatttttatgtgcctcacaggctgtttgggcattaattttgctttttgagccttaagtgtgttagtaggatggagaaactgtgatggggactgggaacctggatttgtctgattttaggtcactgttccctgggcctgtttttgtgagcccttacacaggaagatataaagagagttctttcatttcactgctaaaatcagtatgtagtatggggaatgtatttgggttgtttttaaagaaaaggggaacagaatcaggagagtgggcaaaggcaataaaatcaaagttcttattaattatttctgagaaatagaagtttctcaatttatgactcttggaatgtctgaaagggagcaaatttggaatagatcaatctgttaataagccatctggcaactttcagaacctctattaagagactgctgagtcacaaacagcacttccattaatgaagcgagaggaaaagccataataattacatcttcacccactacccttccagagctttgcttctcctccacatttagccattaaattgcatgaggatttctcttcatcagggtccgcatggaatctttcttatattttaccctttcctacatgtagccttgaatgtcctttccacgaatatgctcccacggctgggagcattttcttttcttttcgtcacctttgatttttgggattagattaataggggaaaaagtccctggctttaaagaaaacaaaagtagaattcttcaaaaataaatttcatactgggaacagaaaggaactaaatgcttcataaaacagggaaaaagaaattaagatcatcctagaaataaactaagataaaaataagtatactgacccttggttggtagataaaaagatgaccagtcttgtattgttttaaaattagataaacatggattaagcatgcaaagactctgttcctttttttttttcttggagacagggcctcacgctgtcacccaggctggagtgcagttgtgcaacatcatggctcaccgcagcctcaacctcctgggctcaaacagtcctcccaactcagactccagagtagctgggactacaggtgtgcgccaccacactcagctaattttttattttatttttttagagatggagtctgtgttgtccaggctggtctcaaactcttgggctcaagcaatcctcccacctcagcctcccaaagtgctgggattacaagcatgagctactgcacctgccctctgtttcctttggaaatctcttacctttcattagggtttctttcatagcaatttcctttggtttttaagacttctacattgctttttcttttattatctgtgctccgtgaaccttatgaatgctgcttaaaaataatgtcaaaatatgttttagctgcctactcaggtaacgttttcttttgctctcatcttggtttccatatactatttttggttttttgtgagatctaatcaatgatctagtcagaagctacttcactggctaacagtgatcatgttcatgtgctaaaaatgaacttgaaacacggaagtagtggttggtccagtttgaaagctcttattagtattcttcatcctggctgtaataatagccattatttgttatgcctttgttatgtagcagacactcttaaggattttatgtgtattattcaaattgctattactgttctttttatagttgagaatctcaggatacctacatttatcactttttcaatatatatgtatttcttattcttattttgtcttggagtgtttaatgtgttatttcctgttcattactttaatattatggtatctaggcttgtctttattaccatgagcaaggtctccaggagttccacagtactgaaggaaaattttgtcatatccctcagaagaactgaatatttattattggtatgggctcctttgtttattctcttctcccaattaatagattttaaatgaaatcttattagctagaaacaaaagccacttactccttgctgagagccaattacttaaatatatttcttccttataataaaataatttgcttctaggagcagaaatctatcttgccataccctttggtttttaaagatttctcttctatttgcatttctgcactttggtggttctcccatgaagataattatggtgtcataaaattcacattccactggttcctttgaatcttaccaaccactcttgttaacagagacaatgaacctgaactgttttaggactcttgttattactgagacaggtcacaaacatcaaaataggagtccgtggcttgtagtgatgctttttagtcttgtgatagcacaatccatcactttccccaaaattcttgtcatagaacataatgaaaaatatgtaaaatacccatttatgtggcatttcattcacttaagttgcagttaactctaagccaaattataccattttttctctctgtactttagctccttgaatttccttaatctgggaaacttttgttcccacaccaaggaacaaattcagggggtacaagtgcaggtttgttacatgagtatattgagtgatgctgaggtttggggtacagatcccatcaccaggtggtgagcatagtacctaacagatagttctttaatccatgccctcctctctccctccctgctctagtagtccacagtgtctattctggtctgggaaattttcatcactttccaccaatcttctatttattctccaaatgtcttccaaagtatcctgccccaccccctcctcatcctaagagattcctttaacttcaagatcatatccagtgattgctgaaaaatgtctgccatgcacttgctaagctagtgtttttaggcattaacatttattatcacatccatatttatatttttgaaataatttatacttctcactgatatcatctaaacagatgcttctcacagttttatgttttgttttttgtcagggatgaaagacaagtgagtggtatcacttaagggaaagaacagtaggcttaacgaatagcagacctggattctagttctggctttgtcatttactagctctggtaccccaggccagtcacttaccatctctggttcggttctcatctatcaaacaaagaggctagacaagattagaaactaaaggcagaagacaaggtagaaaaatcatatgattttgggaagagcattttgtcctttggtttagaagaccaggctgcccaaaagagcctcctattttatccataacccctgatgataaggttggtgggaacagagtttctaatagtaatcataataaatttcagaagagttttaaagcttctggtcaacccccttgatttatatgggtgataaaactgaggcctagagcagttgtaatatgtgcaaagtcatagtgactggcctcctagcccaactactttgtcagctacaatgaaatgctcattaacagaatctttctgcaagtataaacagaatctattttttataaaacagctggccacaactaaccatgccccatctttacaactgcttctgacattcatttatgactgctttgctcacatttaggaataaactttgaaaaaaatactttgtcagaaatagtgccaagttttcactacatctattcttgttcctgtatttcttttcgtacttttaaattttatacatctttttaaaacaattttatacaatttcctttactacaacatccaagcaattcattagatgactacagcctagatgaaggtataaatgcctattacatctacctcattaaagaacttcgttgtaattcttgggcagtttccagactctgttacagaaacagagggctgtttctttttgttgtctttaaacttttcaaattaattcaaaactagtatctaattgtcctttttgctgtggtatgtggtgtaatgttgattgggaataagaattatggtagaaatagcagatgtttcaaattctcccatattagtctcttagggacgctagctccagattccagcccctggggcaataacttgtgaggattttcctggtgttacaaaaaatattgctgttaaaaaactaagactcaaaaccaaaagttgtgattaataataacaggattattagtcaataatattttgattaatactatagaatagcaacagtgaatatacctcaaattgaaaacttttaggttgtgttcttggctcattctctcataacctggatctaagttggaaagctgtggcaccctgtttgggtgtcccatctaccctgttttctgtttctgcagatggcttgttcaagcttcattttaagcctgctctgtctacttatcttccttatatcctaatagacttctcttgtgttattacacatttctcttttgctctaatatttcattattttccagtttgtcagtaccgttatcagagggacgaggaaggaataacacaccagttgaccattttgtttctctgaaaatctgagcaatacggagatccttttattagtaaaactgaatcattactcatactacaagggctttcacttttaaaatgtaatccatcattgcttgccatttttatgaaaaccaaagttgaaaagtcttctgaatcacaggctatgtatagccacacatgcatgacttcaggctagcataaagacatgtctgctcctgagcctcttcttttaaagggcaaccacttgtataccctctggtggccactcctccttctccactccaaggcagccctggtactttcctaagtggcccctcctacagagcacttgccggcatttggcctgctgctggtgaagacgccccttactagcttcataaatgtttttctgcaagcagggatcccagacacatactttggtttctagtgtttcagttactatgttgtatttgaaattctcattccacaattaccctttagttgaagtcctgaagtacatgccatgtactccccctttatttctaccttgatcaatggcctctgcggagtgtagtgaaagacatctttttattatgatctacactttaaaaaaccaaaggctgcctgtattacattgctttggggagttgttaagactctgttttttctactgcttcacattaaacaataattttgttgaattttgaattcttaaaattctcactgacaaacattttaggtcagtgttgaggaaaatgtgtgatgcatgttagagaggtgatgcattctcccttatgcagggacatgggtatatgtgttacatatgctgatatataacccaccattcatcccaggaccacaagggtagctgtagataaactggttatcctaaaatcatgattatcagtgttgatctctgcaaccaacattgctttagggagttgctagtcattacccctgctacaatagatagtatttgtcagtctaagttacagacaaaaaattctaggttgactgattaagaaagccatgtgttttaatttccttcatgttttaaaaacaatggacgtaagtgcagagagacctttgaaaatattaagggaaatctatttaatcctataggtatgtgatgacttgtttttttggaaaaaggtatttggaacatcaatctgtaattatccattttccattcatgcattcactaattcaatatttgatatgtgtctgggagtgctgggaataacataaatacaaaaaaaaccctaagataatcattcaccagaagctcatagatataatacagttatatagctaaatgcaaccagttgtttttccaaatgtactcatcatctgtaataaaagaaaaatgaagtaaaacatctgaaaccttaacttactcatgagttgctacttccttggaggcaactgtagaagcattaatatatggttctttgggttgggtcatactgccctctgctgactcagttactaactaaggacaacctgggtttgaggatcaggagaggatggtgtgggaacctgcctcaggaactacagttccctttctttgaaggattctatccagaagagaccatatcctactaacatactaataggagcaacatagcagatcaaatgataaggtggggtggaaattagaagggaatgggaataagctagtcagaactttctaaggtaactaggctattaggacctaagccagtggtccctagacttgtctgcacattggaatcacctggggaactttaaaaatatgccttttacttcctccagggattgtgacttaattggtcttagatgaggcttgggctttgggatttttctaagattcaaataagagagaagttgggaatctcttctaggcaatagcataagcccagccagggtccagcatttatgaaaaattgacaaactgttttgctaagaatcacctgtgttagtcggcttgcattgctataaggaaatactgacaatttttagaaagaaaagaggtttatttggctcactgttctgcatagaactgtataggaagcatggcgctggcatctgcttctggtgagggcctcacgaagcttacaatcatggcagaaggtgaaggggagccagtgtgtcacatggtgagagagagcaagcgagagaggaggaagttccaggctcttttaaacaaccagctcttgcataaacaaccagagtgagaactcactcattactatggggatggcacaaagtcatacataagggatccgcccccatgacccaaatacctcctactaggcccacctctaacactgaatgtcacactttgaacatgagatttggaggggacaaaacatccaaaccatatcaccacctgagaatggtacactacaggtcacagaaacttacagagtactggagttgaaagagaactgagatcacctagttcagagactaacgggaaacgttaggtcatttatggctctcagacacgttaagcctgcataacattttttaaaatcttgaaattagttcccaacacttaattgagagctttcacagaaaaatctagatatgtggcttatttttaaaaaacagaagatttgctgacttaaacactgcaaaattaaacatttatatctgaatccagcatctctttttgctttgtaaatgaggtcaaggatgaaatccagatgttcttcctttgtatttgtattgtcactgtatggaatctaggtatatccaaggaaaaataaacttaagataagcttattttccttatttcaaaaagcaaaacaaaaacccagaagatctaacaaccctggacctgtagagtggcagcaacagaccagaactcagcagtatagtccgagctggggcacctgctcgccagtgttactgtctccatcagcctgaccccagtgagcatttgatttggtctaccctactcttgccttctacagaactaaaactaacttcctgcaactttcatccattgctgccagctctgcagcataatggaagctcattccctcttctgcatgagacggcttcaacttctcaaggacaggaatcttgctctctctccagatgttctctgctccagttaaatatccctagttccttcacctattccctgtgtgacaggggttctggactcatcattctgatctcttcttctggatacacacttagtggccatcaatatcttgcttaaatttggtacccagagtgaaatgcagtatgttaggggtattttgactatggctgtgacacttctactgataaaacctgaagtaccactaatttttctgttatcatataataacaacatgaatactacttggttcatattgaacctgaggacaactaaaatcccgtcttttttatatgaaatgatataaggccaggtttcttcagcccaaacttatacaacttatttaatttaaatgagtatgttacatttctaatctgtttaatttcatctcgatggggtcattctgggactgttttcagttgccactgtcatctattatattagcaatattgggttgctccatcctcaaatcagatgtttctgatgccttcatccaaatcactgattttaaaagtaaagttgaataagacagggccctatgaaatatcaatagagaccaaaatcacattaattcagcagtcaacaatttgtttatctgggtagatgtccatgcactacaccatcaaggccatatttttcttattacaaagctgttaggaaaccctctcaggaaccaatttatactgtcgattccattcctctctctgaccttgtaatgttaacagccttatcaaaagaggaactagctgggcgtggtggcccatgcctgtaatctcagcactttgggaagccgagatgggcggattacctgaggtcaggagttcaagaccagcccggccaatgtggtgaaaccccttctctactaaaaatacaaaattagccaggcatggtgacttgtgcctgtagtcccagctactcgggaggctgaggcatgagaatcgcttgaacctgggaagtggaggttgcagagtgagctgagatcacgccattgtactccagcctgggcaacaagagtgaaactctgtctcaaaaaaaaaaaaaaaaatggaactatttggcgattacctccttttccaagtacttaaaaaccattttgctacatatacacattaagcttgtcaaaatctgcaatttccccatttctgaaaatcaggatattagaagacattagcttttttttttttgctgaagaccagctggctactttgggtatgtcaatcctatcctttcaatcttcacctaatggaagtgaagttaagatcataaagaaattctatttaggcagaattaaggactcaggagaacatccacgtagaaatcatccacgtagaaccaagagcttgccaacactgaaaaacctgacacaaagcctgttaagcagcaaatggcagacatttctttctctacattaaaactgattttcaacatgaaaagcagatttaaaagggaacatttagggtaaccacacttaatgcattcttgatccagtgactatctcaaaacaggaaaagatttttaagtaagttgaccatttggaaaccacttggtatgtcaaggtcatctcgtagaaaagcccaagttcttatgatctctgaagagctctcaaaagcagtcacagtcccaggaggctggtcctctaagaatcattttgggactcttcggagttcattcatcagccaaagagcaccagtgagcaaagccaaggagcctgactggtgagtggcggccagaggagttgggacatacatcagcagcgtgctgatgcccaagcccacctgtcacaaaggaaagaaggcaataggaaaggcagtaacccaaagttcacattgaaaatggccaggcgtggataaccacacacaaacctccacatcctcctatcagagcacttaaaatacacacatttttaatttcacaagcaaatatgcttacaatgaaagaaattcgaacaaaattgataaacctaaaattccccttattcttcaatccatcccagttccccagagtagtcactgttaccagtttctgcatacttgtactttagtatgtttatagagaaataaatatatagttttgtgcttttaaaaaacatattgttctgtcacttgctttttttcacttagcaatatacactatgtattgagatcttattaaactgctgtgcagtatcgcacagtatggatataccatagttttttttgttttgttttgttttgagacagagtttcactctgtctgccaggctggagtgcaatggcatgatcttggctcactgcaacctccacttccagggctcaagcaattctcctgcctcagcctcccaagtagctgggattacaggcgtgtgccaccccgcctggctaatttttgtattttttagtagagacagagtttcatcatgttggccaggctggtcttgaactcctgacctcaggtaatccgcccacctcggcctcccaaagtgctgggattacaggcgtgagccactgtgcccggcccatagttttttaactatttaggttgtttccaatttttcactatcacaattctatgatgaattttctcatacaaaaggtctttgttgcattggactgtttctaggactgacactaataagttcatttgctgggccaaagaattacccatttaacttttaaaagatattgccagcctgggtgacagagtgagactccatctctaaaaaaaaaaaaaaaagatattgccaaattgccttctggaaaaaactgtactgactcatgctctcaccaggaatatttgaaagtatccattttcctatgcccatggcaatacctgattatcttttttttcacttttttccaatttgataggcacaaaatggtacttattttttaaatttgctcctctctgattataagtgaagctgaacagcttttcatgtttactggccattaatcattgtttttgtggtaattgtgtattgatgtcctttacttattttccggttattaatcttttaatttattataaatatggaaaatattttctcctagtctgtcacctttccttttttttttttttttttttaaacagacagggtctcactctgttgtctaggctggggtgcagcggtgcgatcttgactcactgcagcctcaacctccctggctcaggtgatcctcccatctcagcctcccaagtagtttggactacaggcacacaccaacatgcccatctaatttttgtattttttttgtagagatggggttttgccatgttgcccaggctagtcttgaattcctggctcaagtgatctgcccacctaggcctcccaaagtgctgggattacagccatgagccactgtgcccggccccttttttaactttgtattggggatactgtcagaacaaaaagaagtggtttatacctgtgtatacgccaaagccagcagagtcactgctgccatcttggtccttctaggaaggggaattctccgagagaggaagtagagcactgtaatggcagtgactgaagtgattccctgcagggaagaaagagtctatcacattagatagaagtgccaggtttctaactcaccttacatgtatctcctctagaaccactcagcaaccatgaagtactttcctgtaccagtcacagagaacctccctgcagtcccagcctgatcactcctccacaggctgtctcttccaccatcctcttctgcttgccacttaaacgtcggtatcacccaggctccacctaagattctgtatgtactttatacaccctcactcccagtgatctcatccaccttccaatgtgggtgtccccctcatttttaattctttgcatccttatccctaaccatatctctaatcctatattcttaaagcagggctgaccccagcacatgagggttattattttcctgggctgtgagtggagaaagtgctggtgctgccagctggtgctaaaaaagacctaaagtctcattttcattcctatctcttcagaacaagggtccaggactggcaataatggtctccttcctcttccacggtatcagggagaatgttttctatcatatttctacatttatttcacttcatttccttttcagtgctgtccacaatgacaatttcaaccaggctttacttatgctaaaatactgtgcgcaggtggggactcagcccacaccaggtaacatgcctcagcccagcccccgttggacagctgagccctctggccccctctctctggacgtgctgctctcatctcacactcaacatacctccatctgatgacatcctcccacctctagctccacactcattctgagggtcccatccctgtaggtcatgtttcaagcatgctgtagaagaaactttgggatttcacttgatctttcttcacctttattcctgacagccaatcttattaactcttttcctttatttatttatttatcgtagagatgaggtctccctgtgttgcccaggctggtcttgaactcttgggctcaagcgatcctcttgccttagcctcccaaagtgctgggattacaggcatgagccattgcgcccagtgctcttatttttaaattaaatttaattttttaagagacaggctctcactctgtctcccaggctagaatgcagtaacgtgatcacagcttactgcagcctcaaactcctgctcaaacaatcctctcgcctcagcctcccaaagtgctaggattataggtgtgagccaccatgcccagcctctctattcctttaaattctctctcaaatgcatcattcttctcaagtcccactcccaccatgtaggccccatctccatcactctccctggcattacgcagcagcactatgcttctcacagtctccttactgctcatctttccccgctccaattcatcacacacaggcctccaagccaatctttgaatggcccatagcagaccctcaaaacatattcgcttaaatagaatgaaaagtactggtgaagctcctggctccttgagcttctggtttagctccgagagctacgtgcttagcagctatggtctccgcattcgcttctctactcaaccacatttctgctgaaatgactttctaggtacgtgcagaattgagggaggttatcacttgccaagtggtaaaaggcacatttgaacttttaagaagctggcaacgtcctgaaagctagaatttggctggggttggggtagggggacaggggtgaataatgaggacaaagacattagattagagaaatggtcctaaaatttcttccaaagagagcaggaaatatagttcctgctctaccctctcagtgttgccatcagtgcttcactgacaccccaaagcctatgataggctcctgtgctctctggcaggtaaccaccaactacacttaccagaatccggtgatcaaactgcaccatggtgggattctcaaaaacattcctcaggatgggggagaaggtaaagaggtcctccgggatccaggattctcccattttgggaaaggagttataaacaagcccagcatctagccctgccacaaaagcccctgtattccaaggtaaatggtatttattaaaatgagaggaagaagagaccaaatactagttctgatatagaaaaagtctgttatcccagagttaaactaagggaacagtcagagaataatagacatatctgcaacaggagttctccaacagagaagatacatcacaatcaccaaggaaacttcaaatctctgcatccttacctgctcccaccccaagattctgcttcctctagagaagtggagtagaggctgtggtgtggggggagggggagaggcttattagcttagaaaaattcccttagtgattttgatgccctcctcaccccgccactgagtgctactgatttattttagaaatgctctcccacagatgtctgcatgactgactcccttatttcctcagcttccactcagatgtcaccttaccaaagagatttcgcttgatgatcctagcccactttctgtctcctgaccctaatttatttttcttcatggcactaaatatcatctagcacattatgtttctattgtgcgttatctgtcttccccaaatgctcaataaatgtttgttgactgaatacggaagtgagaaaaatcccaaaacttataaactaaatcctggataaacaaataaagagggtattcatgaattaatggatgtctgatccattatttattatcaaagaaaatccagaaatgtttgggtcacactcgcttttttctttctttttttttttgagacgcagtctggctctgtcccccaggctggagtgcagtggcatgatctcggctcactgcaacctctgcctccagggttcatgcaattcttctgcctcagcctcccgagtagctgggactataggtgcgccctttggtagagacgaggtttcaccacgttgaccaggctggtctcgaactcccaacctcaggtgatccgcctgcctcggcctcccaaagtgctgggattacaggcataagccaccatgcctggcctttttttctttttttgagtcagggtcttgctctgtcacccaggctggagtgcagcagcgcaatctccgctcactgcagcctcgacctcctgggctcaagcaatcctcccgcctcagccccctgagtagctgagactacaggtgaataccaccacacatggctaatttttgtattttttgtagagacgaggtttcaccatgttgcccaggctggtcttgaactccctggctcaagcaatctacctgcctcagcatcccaaagtgctggaattacaggtgtgagccaccatgcccaacccactccatattttttttaaatgtcccttatgaagtaaaaattcatgctcttatgccaaaaataaaagtgttgagtggctcattggtttgaatcaatattatttttagtccagagcagtactatcaatagaactttctgtgagagtggaagtattctatatttgtgccaaccaatatactagcccctagccacatgtgcctgtggagcatctgaaatgttgctagtgtgactgaagaactaaattttaaattttatttaaccttaattaatttaagtttaaatatccacatgaggctacaggctcctctactggatagtgcagttctagaatgagagcagcagtggtggaagtgtgggttaaagaatgaaaacggccaggcatggtagctcatgcctgtaatcccagcactttgggaggctaaggcgggtggatcacctgaggtcagaagttcgaggccagcctggccaacatggtgaaaccccatctctactaaaaatacaaaaatcagctgggcgtggtggtgtgcacctgtagtcttagctactcgggaggctgaggcacgagaatcgcttggatttagggaggcagaggttgcagtgagctgagatcatgccactgcactccagcctgggcaacagagtgagactcagtctcaaaaaaaagaatgaaaaaatcctgtgttggtctctctgtgccaatgaactctccacctgcaaccatctctgagggcaagccttttctctgacccatgttgatgtaatgtgatgataacaatgtttatatatagtaacagctaacacttatgtagcctttgctacatgccaacaacgatgctacacatttcacatttagcagtcatactgttgtcgtaatctccattttatagataaggtctctaaggcccagagaggttacagagcttgcaaaggtcatatagttcacaggtagtgaagccaggatttgaacctaggccatctggatctaggtagatgttcaatatttttgttcaattgacagtaaagtagaatttttggaagagagaaaggaacaggaaacagggtgaagatgggggaatgagagaaacagatgtgaaaaggaaatataaagatgcaggaggaaggggcaaagcattaggcaagaggtcccagcttagagtgcaatgcaaacaggtcatctttgatgagctgagtcctacctgagagggccgtaaggaacaccagacctgctgttccatgagcaaatcgtctcaactgtaggagttggtgggtttcaggcaactaaatatgaaaaaaaatcattcagttaaactgtgttgcaggaacaatgagaggcagcaaagatctctaaggccaaacccaagtgacaaattaagatcagatcttctctgacccctagactaggttaagtactcctggcagatattctgttccaacatgtactgtattttattataattatagattactatctgttttcccttctaccccataagttttgtgaaggcaggaactgccatcttttttactagagcaatcttagcctagtgattggcacataggtactcattacgcatctgttcaaaaactgaatgatttccattattcaggaaacaatgcttcatcacggttgaaaggatgtagcttaagatcaggactggattttcatgtgtgtgatattagtgtttagcaaatatagtcagaatcaaaattgcataaagtgcttagagattcctccatttagtgtttttgataaaatcaaaatttgtttttattcttattaccaacttctaatactaataagtgaatcatcaaatatgaataagaactttataaacaggtgactatgccaccctcaaatggcttacactctactatatgaaaagttaggtatcattactaacatattataggacagtatatcagcactgtccaatagaactttctgtgatggaaaagttctatcatctacctaaggagagcttgaaacatgtggctagtatgactgaaaattaaataaaaaattaattttatttaaatataaagtttaaataaacaaaaagcttatgtaaataaattttatttaattaaaaaaattttttttctcactttgtcgcccagactggagtgcagtggcacaatcttggctcactgcaacctccacctcccaggctcaagcgattctcctgcctcagcctcccaagtagctgggattacaggtgcgcgccactattgcccagctaattttttaacttttagtagagatgggggtttcactatgttggccaggctggtctcaaactcctgacctcaaatgatccacccgcctcagcctcccaaagtgctgggattacaggtgtgagccaccgtgcccagccttaattagttaaaatttaaatagccatatgtagctagtagctactgtgttggacagcatagcactatatggctcattgggtagcatctcaaatcctttttgtaattaggtgaatctaaactaacagagaaaaacaattgataaagtcatcagtaacctttaagagtacaatttcagtagcaagagtgtgtgggtttatgtgtaagtgtgggtaaatgtgtgagtgtgtatgtattgggttgggtgaggaagataattacagggactgaaaagaaggaatagattgtcaggaagcagcagctatagatgcaggcaaaatgaattcattaagatgaattcattttagaagtctgaattaaaatgaattcattttagaagtttggctttgatgggcacggtggctcacacctgtaatcccagaactttgggaggccgaggcgggtggatcacctgaggtcaggagtttaagagcagcctggccaacatggtgaaaccctgtctctactaaaaatacagaaaattagccgagcatggtggtgtgcgcctgtagtcccagctactcgggaggctgaggctgaagaattgcttgaacccgggaggtggaggttgcagtgagccaaggtcacaccactgcactccagcctgggcaacagagcaagactccatctcaaataaataaataaatacataagtaaataaatgaagtttggctttgaaagtcaggagactttcaaataattccttatttttcagatgtggaattattcagtggttgtctactgtatcaatatttcaacccaatttggcttctctgtgggaatgactgccaagacaacacgtccagtccttactgggatctagctactagctccaagtacctaatggatgattcgacttaagagtcctgctgtcatctcaaacttttctccaggaacagcttactcaggtcaacccatgatttcaatacctaatataagactctttttttttttttggagatggaatttcgctcttgttgcccaggctagactgcaatggtgccatctcagctcactgcaacctctgcctcccggattcaagcaattctcctgcctcagcctctcgagtagctgggattacaggcatgtgccaccatggctggctaattttatatttttagtagagatggggtttctccaggttggtcaggctggtctcaaactcccaacctcaggtgatctgcctgcctctgcctcccaaagtgctgggattacaggcgtgagccaccgcgcctggccaagactcatttaaaaaaaaattctagggaaaaaaatgtcctataagggtgtggtgtcttggaacctctattattaatgaaggcctcaaaaaaatgttataccttgcttttaaatcaaagcataaaatgaaaaactagtactttgctttaatcagcagacagaaaaatacttcagacaaaatcactaaggtttactattagacttaactggcaggtccccatttaacgaacaatatagctcttgtccacaccagaagttcagaaacacctctgttctgatctttctcactttgccatccaccatcccttctaggagtcagaggtaaagcgactgggatatttcttgttgttggtactccctcccactctatttttcaatttgtttcacctttgccaatagaaaatgttggcaaaatattcaactcctatatgatccagcaattctacttctagatatatatccaaaagaaccaaaagcggggtcttgaacacagatatttgcacacaactcttaccttgtgcggagggagtagcagtgacagtgaggtccacaagctggcacaataaagaaccagggctgatcccaggtgggcagcaaggcggtactgactgacccgagggatgtcatgggagtctgatttttcttctagtccacttttcaccatataccatcccaacagaccctagaacccccaagagatgaagcaaacaaaacaaggttaaaatgatctgttcaactttcttttttttgttgtttttttgagacagagtctcactctgtcaccaggctggagtgcagtggcgggatcttggctcactgcaatctccgcctcccaggttcaagtgattctcctgcctcagcctcccaagtggctgggactacagttgcgcatcaccacgcctggctaatttttgtatttttagtagagatggggtttcaccatgttggccagatggtgtcaatctcttgacctcgtgatccgcccacctcagcctaccaaagtgctggtattacaggcgtaagccaccacacccggcctgatctgttcaactttactgaggaaatgagctatcaggagtactctctaccccacccctcctctttccataccctccccaatacgcagtgtcccaagattcatgatttatccacagttcttcacatatcaccattaatacttaactactatttagatcagaagtgtctgatcttttggcttccctgggccacactggaagaattgtcttgggccatgcataaaatacactaacactaacagtagctgatgagctttaaaaaaaaaaaaaggtccatggatatatctcataaaactagattgaatgttttggagaaacttaataaaggtaaatgcttaaaaacatctactgtcaagttaggttggaataagacaattataaaagtttcaggggaaaatcataaaaatcaataaggttttgcatgcagatcgctttgcaaatatctaagttcccactccgctttaagcaaaaccacagtttatggggatataagaaacctgcagttgaatgccaatctggggacgcatagtcaaagaaaaggccttgattttgtaaaagttggtaatgaacgtacagatttaagtttaaaagtttatgttatgtatcatattctatgattctctgctttaactggctttttcaattaaccaaacaattgttagttccaatcatatgaaataagacagccctttcactcccacttgccagtagaatcaggtcaaagaggtggactctgccacttctaaatatatactcttcaggaaatctttttgggcatttctctcccctttcaagattaccctggatattctaattaccttgatttcatctgcaagagacattgaaagatgaagacgtacacagttgattcactagcccactttcttctcccataccttatctgacatctttaatttctgcctccctaatagtgttttcagtgttggcttgtttttctaattctaaaatgttaactttcattttgttctacatgcctttctctggttactattagactttgattattgtttctgctgcctctatttcttctctctcatctccctccttaatcccttctttctttatttattttttttgagccagagtcttgctctgttgcccaggctggagtgcagtggtgcaacctctcagctcgctgcaacctccgcctccccggttcaatcaattcttctgcctcagcctccgaaatagctgggactacaggcccacgccagcatgcccagctaattttggtattttaggtagagacagggttttaccatgttggccaggctggtctggaactcctgatcccccaccttggcttccgaaagtgttgggattacaggtgtgagccactgcacccggccttaatcccttctaactgactcattttcttaccacttctgagttaaattaaccaattagcttcctcctgattaaattttgatgtttctttgatgccctgataatctcctttaggatctctaaaccttgacccaaatactcctatgtgtcttctcttttaatttgttgctcagtttcacccaactttttttttttcatcattctagcagtactaacctgttaactgtgggagtctttccttaagaggcgctcaacttacgtgattttaattgccatttatatctgaatatctctcagctacatgggtattctacaatccttcatcccacaaagtgtttctctcttttggaattttcctgtatgcttctgtggcattctagcacagggatccctctttcctatagcagacaagttagaaaaagaggagagacaagaacctagggagacacccatgatgggaaacaaactacatcttgcagcacatgaaaatatactactgagtgctttactgattccaggcactaagctaagtactttaaatatggattatctcatttaatatttacacgactgtacatggtggcactgttattatccccatttacaggtaaagaaatcatagctttcagaggttaggtaatttaccctaagtgtcagagctggggcttgaagctaggcctgtgacactaaaatgcatgctcttacctattctattaaagtgcctcagagattatttccttaaaaagaatgccaactaggggccgggcgcagtggctcacacctgtaatcccagcactttgggaggccaaggcaggcagatcacgaggtcaggagatcgagaccatcctggctaacatggtgaaaccccgtctctactaaaaatacaaaaaattagccaggcatagtggcaggtgcctgcagtcccagctaccgagaggctgaggcaggagaatggtatgaacctgggaggcggagcttgcagtgagccgagatcacgcgccactgcactccagcctgggcgacacagcgagactccgtctcaaaaaaaaaaaaaaaaaaacaatgccaactaggaagctcctgggagcatttctggtttctcaaccttgaataaatcttacctggaagcagacgaggccacagagggcaagaacacgtcctttcatgccacggctgagccagccctttctccaaaagtaggcagcaggcaggatgtacacaaggcctacaaggcgaccccacattcggtgtgagtactccatgtaccagatgaacttgaattctgtcagtgtcatatcatgattcaagctgggtgaaatggaaagtcaaaaaaggaggaggaggaaacatccttctgatttttattttcttacggaatgcaaaacctttctttctcagtcctgcaacttggtaggtctgccctcttcctcatcaacgacctcaggatgactttggatttgggggcttagaagacaagctgactaaacataactgaaccgaagttcatgaaataatctaaccattctgaagggtttaagtccaaaagatcaaatgggcctactgggatgtttacctaattttctctaatacttacattttaaattctggaaattgctggtatctttggaattctgcttcccattcctcttggcttgtaggtggcttcatctcctttattaaatgccaatctaccatcgagaggccagactctgtcaaccttaggataggaaagaaattttggggtgtatgcgtgaggctggattactcacaaaaggtttatagcaacaagtggatctgaacttaaccttgttaaaggtaaacacattgtttccttgtttcctcttttgagacatttctctgttactgcttggaattttgtcagaaacagctgccatcaggtacaaatttatttacccttatattctctcaatccttttattcaactctccccaattcttttttttttcccaattcttcctttcactagcattcctcaacaggtaaaatcaacccctacagccaaagaaatgtgttctaaatgcataaccaacattccttacccagggaaaagagacctgttacatgtatacaggtttagattcttgggtgaatttaaagacaataaaattcaaatttgtttcacttgctcataacaacctatataacacataaggtattttgaaataagggacgtggaatgtgaagagaatttgaggaagacacatttgattaaaactagaaacttttttaccaaaaggaattaggattcctagagtaaaagcctgattttaggcctgaggcaagaaatgcacaagatgagctcggaacatcttgtcatactagaaagtaaggaaactatcaaaggtaattagggccctgccaaaaagtcactagagccaatttcaggagatgcccactgactaaagatgggacaatctgagcaaatcactaacaccatcatcacaacggaccgaaacattatcgagtgtgtttgaacctatgatctcataatgagccttaaaaattcaaatcctttatttgttgcctttggaggatttgggggaccaatttattattttgaaaattggtaaataaagggaaagaagaatcaagtatgtatcctgcctttcctatacaaactataccttgggatatccaaactgatgatgagggaaagctttttagagttgagctaataaaatattataattttgctacgctaatgaaataatggatctaggcaatggtaattaatggctgttaacatctataatagacaccagatattcacgaatgttctattcacctactgaagtattttgctccctcatccctaatttgaatctgatcaaccaactactcattcacaggaaatagacgggacaaaggaacatgttaaatatcacacagttatgcagtcagcaaaatctaaactgtgcataaccataggacaaatgactagagtttcctcagcaactagaagagggggaaagggaggagtgtctaaatctatagtctcttgatagatttaaacaaacctaagaaacatgaaccaattgtgatgtacagaacttctttgggtttaattcaaacaaactgtaaaaaaagttttgagacaaacttggactctgattgaaagagaaaagatacataaacaatgcacaggtaccagttaagacataaaccagtctttatagaaggctcctactaataaaacactcaactgttctatggcagggcaagccatcagacatgttccttctttaaggcctcggtttctccatctatacaatgagggagctagactagatgctctgtaaaattcctttctccagctgggcatggtggctcatgcctgtaatcctggcactttgggaggccgaggtgggcagatcacctgaggtgaggagtttggatcagcctggccaacatggtgaaaccctgtctctactaaaaatacaaaaaattagccagatatggtggcacgcgcctagtcccagctacttgggaggctgaggcaggagaatcgcttgaactcaggagacggaggttgcagtcagccgagatcacaccactgcactccagcctggccaacagagcaagactctgtctcaaaaaaaaaaaaaaaaaaaatcctttctcctcagtcaacctgtgcttctactgatgatccaaatacctgactcactacgagcaaattacttacctagttactccaccaagaataactgctccagccactgttccactgcagaccaggagccatcggcccaccacccgctcagcagcctttgagggaagggacactgtaccccttccagattgcaaagctacttcagagatggtgctgtattgccctggcctcaaagggcgcctgatgcaatcacactaaagatcaagatagacaaattacaactggagaaacagggaatggctgctacccacactcaaccccattctgattagcgcgaagtaccatagcatccccacagccatgtcttgttaagtcatcatctcttatctggattactgcatcagccttccaactggttttccaattggttttcaaatctagcctcactcaaacctatccccaactacatgaatcttctcatctctgaatacttccctcagacttcactctacttacagatatggaatattttctttcacctctaggtctttcaacatttctctctggcttgtacacttcctttcccctgattaataatacctactgcagatctccgcttacatgtcacctcctctgggatgtattcccaggctcttcaaggtctgcaataggtcactcccacagcacactggaaagcccttaatacactgtaatgtacagtcaagcatcacttaacaacaggggcacatgttctgtgaaatgcattcttaagcaatttcatcattgtgtgaacctcatagaatgtacttacacaaatctaaaggctgggtgtagtgattcacacctgtaatcccagcactttgggaggcagaggcagggagatcacttgggtcaggaattcaagaccagcctggccaaaatggtgaaaccccatctttaccaaaaatacaaaaattagctgggcatggtggtgtatgcttgtaatcccagctatttgagaggctgaggtggcaggatcacttgaacctgggaggcagaggttgcagtgagccaaggtctcaccactgcactccagcctaggcgatgaagtgagactccatctctcaaaaaaaaaagtacttacagaaatctagatggtatcgcctactacacccctgagctatatggtatgacttattgctcttaggctataaatctgtatggcatattatgtaccgaatactgtaacacaatggtatttgtttatctaaacatagaaaaattacagtaaaaatatggtataaaagatttaaaaatggggccaggtgcaacggctcaagcctataatcccaaggctttgggaggccaaggtgagaggatcacttgaggccagtagttcgagaccagcctgggcaatgtagcgagaccccctatctctattttttcaaaaattaggcacagtggcacacacttgtagtcttagctacttaagtgactgaggtaagaggatgcttgaggccaggatttccaagctggaggctgcagtgagttataatcatgccacagcactccagcctgggtgacaaagtaaaacgctgtctctaaaaaagaaatttagagaaaaagatttttttttaaaaaaaaggtacacttggaaaggcagctccattataatcttatgggaccatgactgtatctgtggcctgttgttgaccaaaatgttgttatgcagcacatcactctaccttcaggttcatctgtttgtatctcccactaaactatgagctttggggtggcagtgtccggtcagtcttgctctctcccttctgctagctttgtttctaacactgttcctttatataatgagaccatgataaggatttcgcaaatgaataaactgacttcctccagggcaggagtcttgtaatatttatctttctttttccagttcctaatatataataaccactcaataattactagttaagcaaatgcatgccctcttcttactatatccctgtgagtccaaagatccatgctcggtttcctatttctgattaactgagtcacctttagaaaagtaactttaagcctcaatttccttctctgtaggatgcagtaatacttcctcatctgactacttggaactttttaagcaaaaataaactatatgggtaaaaattactcagcttttaccatgtgctaaaggcctgatgtatattaaagaatgtaatcctcataacaaaccttaaagtaggtattgttatccccattttacagataaggaaactgaagaacagaaagtttaattaacttggccaataccacacagcaggtcaatgttccagatctgaacctaggggctctgatctgaacctatgcgttgtgagtgcactgtaaggagctccggaaacgtgatgtggggctctacattatctttatcccggccctttcactccatccccgctcccgcgactcggagtccgctgcagtgcggtacctgtgctctaggcgctgccctaggagccaggagcggcagatactgcctccccttcaaggccctcaacggcggaaagagcaatcgctgcatactgatgacagggaacagccacctcttccacaacccagggctctgtggtctccctcctccgcc

SEQ ID NO: 12318 - DNA, 445 bp, Homo sapiens
attttacacaaacaacacactgataatagaactgttgttcctatcttaggagagtaactgaagcataaagagcttccccttggccaggaagcctctgaataacatgcacagattgtgtactaatgaatgtttatatgaagagtcttgcctttatttattatttatttatttttgagacagagtctcactctgtcatccaggttggagtgcagtggcacaatcttggctcactgcaacctccacctcccgggttcaagtgattctcctgcctcaacctcctgagtagctgggattacaggtgtgtgccaccatgccctactaattttttatatttttagtagagatggggtttcgccatgttggccaggctgatctggaactcctggcctcatgatctacctggctcagcctcccaaagcgctgggattacaggcttgaaccacca

SEQ ID NO: 12319 - DNA, 6850 bp, Homo sapiens
tgcctcagcctcccaaagtgctgggattctgtaatcccactgtaatcccagtggctgagccactgcgcccagcctgcttttgacttttacgacatcgacccttctatgatacatcactgaaactaatacaaatggtggaagaattggtatctcatagaaacatttttagagaaatgaaaaagcagaaaagtcaagacaaattatagtgtatttctgtaaagttacacagaatgtgctagcctctcctgcctccccctccacttcttctgcctctgccactcctgagacagcaagaccaaccctacccttctgcctactcaacagtgaagataatggggatgaaggcctgtatggtgatccagttaatgaatagtaaatatactttctcttccttaggattttcttaatatttttttctaactttacttttagaatattgcttacaatacataaaacaaaaatgcttccagtcaacagcaggctattacattttagggcaaaatttattatagttctcagttacataagtgggagctgaatgatcagaacccatggacacatagtggggaacaacatacactggagcctgtttggtgggggagttggtcaacggggagggagagcatcaggaagagtacctaatggatgctggggttaatacctaggtgatgggttgatctgtgcagcaaaccaccatgacacacatttacctatataacaaacctgcgcatgtacgccagaacttaaaagttgaaggaaaaaaaaatttcattatggcagagttttgactacatgggtggtcggtgcccctaacccctccattgttcaagggtcaagtgcatattaatataatcagaaaaataacagaacgagaattttttaaattattgcatattgaaagtgtactcataggcaattagtatgctaaatatatattacaagttacgagcaaaatagtggttacatcgattgatttttgaatagtggaccagccttgcattgatgtaataaactcccacttggatgtgatatataatactgctgcattcactttgctagctaacaatagaaactaagattagaaggaaagcatatgtttagcttagcatggtggttccaaatctggctaatcaaaatcaactggaggacttgaaaacacaaatttccaaaccctaactctgcagtgagtttggtgtgctgcctaggaacctgcattttaaatatgctttctaataatatttatggagccaagtaagcccagccatctatttataaagtggaatagtacattgagattgttggtttagtgtttaaaacaaaagcaaaatatctttgagaagtctatcaggtttttcttacacacgtgatagacatgtaatttagtgcttcctattattccaggatacagaaatgaacaatagtgtctaccacctggatgtacactgtttaataggtgaaatagatatgtaaaagcaattaaaatatgataaatgctatgagagagaagtaaaaagtgttataggtgatctgataatggactgattgattacctggcagttttaaggaagcctttaaaaataatatatttgaactgggttttaaagaatgatataaatgttgctaatacaccaaaaaaatgtcatctgcaaatatggtttgttcactaaatggagagaaggggaggatgataggacatgaggctaggaaatgtaggttgcagctcaatgatgtgtatgtagggccttattttccattctgaaacatagttagtggatttatatcaaaggatttcaaatagaagaacatcatgatgagaataattttaggatttatatactctactttagggggtggagagttctttttacctaggcttagggaatagaaagtggtgtagagaatataacttcaattacttctttcatcatttttcttcctttagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagcttgtgagtttttgtttttttttttaaattcagtttagctctaaaacctcattttttaaaaacttgttgactttattaaatcttactttcctttgttgagcaagtatggttgagcacaatccttataccaaccaagttactgggactttaacaaatacaactaataagggtaaaatctctctctttttaaatactgttaaatgttttgaagaccaaggtttatatttaagttttatttctttgagaacttatgatatacagtcatgcatcactgaatgacaaagatgtgctctgagaaatacatcattaggcgattttcttttccttgtgctaacataagagtgtgctaagcttatagcttattgctcctaggctacaaacctatacagcatgttactctactactaaatactatatgcagttgtaacacaatggtaagtatttgtgtatataaacatctaggtagagtaaaaatatgatactaaagtcttacgggaccactgttgtatatgtggtctgttgtttactacatcatcatctggcacctgacatcacattcattttagctaaacttaactgataagacatgagtgtttgaagagcaagattcatctgtagactttacatatacaatactcttttggggaaaataagaatataaagaattaaccttgaaattaagaactcttgcatttccctctagtgcctttcttgaacttttaaattcatatttttaattaaaaatttcttgatctaggctaggcatggtggctcacacctgtaatcccagcactttgggaggctgaagtgggcatatcacatcctggctaacagggtgaaaacctgtctgtactaaaaatacaaaaaattggccaggcatggtggcaggcgcctgtagtcccagctactcgggaggctgaggcaggagaatggcgtgaacccgggaggcagagcttgctgtgagccgagatcatgtcactgcactccagcctgggcgacagagcaagactccgtctcaaaaaaaaaaaaaaaatttattgctctgttcaaaaaatggagtcattttttaaacacatggagcagtaacccataatgaggtataatagacctaaccatgaaacacagaaaacttaaccatgttctacttctgctttgtatatagtgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccaggtaactcagttttccttcactcaagtttctaatgattaagaaaaaaaaaacactttaattcaaatattaaatgatgacactaagtgtatcatagataaatatctacaggagatacttctttactgaagacatttgttcattgagaattggtaagtggattaagaaagaagacacttttagtcacttagcatattcatctaagaaacatctttcaaatactgaatatatttaatattctttatgaataagctttaacttctttgatgaatttaaattggagtttatccaagtaagtttttttaaaagcacctgcgaaattctgtttccaaaggaataagtcatacattaaatatgtgaaatatatttatgttgctaatcattttatatcagccaacaatgtagtactaccagatgcagtggtgacatcacactcaagggttttcaaccagagagaaacatgattcatatatttaagagattactgtagtgactaggggtagggtaatgggatcaaggcagagaggctgagagatcagctatagatgtatcagaggtggtcagcaagacagtagttgggtttgggcagaggtaaacagatttgaggtatgttttggaagtaaaaaaaatattggggttacttgctgctgggtatcatgtagaaggagagggagttaggatggtgattccactgactaaaatggagaaagctgagaagttcagagagcagaacagttttgttgactgttgattggtagccatatgatagacacacagtgccaagtgctctgagtatatcttctcatttaattttcacaaaaggcttctgaggtgggtatattctcatattatagatgaggtagatgctaagccacattttctgggaagtatgcatatatcctcagtgaaattaaataacttgcccaagtaccagcttactgggaaatggcagagctgggatgaaactagccttttcaactctaaaactttggctgttttttcaaagttcatgtatgaaaaagaaatacaagcaaattattcctgtaggagtaaggagtaatggtctaatttgttgcttatactaattagacttattctattggaacaccaacatgccagcatcagtttggctaaagtaaaaataaagctcccgtatttaaaattattctaaaaataatggaacaaaaataaaattcttttcatagtattaatacattaccaattacatctgttcatccatctggaaattgcttctttgcctcctcagactagtttctagaatatctttctcctcttctcccatttgtgaaaatccttcccattcttcttttctctgtgtctgattttttgcctccttcatgagtctttccttcaactccccttgtttctcactcgccctgttctgtactttggcaatattgccttaatttaggacaaccagaatttgtttactcatgtctacttgtttgtgtattgttttatatatatataagcatatatttatttatattaatatttaagtgttaaatgactagtgcagtagattttgaagtctttaaaagaaagcctagaatgtattatttttcagttagcatgagagttaaccaaaaaaaggtactcttgtactttttgttgtcagaaaaaaaatattttcattaaattctccttttccttcctgccttggttatttggtatagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgcttttgggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatataaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattgaaaactcctgttatctccttgtttgaatttcaggtcattaaattgtataaccatcatttgaa

SEQ ID NO: 12320 - DNA, 6841 bp, Homo sapiens
tgcctcagcctcccaaagtgctgggattctgtaatcccactgtaatcccagtggctgagccactgcgcccagcctgcttttgacttttacgacatcgacccttctatgatacatcactgaaactaaaacaaatggtggaagaattggtatctcatagaaacatttttagagaaatgaaaaagcagaaaagtcaagacaaattatagtgtatttctgtaaagttacacagaatgtgctagcctctcctgcctccccctccacttcttctgcctctgccactcctgagacagcaagaccaaccctacccttctgcctactcaacagtgaagataatggggatgaaggcctgtatggtgatccagttaatgaatagtaaatatactttctcttccttaggattttcttaatatttttttctaactttacttttagaatattgcttacaatacataaaacaaaaatgcttccagtcaacagcaggctattacattttagggcaaaatttattatagttctcagttacataagtgggagctgaatgatcagaacccatggacacatagtggggaacaacatacactggagcctgtttggtgggggagttggtcaacggggagggagagcatcaggaagagtacctaatggatgctggggttaatacctaggtgatgggttgatctgtgcagcaaaccaccatgacacacatttacctatataacaaacctgcgcatgtacgccagaacttaaaagttgaaggaaaaaaaatttcattatggcagagttttgactacatgggtggtcggtgcccctaacccctccattgttcaagggtcaagtgcatattaatataatcagaaaaataacagaacgagaattttttaaattattgcatattgaaagtgtactcataggcaattagtatgctaaatatatattacaagttacgagcaaaatagtggttacatcgattgatttttgaatagtggaccagccttgcattgatgtaataaactcccacttggatgtgatatataatactgctgcattcactttgctagctaacaatagaaactaagattagaaggaaagcatatgtttagcttagcatggtggttccaaatctggctaatcaaaatcaactggaggacttgaaaacacaaatttccaaaccctaactctgcagtgagtttggtgtgctgcctaggaacctgcattttaaatatgctttctaataatatttatggagccaagtaagcccagccatctatttataaagtggaatagtacattgagattgttggtttagtgtttaaaacaaaagcaaaatatctttgagaagtctatcaggtttttcttacacacgtgatagacatgtaatttagtgcttcctattattccaggatacagaaatgaacaatagtgtctaccacctggatgtacactgtttaataggtgaaatagatatgtaaaagcaattaaaatatgataaatgctatgagagagatgtaaaaagtgttataggtgatctgataatggactgattgattacctggcagttttaaggaagcctttaaaaataatatatttgaactgggttttaaagaatgatataaatgttgctaatacaccaaaaaaatgtcatctgcaaatatggtttgttcacaaaatggagagaaggggaggatggtaggacatgaggctaggaaatgtaggttgcagctcaatgatgtgtatgtagggccttatacatagttagtggatttatatcaaaggatttcaaatagaagaacatcatgatgagaataattttaggatttatatactctactttagggggtggagagttctttttacctaggcttagggaatagaaagtggtgtagagaatataacttcaattacttctttcatcatttttcttcctttagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagcttgtgagtttttgtttttttttttaaattcagtttagctctaaaacctcattttttaaaaacttgttgactttattaaatcttactttcctttgttgagcaagtatggttgagcacaatccttataccaaccaagttactgggactttaacaaatacaactaataagggtaaaatctctctctttttaaatactgttaaatgttttgaagaccaaggtttatatttaagttttatttctttgagaacttatgatatacagtcatgcatcactgaatgacaaagatgtgctctgagaaatacatcattaggcgattttcttttccttgtgctaacataagagtgtgctaagcttatagcttattgctcctaggctacaaacctatacagcatgttactctactactaaatactatatgcagttgtaacacaatggtaagtatttgtgtatataaacatctaggtagagtaaaaatatgatactaaagtcttacgggaccactgttgtatatgtggtctgttgtttactacatcatcatctggcacctgacatcacattcattttagctaaacttaactgataagacatgagtgtttgaagagcaagattcatctgtagactttacatatacaatactcttttggggaaaataagaatataaagaattaaccttgaaattaagaactcttgcatttccctctagtgcctttcttgaacttttaaattcatatttttaattaaaaatttcttgatctaggctaggcatggtggctcacacctgtaatcccagcactttgggaggctgaagtgggcatatcacatcctggctaacagggtgaaaacctgtctgtactaaaaatacaaaaaattggccaggcatggtggcaggcgcctgtagtcccagctactcgggaggctgaggcaggagaatggcgtgaacccgggaggcagagcttgctgtgagccgagatcatgtcactgcactccagcctgggcgacagagcaagactccgtctcaaaaaaaaaaaaaaaaatttattgctctgttcaaaaaatggagtcattttttaaacacatggagcagtaacccataatgaggtataatagacctaaccatgaaacacagaaaacttaaccatgttctacttctgctttgtatatagtgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccaggtaactcagttttccttcactcaagtttctaatgattaagaaaaaaaaaacactttaattcaaatattaaatgatgacactaagtgtatcatagataaatatctacaggagatacttctttactgaagacatttgttcattgagaatgggtaagtggattaagaaagaagacacttttagtcacttagcatattcatctaagaaacatctttcaaatactgaatatatttaatattctttatgaataagctttaacttctttgatgaatttaaattggagtttatccaagtaagtttttttaaaagcacctgcgaaattctgtttccaaaggaataagtcatacattaaatatgtgaaatatatttatgttgctaatcattttatatcagccaacaatgtagtactaccagatgcagtggtgacatcacactcaagggttttcaaccagagagaaacatgattcatatatttaagagattactgtagtgactaggggtagggtaatgggatcaaggcagagaggctgagagatcagctatagatgtatcagaggtggtcagcaagacagtagttgggtttgggcagaggtaaacagatttgaggtatgttttggaagtaaaaaaaatattggggttacttgctgctgggtatcatgtagaaggagagggagttaggatggtgattccactgactaaaatggagaaagctgagaagttcagagagcagaacagttttgttgactgttgattggtagccatatgatagacacacagtgccaagtgctctgagtatatcttctcatttaattttcacaaaaggcttctgaggtgggtatattctcatattatagatgaggtagatgctaagccacattttctgggaagtatgcatatatcctcagtgaaattaaataacttgcccaagtaccagcttactgggaaatggcagagctgggatgaaactagccttttcaactctaaaactttggctgttttttcaaagttcatgtatgaaaaagaaatacaagcaaattattcctgtaggagtaaggagtaatggtctaatttgttgcttatactaattagacttattctattggaacaccaacatgccagcatcagtttggctaaagtaaaaataaagctcccgtatttaaaattattctaaaaataatggaacaaaaataaaattcttttcatagtattaatacattaccaattacatctgttcatccatctggaaattgcttctttgcctcctcagactagtttctagaatatctttctcctcttctcccatttgtgaaaatccttcccattcttcttttctctgtgtctgattttttgcctccttcatgagtctttccttcaactccccttgtttctcactcgccctgttctgtactttggcaatattgccttaatttaggacaaccagaatttgtttactcatgtctacttgtttgtgtattgttttatatatatataagcatatatttatttatattaatatttaagtgttaaatgactagtgcagtagattttgaagtctttaaaagaaagcctagaatgtattatttgagtttcagttagcatgagagttaaccaaaaaaaggtactcttgtactttttgttgtcagaaaaaaaatattttcattaaattctccttttccttcctgccttggttatttggtatagctggagaaacagaagttagagaagcagaagaaggaattaaaagctaccaaaaagactcttgatgaagaaagaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatatgaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttaagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcagctattaaaaactcctgttatctccttgtttgaatttcaggtcattaaattgtataaccatcatttgaa

SEQ ID NO: 12321 - DNA, 6855 bp, Homo sapiens
tgcctcagcctcccaaagtgctgggattctgtaatcccactgtaatcccagtggctgagccactgcgcccagcctgcttttgacttttacgacatcgacccttctatgatacatcactgaaactaaaacaaatggtggaagaattggtatctcatagaaacatttttagagaaatgaaaaagcagaaaagtcaagacaaattatagtgtatttctgtaaagttacacagaatgtgctagcctctcctgcctccccctccacttcttctgcctctgccactcctgagacagcaagaccaaccctacccttctgcctactcaacagtgaagataatggggatgaaggcctgtatggtgatccagttaatgaatagtaaatatactttctcttccttaggattttcttaatatttttttctaactttacttttagaatattgcttacaatacataaaacaaaaatgcttccagtcaacagcaggctattacattttagggcaaaatttattacagttctcagttacataagtgggagctgaatgatcagaacccatggacacatagtggggaacaacatacactggagcctgtttggtgggggagttggtcaacggggagggagagcatcaggaagagtacctaatggatgctggggttaatacctaggtgatgggttgatctgtgcagcaaaccaccatgacacacatttacctatataacaaacctgcgcatgtacgccagaacttaaaagttgaaggaaaaaaaaatttcattatggcagagttttgactacatgggtggtcggtgcccctaacccctccatggttcaagggtcaagtgcatattaatataatcagaaaaatcacagaacgagaatgttttaaattattgcatattgaaagtgtactcataggcaattagtatgctaaatatatattacaagttacgagcaaaatagtggttacatcgatggattttagaatagtggaccagccttgcattgatgtaataaactcccacttggatgtgatatataatactgctgcattcactttgctagctaacaatagaaactaagattagaaggaaagcatatgtttagcttagcatggtggttccaaatctggctaatcaaaatcaactggaggacttgaaaacacaaatttccaaaccctaactctgcagtgagtttggtgtgctgcctaggaacctgcattttaaatatgctttctaataatatttatggagccaagtaagcccagccatctatttataaagtggaatagtacattgagattgttggtttagtgtttaaaacaaaagcaaaatatctttgagaagtctatcaggtttttcttacacacatgatagacatgtaatttagtgcttcctattattccaggatacagaaatgaacaatagtgtctaccacctggatgtacactgtttaataggtgaaatagatacgtaaaagcaattaaaatatgataaatgctatgagagagatgtaaaaagtgttataggtgatctgagaatggactgattgattacctggcagttttaaggaagcctttaaaaataatatatttgaactgggttttaaagaatgatataaatgttgctaatacaccaaaaaaatgtcatctgcaaatatggtttgttcacaaaatggagagaaggggaggatgataggacatgaggctaggaaatgtaggttgcagctcaatgatgtgtatgtagggccttattttccattctgaaacatagttagtggatttatatcaaaggatttcaaatagaagaacatcatgatgagaataattttaggatttatatactctactttggggggtggagagttctttttacctaggcttagggaatagaaagtggtgtagagaatataacttcaattacttctttcatcatttttcttcctttagtccacaagccctagccatgccgtggtagccaatgttcagcttgtcttgcatctaatgaagcaacacagtaaagctttgtgcaatgatcgagtcatcaacagtattcctttggcaaagcaagtatcttcacgaggtggtaaaagtaagaagttgtcagtaacacctccctcctccaacggtattaatgaggagttgtcagaagtcttacagactttacaggatgaatttgggcaaatgagcttgtgagtttttgtttttttttttaaattcagtttagctctaaaacctcattttttaaaaacttgttgactttattaatcttactttcctttgttgagcaagtatggttgagcacaatccttataccaaccaagttactgggactttaacaaatacaactaataagggtaaaatctctctctttttaaatactgttaaatgttttgaagaccaaggtttatatttaagttttatttctttgagaacttatgatatacagtcatgcatcactgaatgacaaagatgtgctctgagaaagacatcattaggcgattttcttttccttgtgctaacataagagtgtgctaagcttatagcttattgctcctaggctacaaacctatacagcatgttactctactactaaatactatatgcagttgtaacacaatggtaagtatttgtgtatataaacatatctaggtagagtaaaaatatgatactaaagtcttacaggaccactgttgtatatgtggtctgttgtttactacatcatcatctggcacctgacattacattcattttagctaaacttaactgataagacatgagtgtttgaagagcaagattcatctgtagactttacatatacaatactcttttggggaaaataagaatataaagaattaaccttgaaattaagaattcttgcatttccctctagtgcctttcttgaacttttaaattcatatttttaattaaaaatttcttgatctaggctaggcatggtggctcacacctgtaatcccagcactttgggaggctgaagtgggcatatcacatcctggctaacagggtgaaaacctgtctgtactaaaaatacaaaaaattggccaggcatggtggcaggcgcctgtagtcccagctactcgggaggctgaggcaggagaatggcgtgaacccgggaggcagagcttgctgtgagccgagatcatgtcactgcactccagcctgggcgacagagcaagactccgtctcaaaaaaaaaaaaaaaatttattgctctgttcaaaaaatggagtcattttttaaacacatggagcagtaacccataatgaggtataatagacctaaccatgaaacacagaaaacttaaccatattctacttctgctttgtatatagtgatcaccagcagcttgcaaaacttatccaggagtcgccaaccgttgaactgaaagacaagttggagtgtgaattggaggcattagtgggaaggatggaagcaaaagccaaccaaataactaaagttcgaaaataccaagcccaggtaactcagttttccttcactcaagtttctaatgattaagaaaaaaaaaaacactttaattcaaatattaaatgatgacactaagtgtatcatagataaatatctacaggagatacttctttactgaagacatttgttcattgagaattggtaagtggattaagaaagaagacacttttagtcacttagcatattcatctaagaaacatctttcaaatactgaatatatttaatattctttatgaataagctttaacttctttgatgaatttaaatcggagtttatccaagtaagtttttttaaaagcacctgcgaaattctgtttccaaaggaataagtcatacattaaatatgtgaaatatatttatgttggtaatcattttatatcagccaacaatgtagtactaccagatgcagtggtgacatcacactcaagggttttcaaccagagagaaacatgattcatatatttaagagattactgtagtgactaggggtagggtaatgggatcaaggcagagaggctgagagatcagctatagatgtatcagaggtggtcagcaagacagtagttgggtttgggcagaggtaaacagatttgaggtatgttttggaagtaaaaaaaatattggggttacttgctgctgggtatcatgtagaaggagagggagttaggatggtgattccactgactaaaatggagaaagctgagaagttcagagagcagaacaggtttgttgactgttgattggtagccatatgatagacacacagtgccaagtgctctgagtatatcttctcatttaattttcacaaaaggcttctgaggtgggtatattctcatattatagatgaggtagatgctaagccacattttctgggaagtatgcatatatcctcagtgaaattaaataacttgcccaagtaccagcttactgggaaatggcagagctgggatgaaactagccttttcaactctaaaacttcggctgttttttcaaagttcatgtatgaaaaagaaatacaagcaaattattcctgtaggagtaaggagtaatggtctaatttgttgcttatactaattagacttattctattggaacaccaacatgccagcatcagtttggctaaagtaaaaataaagctcccgtatttaaaattattctaaaaataatggaacaaaaataaaattcttttcatagtattaatacattaccaattacatctgttcatccatctggaaattgcttctttgcctcctcagactagtttctagaatgtctttctcctcttctcccatttgtgaaaatccttcccattcttcttttctctgtgtctgattttttgcctccttcatgagtctttccttcaactccccttgtttctcactcgccctgttctgtactttggcaatattgccttaatttaggacaaccagaatttgtttactcatgtctacttgtttgtgtattgttttatatatatataagcatatatttatttatattaatatttaagtgttaaatgactagtgcagtagattttgaagtctttaaaagaaagcctagaatgtattatttgagtttcagttagcatgagagttaaccaaaaaaaggtactcttgtactttttgttgtcagaaaaaaaatattttcattaaattctccttttccttcctgccttggttatttggtatagctggagaaacagaagttagagaagcagaagaaggaattaaaagctaccaaaaagactcttgatgaagaaggaaacagcagcagccgttctggaatcacagggaccacaaataagaaagattttatgaaactgagacctggagaaaaaaggagaaaaaatcttcagttattgaaggacatgcaaagcatacagaattcattacaaagcagtagtttgtgttgggattactgactcataaccaggtcagaaattttattcagataatctgtacctcatcaatcagatgatgacaatttacttcccaggtctcatactcacttatgttggaattaattaatagcaggtgttaaaggacccaggcttcattacacaggcttttcatgtatgcaggatgactcaatgttaaagcatttaaatggaaaccaggggagttttaaagcccgagaaaccacacataatcttttgttgagatgagtttgctgtactgacgctgcactttgtaaacagattaccagttttttacttgtgggtgtgattttttaaaatagttctttatatataattaaaattaggtttaaattttcaaaatatgagactatgctataggcagtgcttgcttgaaaagtctcatttttaaatctccctggcatgaggtgcccacttcccctttccaaagcaaccattaaacatactttgtttctactattggtggagtttttctatatttaaaaatacatatatatttcagaggatttttattttgctttttggcatttcagactttgatcagtgttaagtgcacttgtattgctttttaatctgttaattttttaaagacccaagcagtcattttgagttatatctataaaaattataaaaggatttttgaaagtataaacaaattgtcagtgaaataaatgagattttggaataaagtgagaatgggagaagggatatgttgtgagcatataccttcacagttcttaatacctgttttgtaatcatgatattcagtcaaggcattatggtttttaatcttgaaacttagagaaccctttgaatatttgcttttactggtgtacagtatgagtggaatatgaactgtacacataattatcatgttgatataaatcataatttcaactagatcaagacatgttaaccttttataaatttaaagtcaataaagcacctttttaaaggaaacactgcaactttccttaacagcctgttaataaaggctttgtgacaagctctcaaaaaatgcatttctaaataggaggacatcaatgtattgatgaagagaaaaaactagtacttagttgccacactcatgcttacatagaaagagagcccaagaatattagatttcctcatgatacaagatactacagtaacaggctttaatttaggatccttagattttggggtattatttgtgactctcctgaaattgtaaacttgtgcttctgtgtccagttttctaatgagtaggttcgtagcttgattgaattaataattgtgagcccatagacacaagggaagtgagaaacagtgctctggtgacatgataaatatatgtgtcaaccaccatttcaactattaaaaactcctgttatctccttgtttgaatttcaggtcattaaattgtataaccatcatttgaa

SEQ ID NO: 12322 - DNA, 1575 bp, Homo sapiens
acgttgtaacagagctttattgctattcatttcaaataaggttatgtttacagacttgtggtagacatgtgaattgttcattcctatataatgtgaattgcagtggtagtagcggtatacacagtgctatgggggcacagaggaaggtggggatgtcagagaaggcagtcgtgaatcagataacttcccaaaggaagagatgatgcctaaactctagaaaataggaattagtcacaagggagaacagttgttccaggtgcacaagacagactgaaccaaagtggggaggcaggaatctgcagattacatgaggcaattgtgaacagcagagtagcattggtacgtaaaagttgaggtatgcagagactaggtcgaaggaggctaaggagcttcaacttaatcatactggtctctaaattttgtaaccctaatcaaaaagggaaaaaattacacctgcacaaccaatagacatacaaagttatgaaacatgtaactgtcaattcaaatatttaaaagttttgcttgtgtaaatatataaaaagggctagtattcctcctccctccctcccacacacaccagtggtatatattaaatgcccaagtgcatgtactccatattggagacttctgcagaaggtgaggggaaccactggaaggttctcagcagagaagtggtagggttgcacttagatttccctggcttttgatttgaatttgaagtggatgcaagtatgttaagactagaagctttaaattcttgatctcttcagccattctacattcttttatgtggtatcaggccaagataaccaaggtttaaatgaggaaaatggcagatgcgtttgtgaaatacttggagtagaaagcttaatttttaattactgatttgctagccacttaaatgccctgttaaaaagcttatatttcacacaattaccaaagaaatcattttggtaccaattttgctaaattggatatactaatagaaacttcctcactgcaagaccaagagggaggctaaggttcagactctctgtatagtgaattagtgagtggaaaaacactgtatattttaattgtttgatttgggtgttggttaaggaaaaatgggtacaaactgaacattttcatctggggtgcatattcctccaataatttccaaatatttctggggaaaaaaaagaaatggcaactttggacaagaacaaagtttaaaagtcagttggaatttcttttaattaaaagaccaaggggacaagaagctcctttgttacagtacattacatatggctcttatgtagaataaaatagacatcagagtcaaatgtttctaccagcaccaaactcttacttgtagcaggtgaacagtgaagcaagatttcttttactggctttgagattgtaatacatcttttacatgcagtgtgttctttggtagacttaatcgttgagtgaaattacagaatttgcaaaggaaaaaaatgtaaaatttgagcacagtacttctcactataagctatttatacagaattcagaaaaaatgtcaatcctagtaagatttttaaatacttctta

SEQ ID NO: 12323 - DNA, 12281 bp, Homo sapiens
acgttgtaacagagctttattgcaattcatttcaaataaggttatgtttacagacttgtggtagacatgtgaattgttcattccaatataatgtgaattgcagtggtagtagcggtatacacagtgctatgggggcacagaggaaggtggggatgtcagagaaggcagtcgtgaatcagataacttcccaaaggaagagatgatgcctaaactctagaaaataggaattagtcacaagggagaacagttgttccaggtgcacaagacagactgaaccaaagtggggaggcaggaatctgcagattacatgaggcaattgtgaacagcagagtagcattggtacgtaaaagttgaggtatgcagagactaggtcgaaggaggctaaggagcttcaacttaatcatactggtctctaaattttgtaaccctaatcaaaaagggaaaaaattacacctgcacaaccaatagacatacaaagttatgaaacatgtaactgtcaattcaaatatttaaaagttttgcttgtgtaaatatataaaaagggctagtattcctcctccctccctcccacacacaccagtggtatatattaaatgcccaagtgcatgtactccatattggagacttctgcagaaggtgaggggaaccactggaaggttctcagcagagaagtggtagggttgcacttagatttccctggcttttgatttgaatttgaagtggatgcaagtatgttaagactagaagctttaaattcttgatctcttcagccattctacattcttttatgtggtatcaggccaagataaccaaggtttaaatgaggaaaatggcagatgcgtttgtgaaatacttggagtagaaagcttaatttttaattactgatttgctagccacttaaatgccctgttaaaaagcttatatttcacacaattaccaaagaaatcattttggtaccaattttgctaaattggatatactaatagaaacttcctcactgcaagaccaagagggaggctaaggttcagactctctgtatagtgaattagtgagtggaaaaacactgtatattttaattgtttgatttgggtgttggttaaggaaaaatgggtacaaactgaacattttcatctggggtgcatattcctccaataatttccaaatatttctggggaaaaaaaagaaatggcaactttggacaagaacaaagtttaaaagtcagttggaatttcttttaattaaaagaccaaggggacaagaagctcctttgttacagtacattacatatggctcttatgtagaataaaatagacatcagagtcaaatgtttctaccagcaccaaactcttacttgtagcaggtgaacagtgaagcaagatttcttttactggctttgagattgtaatacatcttttacatgcagtgtgttctttggtagacttaatcgttgagtgaaattacagaatttgcaaaggaaaaaaatgtaaaatttgagcacagtacttctcactataagctatttatacagaattcagaaaaaatgtcaatcctagtaagatttttaaatacttcttaaaaacttgctaattagcttctgtgtgttcagacacacaagacaagtgaaatacactgtagtaaataattagtttttaaaatatctttcatgatgtttctggtaattgggctaatctgaagggcatggaattctttgaactcctgtatggctactttctccccttcattttcccccaagcacatctataaggcctcccattttggatcaacttgctaatatgtcttaagtatgtaaataatgacggcaataattttcaactactaccacaccgtagtatcttcaacactttgccttttactatatgaagaatatggaagttgaaaagtgatcaaggtaaatcagttactgaaaaaaagaaaaacctagaatggagaaagggatatcaaatgattttgatctgtcatgacatcaaggcccaatatatgtgatgccacagaatttcagtgttggtttgaaaactgatgttcctctgcacagtgagcacagagtgtatttctaaaatggttttaatattaccagatgccaaaaatttgtaacagcatttgccttttaatagaaacttgttcccactgtgaatccaggattgaagtattttaatattctttggatacttaaaagattagtatcataatcatgtaattacatatggagttacttcacttaagccacctgcactgctacagttctaaactcatcctagagagatttaaaataaataaagtgactgaactttctctcatagatggggtctaaattccgaagactttctactcatagagctgccagtgtaatcaagagtgtatagcaatgatgcccctgatcttacagtcctttatacaacagtttggacaggagtgacacactgtgcaggagagctggctctctctgaggatgaggttgatcggttagaaatctctctctgtagttcctctacttttttctgaagctctgctcgtttagcaagaagttctttgtatctgttgtgaataggttcctgcaagagcaaaacataaaatattcaactaggcaatcctgaccaaagccaggtcaaatcattccctaaatgttgcagtgtatgttttttcagctgttggaaccaatggcacctttccaacccatcagtgaaattaaataccgggactgtggacaccactaatcttttcactggctttcccagtgcccctgagtatttccaaagaataacctgctgtgtaggtgctcctgaaactggtacttttccaaatacaacaaataattaacaagacaattaaaagacagtagtcagaagattccctgttatttataggtttttagtcttaaacagttctaagtagttaatattccataaacatattcacagtagaccagaattttgttcagcttttaactttcctaaagctactttcttcagcttattaaaacaagaccccctagaggttatccagacagaggagggaagatgcaagaaaagagagcagtgatttgtccaatgtcatacaagcagtcctaagaaccaggtatactgattaccctgccccagtgtagtatttttctactatacaattgttaactatcaatgggtaaggagtaaagttttaaatatgcacagataatctttccagctgcttttaaggagacaaagttgcactgcatgaatgaaaactcccattgtatattgtaaggcacatacctgtggtttcatccgtggattccaccttatgtaatatcccacccagagctctaggtggcgcatgctggctactggataaaggacatgattggaatagctcccatagagaggattagtgaagtcttccagctggctgcttatgtaagaccacagtgacacagtccttttaggaagattctgtaggcaggaaaaataggtaaagattctccaccacataagccatttacactttagatgaaatttgtgaagaagtactttgttgtcattaaaatctctttagaggaagtggacttggagacttcagtgataaaccaacttatattaagatcagagggtactggaaaacagtatgcagttcctcaaagagataccatatgacccaacaattccactcttgtacatatccagcaaacagaagacatgtctgtacaaaaacttttttatagatgttcaaagcagcattattcattaacagccaagaagtgggaacaacctaaaagtccatcaactgacgaatggataagtaaaatatatccacacaatggaatattattcagccataaaaagaaatgatataaaatgtatgaaccttgaaagcatattaaaggaaaggagctagacacaaggtttacatattaaatgattccatttatatgaaatgtccagaagaggcaaatctagagacaaaaacattagtgtttggcaggggtgaatggggagtgactattaacaggttttctgaggtgatgaaatgttctgaaatgaaaatgtgatggctgtacaactcagatatactaaaaaccagtcaactatacactatcaaagtgaatttcatggtatgcatattattatcaatttaaaaagtttttttaaaaataatcaatgattcctaccccaaggctctcaaaaaataaaactcttcgaaacttagctatgctatttctaatgaacattccttaagttgttgagtgcctgctatgcatagaaatacttactgcatgctagacactgaagacataaggtgaatttaaaaatttaatacctgcctttaaggaagtctaggaaatactacatagcagttcttgtggtattttgtattgcttatttaataatcttcataattttacaaaagcagacattaacttccccaagcgaactgttacagtaagtgatagatccaggatttgaacccagcaactgggcttcagtgcaagtacttattcctactgtgctttataaaataaaacataaatactttgtaaccacattttttagaataaaagttgatgcagagggagataccaatcaagatgattaagatgttgatacataggatagacaagttttgataaagaagtaaaacttgaaatgtaatccttacaccatttcttcttaataccaaccccacttaacagtgatacctttggggaaaagggataacgaaaaactttaactttctacatactatcttttccgtatttgaatttttttatggtattactttacaacttaaaaaactcaaaaacttaacctaaaatgtctcaataagtaggatatacttgggaatttgagctgcctattcactcgaatatacattttctgctaattaaatttttctgcacctgctgtaaaggatttccattctacatggaaaaattggtacactggtgctccttagatttcacgtacttcagttctctttagcagaaaccacttcccactcatgaactcagcagacagctagctagcaccttcagccttgtgacaaagatacttcagaatatatcaggtccagatatatggaaggaagccctcaatattatagcatgtaagataaagtatgacccaaaagaatgacttcagttgaaatctgtcacagagtacattcttttagggaaaagtatacagtagagatagtatggggaaggtcatgtttcatattttacctcttttcctctctgttgttcactattacagaggaatgttccgaataagcagctgtataggtggtccaaaatggtaatgagaaaatactcattgaattcaaatgcggtaggaaactgcaaatcaaacatcacaaacacataaattaagacattcttcaagcatattcatccctgtcatgggtagatccttttgaggtagtatttaaaatgaagttaaacattcaaatctacattattccaagccattatggcattattcgtatggttttcttttcaaaaatcatgttatcacttttctgatcatgatgtttctgtatctgctatatctgctaaccctaaatttgcaggctgaattttgacttaggcaattctggcaactctaggcattctctgcccaaaatgaccacaaacaacattaagattctttaaattttcaagaacatagttgtttttcttttttaaggattacacacaaaatgccaataatgtctccagaaaatgtcagcaatacacaaaagtaaacatctaaggcagataatttacaagtcaaccaacctattaaatatttagatggtgcaaaagtaattgcggcttttgccattgaaatggcaattacttttgcaccgacgtaaacttttcagggaacatccatcccatcaaaccagagtcccttgtaagccactattttggcagcatctaacaaaaagaaaattcactctctaacccaagccaggggcttgactggatgtcttagttttacacaacacaattttaggggactaatcaaatgaaaaattacgaacccctgaaagttagaaggtttcgtttaatccatcctatctaatatttcagaattatttggaagcttctatgtaagattctaccaattatagggctgtacgtgataagaaattatataaatatttagattgcagactgtgaaaatacacattgcttccaagcttttacatcttagatcccttcctttatagtggaggaaaatagtataaacatcatgtaaatggaacatggatgaaaacaactttgccttaaagtttcctacattttagcaagtatagacagggtaacatgacagatttcctaaacaagaaagggcacttactaggccttgatttttgtggctgtgaagctgaatgaagcagatgatcaagcagaagatgaccaagcatttccacaacaaaaccaattgtaaaaaactttgtcaagtcccatttattcctttaaaaaataaatcccacctatttttcacactcttaacagccctattattagcgaaatatgaatgcatcctgaatcactaaatagcaatcccaaggatctaagcctgcgattagtttttcatcttcttggcaaaactgttagctcagttatgagaagacagtgtaatcagtaggcatttcctcacaaagaaagtaaaatagcagggcattaactgcagctattgcttttaaaaccctcagcagaagagaactattttgttttctttacatgtttaaaatctaaaaggcccttcaacaattgcttcctgatctcagggctgaggtgacagagatgaggatggaaataggaggagaggtatagaatctggctgtcataacatagttggttctgttttgacaaatgtgctattcaagtctctgtactagtattcaagtatttataaaactgataattgctaacaaacattatgactagttaatatgctttatattcaggaagaaaatatacagaaaaacactaggtgtataaaataaagatggctacaaagtattttaggttctatcaaaaatacagatttaaactgattttcttttatttagtgccaggctcaaaattaggattaaactacttttagatagacagcatatataaagttaacaaaattaaaattactaaggaagaaatgtattatgatgtattcttctcccatccaagtgctaacaaggcccgaccctgcttagcttccaaaatcagatgagatgggtgcattcagggtggttggctatagattatcgtgtactcttctttgcaagaaattggtaaatgtgctttttttctagcaaacatatcagaactgatacattcaaacacatcgtttccttcaaggtattcaccttggaaagcagtacacacaaccatcaacaataccacagtttcaaagagctttcctactcctttgatggcgaattttatttctaccaagagtcaaaggttatttaagactgaatatggtaacagtcaaaagtggggtcctaatgttttgggtcaaacatccaaaaaaggattgtagggacttaggtagttgatatactgcctcaaagccaattccaaaggaaaaagtcaaacctaatccaagaaagtattaaacactgcacctctccttcctcttacctcccaacacaccaaaggtctgatttataaaccaaaactgaattgtatacaccttttcagtatatatgctaaaatactagtctcatcatatcatagtcatagctacaaaaatgcttcatttaacccaacagtttctaaataattcacccaagtagaaatgcttatggaggcaagggactgttaaatatataattgatgattatttcaccccattaccattaattttcttgtattgaaataaacagtattttattgaagctaaaaatatgctcctaaataaatatgatccaaagccaggcagagccagcacttgccctactttaaattcatatggcaatctaaataaaaacaattcagacttccagttgttttggggtctaataaacccttgggtaaataattatctcccaatgagctgcattcaacagggtttcgagatggtttgagtcagaattaaatcatatttttaagacaatgacccgttgcctcattaataaagtgatctcacaataaaccaggtgttttctcagtcccctctactctttccaaaagattaaattcatttatattaatatttcaaataaatttgttagaagttctaaaagccataatagctctctctatgcccaaaaataaaaagaactggatgtagtatgtgcctcccttgttatgctttctatataaacatttttcccttaaaataaaaattttcagaagaagcagattgaaattcaaaaaaaaaaattaacagttaaagttacttaaaatattttattttgcttgcggtacctagcttattttttctccactcttagcaatatataaatgtgtttttaggtgagcctatttaacactatttgttcaaaacaaatgataaaacctctcaggagttattatcaatgctactcactgaaatactaatagaatcaaattttcaagtgttaatctttaacctgattcataatgtgacaataaatagctctcacatggacatggagatgttacaagaatttccatttaatgatctataggctaatcagtgaccaaatctccccactctgacaggaaaactgaaaggagatgtgtaagaatacataggccagataaattacctgtcttgtcatctgccagacacagtcaataaattgaagaaaaacaggcgatctgtctgcatctgcatggttcttatctccatggccaactctctgaagcaaaaagagtgaaatatatgaacttagggggatttttcatgtttgatggaaataattttttaaaaaaataattggtcaatagtctaaaaattttcaaagtcgggtgctgtggtttacacctgtaatcccaacactttgggaggctgtggtggaaggatcacttggagccaggaattcgagatgggtctgggcaacatagcaagaccccatctctacaaaacatttttaaaagccaggcatggtggcgtgcacctgtagtcctagctttcaggaggctaaggtgggaggctggcttgcgcccaaaagtacaggactacagtgaactacggtcgcatcactgcactccagcctgcatgacagcaaggccctgtctcaaatacataaaaattttcagaaagtcttttaaagagcattgcaaagtaagtaaaaaatcacccattatcctgccaagcagaaacattttgatgtgcaaactgctcagatattttctgacacaagtgcttataatatgaattactactctgtttaataaactcagatcctaaaaggttgctaataaaagatggaagcagtcagaacctcagaggccagatttttgtcctggagattttaatttctctctgagaaataagttacatggacactggcctcagaaagcaccattctctgttcatatcttgaccactgagtgaagggtaccccctcctatcttagcactaatgtgtcttcatcaggaggaaccatattagcacacatcttagaaaacctgtcaaaaatgcttgacatccaccctccaagcatgcagtcatctacctagtttctcagttatttcctctgaggacctttgactcagataactgaaaacagaatcctgctccttaccccaaagcaggaattctaaaagtgtggtccacaaacatccaagggctgtgaggtcaaaactatttccataatattaagacattatttacctttttcagtgtgttggcatttgcactaatgatgcagaagttatgaaggataaaaattctggtgcctttgcaggcatcaagcagggcaatgcttataattaaaactgcattcgtacccactgtattctaccctaccagacactcacagttaaattaaagaaaaaaagtccatttctcttatgccagtgtacttaacaacgcagtaaaaattactgattttattaaatctcatcccttaagtacactttttttttaatggcctgtgtgacaaaacgggaaatatgtgttaactctttgctactgcatgtagtatggtaggagatagcactttctcatcatttttacttgaaagaaaaattaatgtatgcacttgtggttagaaagacttaaagactttttttttttgaaaaggtacaatgtgaattatcactgaaaggaaaacagctgacaatatttgttgtcaatgaaaaaattcaagcttttgagtgaaaactcaatttttggtgaacttttgcccaccataatgagcttaaaaatacttgaaggcttttctgacaaaaccaatggtgatgattaacaagtgtgattttatggtattatatgatgaaatgcatttacatttggaagatctgtgtaactcaataagccagtattttccaaataaccaatatgtgatgttacaaaaccacacatgggtaaaagatctattcaaaatggaagtgagaccaatggaatttaatgataaaaaaaattcattaacttgattttggattccatataacaactaacctctaagaaactaccatttatcaagttctggcgtagtatcaaagaagaatatctacaattccctgaaaaagctattaaaatactttctgcttttccacttacatatctgtatatggttagatattcttcatatactaaaaccaacaaaacataacagattgaaggtaaaaatagatataaaattcagctatcttctattaagccaaactcattaaatttgcaaaagtaaaacaatgccagtcttttcattaaactttttgttttggaaaatattttttttagtttaaatatttctgttaatatataataagcttatttcctaaattaagaaatatttttaaattttttcaaatttaattttcaatatggcaaatattgatataactcacataaagttctctgggtaacaagtttggggagttaggaaaaaaaagttctatccataattgttaacaatgtaaagggggtcctgaaaccaaaaagtttgagaatcattactctacattaaccttgtgagcaaatcctcttgactgggtgccctttaattgtcaagattctattttcagaatataactaggtaaaaagaacggggggagtaggtaaccagagttagcaatttaggaatccatagcaacttcgaacaccccaaaatgtttgattttgaacacatttatataaacatgtgcagctttggctgactaaaacttgattctttgaagtacgagtttgttttaaatggccgtttcatgataagtacattgtgtagagaacggcaaaatgtgagccatctgaataaacactccaggtacccaattttatttaacagttcaagttcaaaagagcagactaactttaaatgtctgttcctttcatgttacagttaacccttgaacaacacggttagaactgcacaggtccacttatatgcagatttgtttcagccaaatgcaggatgcggaacccacatacacagagggccaactttacatggtcccagcagggccagcttcagaacttgaatatgtgtggattttggcctgttcatgggatctgggaaccaagcccccacatataccaagggacaactgtataaacactgctagtatactctggtaactactggatactaaaggtaaacattacagacagcatctgggtaaagacccttctaaaagtttttcaattatttaggaaaacgcctgcccagaaacacccgtggacatcactgaatgatatccgatgtttcccagtggagatcacagaaaagactgggtcagacacttgacaaatagctagctctgactccagactagtcatgttagggatatcttaatgctttccaaaacaagcaaaaacgtttaccccactagataaatgatcaatttcagatgaatatcttattttaaaaaacacatttttttcacatgccttggcatgaatgcatgtgatatatccaaagtcaaggttccttacttactagttgaaatcgatgtccaaaacttagccattctttctccacaaggacttcaaatcctcggatggttcgatagtatccatccaacatgagcatggcaagggaagtgagctgagctgtgcgatcccaaccatcactgcaatgcactaccacagacgtcttccctgactctaccttgtcagcaatcctaagagcccctgcaagaataagct

SEQ ID NO: 12324 - DNA, 17792 bp, Homo sapiens
acgttgtaacagagctttattgcaattcatttcaaataaggttatgtttacagacttgtggtagacatgtgaattgttcattccaatataatgtgaattgcagtggtagtagcggtatacacagtgctatgggggcacagaggaaggtggggatgtcagagaaggcagtcgtgaatcagataacttcccaaaggaagagatgatgcctaaactctagaaaataggaattagtcacaagggagaacagttgttccaggtgcacaagacagactgaaccaaagtggggaggcaggaatctgcagattacatgaggcaattgtgaacagcagagtagcattggtacgtaaaagttgaggtatgcagagactaggtcgaaggaggctaaggagcttcaacttaatcatactggtctctaaattttgtaaccctaatcaaaaagggaaaaaattacacctgcacaaccaatagacatacgaagttatgaaacatgtaactgtcaattcaaatatttaaaattttgcctctctgtaaatatataaaaagggctagtattcctcctccctccctcccacacacaccagtggtatatattaatgcccaagtgcatgtactccatatggagacttctgcagaaggtgaggggaaccactggaaggttctcagcagagaagtggtagggttgcacttagatttccctggcttttgatttgaatttgaagtggatgcaagtatgttaagactagaagctttaaattcttgatctcttcagccattctacattcttttatgtggtatcaggccaagataaccaaggtttaaatgaggaaaatggcagatgcatttgtgaaatacttggagtagaaagcttaatttttaattactgatttgctagccacttaaatgccctgttaaaaagcttatatttcacacaattaccaaagaaatcattttggtaccaattttgctaaattggatatactaatagaaatttcctcactgcaagaccaagagggaggctaaggttcagactctctgtatagtgaattagtgagtggaaaaacactgtatattttaattgtttgatttgggtgttggttaaggaaaaatgggtacaaactgaacattttcatctggggtgcatattcctccaataatttccaaatatttctggggaaaaaaaagaaatggcaactttggacaagaacaagtttaaaagtcagttggaatttcttttaattaaaagaccaaggggacaagaagctcctttgttacagtacattacatatggctcttatgtagaataaaatagacatcagagtcaaatgtttctaccagcaccaaactcttacttgtagcaggtgaacagtgaagcaagatttcttttactggctttgagattgtaatacatcttttacatgcagtgtgttctttggtagacttaatcgttgagtgaaattacagaatttgcaaaggaaaaaaatgtaaaatttgagcacagtacttctcactataagctatttatacagaattcagaaaaaatgtcaatcctagtaagatttttaaatacttcttaaaaacttgctaattagcttctgtgtgttcagacacacaagacaagtgaaatacactgtagtaaataattagtttttaaaatatctttcatgatgtttctggtaattgggctaatctgaagggcatggaattctttgaactcctgtatggctactttctccccttcattttcccccaagcacatctataaggcctcccattttggatcaacttgctaatatgtcttaagtatgtaaataatgacggcaataattttcaactactaccacaccgtagtatcttcaatactttgccttttactatatgaagaatatggaagttgaaaagtgatcaaggtaaatcagttactgaaaaaaagaaaaacctagaatggagaaagggatatcaaatgattttgatctgtcatgacatcaaggcccaatatatgtgatgccacagaatttcagtgttggtttgaaaactgatgttcctctgcacagtgagcacagagtgtatttctaaaatggttttaatattaccagatgccaaaaatttgtaacagcatttgccttttaatagaaacttgttcccactgtgaatccaggattgaagtattttaatattctttggatacttaaaagattagtatcataatcatgtaattacatatggagttacttcacttaagccacctgcactgctacagttctaaactcatcctagagagatttaaaataaataaagtgactgaactttctctcatagatgggttctaaattccgaagactttctactcatagagctgccagtgtaatcaagagtgtatagcaatgatgcccctgatcttacagtcctttatacaacagtttggacaggagtgacacactgtgcaggagagctggctctctctgaggatgaggttgatcggttagaaatctctctctgtagttcctctacttttttctgaagctctgctcgtttagcaagaagttctttgtatctgttgtgaataggttcctgcaagagcaaaacataaaatattcaactaggcaatcctgaccaaagccaggtcaaatcattccctaaatgttgcagtgtatgttttttcagctgttggaaccaatggcacctttccaacccatcagtgaaattaaatacagggactgtggacaccactaatcttttcactggctttcccagtgcccctgagtatttccaaagaataacctgctgtgtaggtgctcctgaaactggtacttttccaaatacaacaaataattaacaagacaattaaaagacagtagtcagaagattccctgttatttataggtttttagtcttaaacagttctaagtagttaatattccataaacatattcacagtagaccagaattttgttcagcttttaactttcctaaagctactttcttcagcttattaaaacaagaccccctagaggttatccagacagaggagggaagatgcaagaaaagagagcagtgatttgtccaatgtcatacaagcagtcctaagaaccaggtatactgattaccctgccccagtgtagtatttttctactatacaattgttaactatcaatgggtaaggagtaaagttttaaatatgcacagataatctttccagctgcttttacggagacaaagttgcactgcatgaatgaaaactcccattgtatattgtaaggcacatacctgtggtttcatccgtggattccaccttatgtaatatcccacccagagctctaggtggcgcatgctggctactggataaaggacatgattggaatagctcccatagagaggattagtgaagtcttccagctggctgtttatgtaagaccacagtgacacagtccttttaggaagattctgtaggcaggaaaaataggtaaagattctccaccacataagccatttacactttagatgaaatttgtgaagaagtactttgttgtcattaaaatctctttagaggaagtggacttggagacttcagtgataaaccaacttatattaagatcagagggtactggaaaacagtatgcagttcctcaaagagataccatatgacccaacaattccactcttgtacatatccagcaaacagaagacatgtctgtacaaaaacttttttatagatgttcaaagcagcattattcattaacagccaagaagtgggaacaacctaaaagtccatcaactgacgaatggataagtaaaatatatccacacaatggaatattattcagccataaaaagaaatgatataaaatgtatgaaccttgaaagcatattaaaggaaaggagctagacacaaggtttacatattaaatgattccatttatatgaaatgtccagaagaggcaaatctagagacaaaaacattagtgtttggcaggggtgaatggggagtgactattaacaggttttctgaggtgatgaaatgttctgaaatgaaaatgtgatggctgtacaactcagatatactaaaaaccagtcaactatacactatcaaagtgaatttcatggtatgcatattattatcaatttaaaaagtttttttaaaaataatcaatgattcctaccccaaggctctcaaaaaataaaactcttcgaaacttagctatgctatttctaatgaacattccttaagttgttgagtgcctgctatgcatagaaatacttactgcatgctagacactgaagacataaggtgaatttaaaaatttaatacctgcctttaaggaagtctaggaaatactacatagcagttcttgtggtattttgtattgcttatttaataatcttcataattttacaaaagcagacattaacttccccaagcgaactgttacagtaagtgatagatccaggatttgaacccagcaactgggcttcagtgcaagtacttattcctactgtgctttataaaataaaacataaatactttgtaaccacattttttagaataaaagttgatgcagagggagataccaatcaagatgattaagatgttgatacataggatagacaagttttgataaagaagtaaaacttgaaatgtaatccttacaccatttcttcttaataccaaccccacttaacagtgatacctttggggaaaagggataacgaaaaactttaactttctacatactatcttttccgtatttgaatttttttatggtattactttacaacttaaaaaactcaaaaacttaacctaaaatgtctcaataagtaggatatacttgggaatttgagctgcctattcactcgaatatacattttctgctaattaaatttttctgcacctgctgtaaaggatttccattctacatagaaaaattggtacactggtgctccttagatttcacgtacttcagttctctttagcagaaaccacttcccactcatgaactcagcagacagctagctagcaccttcagccttgtgacaaagatacttcagaatatatcaggtccagatatatggaaggaagccctcaatattatagcatgtaagataaagtatgacccaaaagaatgacttcagttgaaatctgtcacagagtacattcttttagggaaaagtatacagtagagatagtatggggaaggtcatgtttcatattttacctcttcctctctgttgttcactattacagaggaatgttccgaataagcagctgtataggtggtccaaaatggtaatgagaaaatactcattgaattcaaatgcggtaggaaactgcaaatcaaacatcacaaacacataaattaagacattcttcaagcatattcatccctgtcatgggtagatccttttgaggtagtatttaaaatgaagttaaacattcaaatctacattattccaagccattatggcattattcgtatggttttcttttcaaaaatcatgttatcacttttctgatcatgatgtttctgtatctgctatatctgctaaccctaaatttgcaggctgaattttgacttaggcaattctggcaactctaggcattctctgcccaaaatgaccacaaacaacattaagattctttaaattttcaagaacatagttgtttttcttttttaaggattacacacaaaatgccaataatgtctcaagaaaatgtcagcaatacacaaaagtaaacatctaaggcagataatttacaagtcaaccaacctattaaatatttagatggtgcaaaagtaattgcggcttttgccattgaaatggcaattacttttgcaccgacgtaaacttttcagggaacatccatcccatcaaaccagagtcccttgtaagccactattttggcagcatctaacaaaaagaaaattcactctctaacccaagccaggggcttgactggatgtcttagttttacacaacacaattttaggggactaatcaaatgaaaaattacgaacccctgaaagttagaaggtttcgtttaatccatcctatctaatatttcagaattatttggaagcttctatgtaagattctaccaattatagggctgtacgtgataagaaattatataaatatttagattgcagactgtgaaaatacacattgcttccaagcttttacatcttagatcccttcctttatagtggaggaaaatagtataaacatcatgtaaatggaacatggatgaaaacaactttgccttaaagtttcctacattttagcaagtatagacagggtaacatgacagatttcctaaacaagaaagggcacttactaggccttgatttttgtggctgtgaagctgaatgaagcagatgatcaagcagaagatgaccaagcatttccacaacaaaaccaattgtaaaaaactttgtcaagtcccatttattcctttaaaaaataaatcccacctatttttcacactcttaacagccctattattagcgaaatatgaatgcatcctgaatcactaaatagcaatcccaaggatctaagcctgcgattagtttttcatcttcttggcaaaactgttagctcagttatgagaagacagtgtaatcagtaggcatttcctcacaaagaaagtaaaatagcagggcattaactgcagctattgcttttaaaaccctcagcagaagagaactattttgttttctttacatgtttaaaatctaaaaggcccttcaacaattgcttcctgatctcagggctgaggtgacagagatgaggatggaaataggaggagaggtatagaatctggctgtcataacatagttggttctgttttgacaaatgtgctattcaagtctctgtactagtattcaagtatttataaaactgataattgctaacaaacattatgactagttaatatgctttatattcaggaagaaaatatacagaaaaacactaggtgtataaaataaagatggctacaaagtattttaggttctatcaaaaatacagatttaaactgattttcttttatttagtgccaggctcaaaattaggattaaactacttttagatagacagcatatataaagttaacaaaattaaaattactaaggaagaaatgtattatgatgtattcttctcccatccaagtgctaacaaggcccgaccctgcttagcttccaaaatcagatgagatgggtgcattcagggtggttggctatagattatcgtgtactcttctttgcaagaaattggtaaatgtgctttttttctagcaaacatatcagaactgatacattcaaacacatcgtttccttcaaggtattcaccttggaaagcagtacacacaaccatcaacaataccacagtttcaaagagctttcctactcctttgatggcgaattttatttctaccaagagtcaaaggctatttaaaactgaatatggtaacagtcaaaagtggggtcctaatgttttgggtcaaacatccaaaaaaggattgtagggacttaggtagttgatatactgcctcaaagccaattccaaaggaaaaagtcaaacctaatccaagaaagtattaaacactgcacctctccttcctcttacctcccaacacaccaaaggtctgatttataaaccaaaactgaattgtatacaccttttcagtatatatgctaaaatactagtctcatcatatcatagtcatagctacaaaaatgcttcatttaacccaacagtttctaaataattcacccaagtagaaatgcttatggaggcaagggactgttaaatatataattgatgattatttcaccccattaccattaattttcttgtattgaaataaacagtattttattgaagctaaaaatatgctcctaaataaatatgatccaaagccaggcagagccagcacttgccctactttaaattcatatggcaatctaaataaaaacaattcagacttccagttgttttggggtctaataaacccttgggtaaataattatctcccaatgagctgcattcaacagggtttcgagatggtttgagtcagaattaaatcatatttttaagacaatgacccgttgcctcattaataaagtgatctcacaataaaccaggtgttttctcagtcccctctactctttccaaaagattaaattcatttatattaatatttcaaataaatttgttagaagttctaaaagccataatagctctctctatgccaaaaagtaaaaagaactggatgtagtatgtgcctcccttgttatgctttctatataaacatttttcccttaaaataaaaattttcagaagaagcagattgaaattcaaaaaaaaaattaacagttaaagttacttaaaatattttattttgcttgcggtacctagcttattttttctccactcttagcaatatataaatgtgtttttaggtgagcctatttaacactatttgttcaaaacaaatgataaaacctctcaggagttattatcaatgctactcactgaaatactaatagaatcaaattttcaagtgttaatctttaacctgattcataatgtgacaataaatagctctcacatggacatggagatgttacaagaatttccatttaatgatctataggctaatcagtgaccaaatctccccactctgacaggaaaactgaaaggagatgtgtaagaatacataggccagataaattacctgtcttgtcatctgccagacacagtcaataaattgaagaaaaacaggcgatctgtctgcatctgcatggttcttatctccatggccaactctctgaagcaaaaagagtgaaatatatgaacttagggggatttttcatgttttgatggaaataattttttaaaaaaataattggtcaatagtctaaaaattttcaaagtcgggtgctgtggtttacacctgtaatcccaacactttgggaggctgtggtggaaggatcacttggagccaggaattcgagatgggtctgggcaacatagcaagaccccatctctacaaaacatttttaaaagccaggcatggtggcgtgcacctgtagtcctagctttcaggaggctaaggtgggaggctggcttgcgcccaaaagtacaggactacagtgaactacggtcgcatcactgcactccagcctgcatgacagcaaggccctgtctcaaatacataaaaattttcagaaagtcttttaaagagcattgcaaagtaagtaaaaaatcacccattatcctgccaagcagaaacattttgatgtgcaaactgctcagatattttctgacacaagtgcttataatatgaattactactctgtttaataaactcagatcctaaaaggttgctaataaaagatggaagcagtcagaacctcagaggccagatttttgtcctggagattttaatttctctctgagaaataagttacatggacactggcctcagaaagcaccattctctgttcatatcttgaccactgagtgaagggtaccccctcctatcttagcactaatgtgtcttcatcaggaggaaccatattagcacacatcttagaaaacctgtcaaaaatgcttgacatccaccctccaagcatgcagtcatctacctagtttctcagttatttcctctgaggacctttgactcagataactgaaaacagaatcctgctccttaccccaaagcaggaattctaaaagtgtggtccacaaacatccaagggctgtgaggtcaaaactatttccataatattaagacattatttacctttttcagtgtgttggcatttgcactaatgatgcagaagttatgaaggataaaaattctggtgcctttgcaggcatcaagcagggcaatgcttataattaaaactgcattcgtacccactgtattctaccctaccagacactcacagttaaattaaagaaaaaaagtccatttctcttatgccagtgtacttaacaacgcagtaaaaattactgattttattaaatctcatcccttaagtacactttttttttaatggcctgtgtgaccaaacgggaaatatgtgttaactctttgctactgcatgtagtatggtaggagatagcactttctcatcatttttacttgaaagaaaaattaatgtatgcattgtggttagaaagacttaaagactttttttttttgaaaaggtacaatgtgaattatcactgaaaggaaaacagctgacaatatttgttgtcaatgaaaaaattcaagcttttgagtgaaaactcaatttttggtgaacttttgcccaccataatgagcttaaaaatacttgaaggcttttctgacaaaaccaatggtgatgattaacaagtgtgattttatggtattatatgatgaaatgcatttacatttggaagatctgtgtaactcaataagccagtattttccaaataaccaatatgtgatgttacaaaaccacacatgggtaaaagatctattcaaaatggaagtgagaccaatggaatttaatgataaaaaaaattcattaacttgattttggattccatataacaactaacctctaagaaactaccatttatcaagttctggcgtagtatcaaagaagaatatctacaattccctgaaaaagctattaaaatactttctgcttttccacttacatatctgtatatggttagatattcttcatatactaaaaccaacaaaacataacagattgaaggtaaaaatagatataaaattcagctatcttctattaagccaaactcattaaatttgcaaaagtaaaacaatgccagtcttttcattaaactttttgttttggaaaatattttttttagtttaaatatttctgttaatatataataagcttatttcctaaattaagaaatatttttaaattttttcaaatttaattttcaatatggcaaatattgatataactcacataaagttctctgggtaacaagtttggggagttaggaaaaaaaagttctatccataattgttaacaatgtaaagggggtcctgaaaccaaaaagtttgagaatcattactctacattaaccttgtgagcaaatcctcttgactgggtgccctttaattgtcaagattctattttcagaatataactaggtaaaaagaacggggggagtaggtaaccagagttagcaatttaggaatccatagcaacttcgaacaccccaaaatgtttgattttgaacacatttatataaacatgtgcagctttggctgactaaaacttgattctttgaagtacgagtttgttttaaatggccgtttcatgataagtacattgtgtagagaacggcaaaatgtgagccatctgaataaacactccaggtacccaattttatttaacagttcaagttcaaaagagcagactaactttaaatgtctgttcctttcatgttacagttaacccttgaacaacacggttagaactgcacaggtccacttatatgcagatttgtttcagccaaatgcaggatgcggaacccacatacacagagggccaactttacatggtcccagcagggccagcttcagaacttgaatatgtgtggattttggcctgttcatgggatctgggaaccaagcccccacatataccaagggacaactgtataaacactgctagtatactctggtaactactggatactaaaggtaaacattacagacagcatctgggtaaagacccttctaaaagtttttcaattatttaggaaaacgcctgcccagaaacacccgtggacatcactgaatgatatccgatgtttcccagtggagatcacagaaaagactgggtcagacacttgacaaacagctagctctgactccagactagtcatgttagggatatcttaatgctttccaaaacaagcaaaaacgtttaccccactagataaatgatcaatttcagatgaatatcttattttaaaaaacacatttttttcacatgccttggcatgaatgcatgtgatatatccaaagtcaaggttccttacttactagttgaaatcgatgtccaaaacttagccattctttctccacaaggacttcaaatcctcggatggttcgatagtatccatccaacatgagcatggcaagggaagtgagctgagctgtgcgatcccaaccatcactgcaatgcactaccacagacgtcttccctgactctaccttgtcagcaatcctaagagcccctgcaagaataagctggaaaacagattttttaatacattgtttttaaacaaggtaaatacttccttcttcaaaatttactaatacagcttatcagggatcattatttcaataacatgaggaaaaacatttgtcccttcctaagaagaattttttttaatggtagaagatatataaattttgcttttaaaactagaaaaacctcataattgctgactcctattaatttgcccaacgaaatagccaaatcaaaagtacctttgggtgctacataaatcatggtgtaagattcttcttagaaaagttctaaagagatctgtttctaagaatcaaatattccatcatctatttaaataaaaataattgatatagcaattgaagcctttttatgatttaaaacaatgcttaaaccaaattgggataagtacctgaaagcaataatactggatctctttaaaatactctatagcatttattgtattgttttgactaaagatttttatgtcacagagcatacagcaagcacagtataaactttagagtgagctacttttctgtaacactatgcatgaaaattcacagaatatgtcaatctgttacttaaaataacttcagctcttatttttttaaatatgcagaaatcctttgcaaaataacttaccttttctgaagtcaatcttgagttaaaactaaacataattagatataaccaaaaaagaaacacaaaagtatggtatcttaaaaaaaaaaaaaaaaaaaaaggacaatacagccctattcttctctgcaatggccatattgtattatacttgaaaaacagtatagttctacatacgcagatgagaatgaaagaaaacagattattaagcttggaagtatgataacctccccttgatcacagctataagcatattctggaaatggggtactatgacgatcttgactatatatcaagagtcatttgtaagcctgaagtgcctagacctcattgtccaatgatcctaattcagtatcttaaataaattccacctataattctagtgcatatacgaagttaagaatcactaacccaaaggcttagttaagattgatcaggaagagttatccaaagtagtaattgttcattcattcattaaataaacatttatggagtcccttactagaaggtagatactgctctaggcacgggccatacagcagggaacaaagttcctgcttactgaagtttacattctatttgggtgaggcccaccagtcacaaataaacaaggaaatatacagtataccagatggcaataagtgaaaacgctccatagaagttatagggaatgctggtagaactcttattttgtaaagaggctgggaaaggtctctctcagaaaggtgatatttgagcagagaccagaagagagtgattgagtaaataaactttctttgtgtgataaggattgggggagaataaagtagtttagcccaactatatgtcttataactctagggaaatttgattctgttatagccagccttttagagaccatgttgaaactgcaaattaaatatctggagttttcagaatcaaacacagcgatttatgttagttccaaatcaagcctaaggctgtatatttacacgtcacataatttaatgaatgggccacatgaacatgctctctgagtagtgtttatactttgtgattttcaagcttctaagcttctcaaagggaaacaatagtaaaaatggtctatttaaaattcttattcagtttggttttctcttcaattctgtctgaacttcagagattttaatgtgagcagaagtatcctccttcttaacgtgaaagactgcatttcccattacctcttaatatttatatatgtggttacataagtctacattttggtgagttatgttactgacagaccatatctgaaaatataactagattaaattagcatgttaggtaaattagcactgacatgtgctctgcgaatgacttagcactcagtgtggctcatgcaaccactccacctcatttccctgatcagaatggttttaacttcacaaatcaactaatatttattgggtacctattcacacggatagtgctgccctagctcctgagaggacaaaaaaatatatgtaggatttatccagtcttggtctccataaattagcaatatacgttggttgacacacaaaagcaaacaaagtacacgctagttcctgattagatggaaagacagggtaaagagttcagagaaaatggaaaaggatgcaatctgggaagaccttatggaagaaatgaaatatgaactggaatctgaaggatggttcgaattcagataggatgggagggggaacaaaagaaatacaacataaccaaatgcacaatataaaaaaccaattcattcaaacattaaaattcactagtagttccaagtatcaaagcatttacccatttttcattgtttagaaaggtaccttcatgttgattgcaattataagtaaaaagctaatataaacaaaggggtagagagagtctttgtttgggatatagtaacacacacccaccttaatatgttctagccaatgagtagattccaagttagacaaccagtgagtttcctcaatgttggggtacacaatctccttaagttttcgtaatgattctctcataacatgaatattgtggatatccaggaaaactagttcagcattttgataggcatcttcactttcataacctccaccctttgcctggaaaaaagcacacatcatggaaaatcataaatgaatgcacatctgtaaacaagtgacataaaatatccaatagcataaaagatgatacatattactggagacaaggaaaactccacaggaaaatgtggatggctcaggacaacttatttagcacaaccactcgctttcttgtgttcttctttacaaaatgaatatatacgtagtctgacttgcccatatggccattattaaaattaaatatgaaacacataggaaggtatttaaacactgtaaagcactaaattttcccagcccatacgccaagtcctacccaaacataagttcttacagatgacttcctttcatatatactgaaattaccagactgtaagtttcatgtgctgagaccacatgtctggttcacctatgcttcttcacctccctgcctcttcacctcattttaatcttcatatctgagaaataaactctttgcaatcaaaatgacctgcttcttttttaaccacataattctctttaaataaaaagacagaacaaggataaaagcacagaatgctatcatcatcaatgttctcaaagacttaaatctacatctacaaaatagaatgagaaaatatttggtgttcaaaataagctatggctagaaagaagaaccttatttttctggacttaatctttttatatttcatgaataaaatattctatctcctacctaactcgtgtaaaattatacttcttagagccctaatagaaacaaattaggaaaatactggagcagtaaattatacaaaattaagtgatcatatgacccacacctttgaaacaacaaaaccaccaactcataaccagcaacaaactactgaaagaacagaagttcagcttcctttctgacactgagagtctgggaaatcgtttggcacaattatagaatttacagtatttcaagggatacctgttaaagattacttctgaagagtgggaataagacaggaactttcaattcaaatttgttgcaacattctagaaagacagcagtggtaacaactatacagaacctgtcaccgaaacacatagaataaaaatgccctggattcaggtagtggcatggttgtacaactttgtgaatatactaaaagcactgaaatgtacacttgaaaagatgagcgcttttcagtaatggtacctgctgctgtagttatgtcttctctctccttccctcctcctatagatttggtcaactgaaccaaaatttcaatttccacaatgctaatatttattctgctggaacaatcagctacagctaactgccaattcttcagtctgaataacttgttcaggtggaggacggtcagaagagggcaccactagtcaccgagaacactacttcgctattcctagagcagtactatacagggacttcagtgagtcataagctcagttagttgtcaactttggagaagtgggaagctaagaataactgaacacctagttattatgtaagtaagcaaaagtttatgcattattttttattaaatgatttttgctcccaaaacaacactgttaactattattattctcatttttaccaataaacaaattgaggtctaaagaggttaaataactaactcaaaatcacaccatcaagttgaagagccaagacaagaacctatatgtttaccactgtagagcctgagctctttttactacactgtggccctgccaaactcagctgattcatgaaaccataattataattactaagagaccatctgaccttgttggcaacagcattaacacttggccgggcatcaaatataaagattttgtgagactgggcattggaatccatgatagcttgaaggtatttttcatcttctttgcttcgctttccactcactccaaccatgggctggctacaccgagtgattgtggcttgactttcaggatgaatccatgataaaaccttaatgaggaaaaaatggtaacacaccttttacatacttctctgtttataattctccaaaacagtactcagtaaagctctgctttctaattggatcccaagcctggccatgaaaggacatctgaggctgctaagaaaaatcatcacctttccttcaagcccattctgggatgtggaaaacttggtctaattctttagtcagatactgattaggaaagtatttgattattgggaaatgttatctcctgaaaaaaatactgtgaaacagggctaagtaaaccccacttaatatattagtaaaactgctcagttctaaaagcctttagaatctatgaattttgtacctaaaattatttaagctcatctttctaagatccagttataaatctgtaaggtgttctttctaggacttaaaaaaaaaaagaacatttatcatcatgactaaagaatatacaataagataaataaatagtgactaatacacacagcaaactttttcagtgaagaatcatgcaattctgtgcagttatctaatacccatatcacactctctggaagcctctttaagtctttcttccagttttaactttactaaataaatcaatctccaatatccccatgaaagacctgctgctgtagctatttatatcctgaatccattctcctactcattaatctcagcattatgttgagtaaaaaagcacttgcaaaggctcatccaaacttcctacttactgggatacggcctcttgatctgaaggatgccactctctttaattcttcatcaggaatatttgctggcacaaccaggag

SEQ ID NO: 12325 - DNA, 611 bp, Homo sapiens
ttcaaatctctctgagttctgttgttacatttctctaaccacagcgggagaaaattttctggttatgttatcagattgggcccactcagataatgaaaagatggttttgatattgaatttgttaatcgtcttttagatgtttcttcatctgtatcttttaaaatacacctacctcatactttgtgtgaagtttaaatgaaatatctttgctttatttgggatgctgtggcatttcctttttttgaaagttgtgtttaatcactaatattgcaacaattctatgtgttaatgattctctaggtaaaagaaatatttttgacatcgtaggctaaacaggcatttgtaaattagttgaggaacattttttgtttcagttgggatatatattgtaagtatcctaaaaatctcagaatgaacctgttttgtaaactggactgattgtacagtaaaataccaagtaggtaatgatatccaaataccagcttaaatcctaacctataatgggtgctgaaaagtgtttactgaaataaaagtaactaaatagtgtgatgtcttttaagaattttagtactctataatcactaacctagaagcctctttattataagata

SEQ ID NO: 12326 - DNA, 473 bp, Homo sapiens
cagctgctaactgtgtgaccttgggaacctaacctctttgtgcctcagtttcctaatctgtaaaattaggctgataacagaatcatagtcttgtaataagggttaaagatataatctatgtacagtgcctagtccaatttctagcacacagaaggtactgcataaatgttagctattattacgtttctgaaagctcacttgggtacacataacatggggcaagaccagagggtggagaccagttagatcgtcactgaggtcccttccagaccagtaaatttctgaataaagctttgaaaactagttgctcacttttaagtagctcacttcctgtcttgtttacattaagagacagcagaataatttttccagataatgcaaatgtgtccagaattagttctaatttgaattaataagattttattatacttttaaatacaaatctctcaatattccccatgaaaatataaaaa

SEQ ID NO: 12327 - DNA, 517 bp, Homo sapiens
ccaacacttgtgggaccccaggacggtgcagggagcaaggttgaggctgcagcagaggctctgggtctgggaatgggtcctgcctggccatgcaagggtggaggtggtgcagttgatggccttggggactgccacttttgctcccacagctgctcctgccattaccactcatgcctctctactgcagctggtgtgatggcagcagctgctctgggtgggtatatacccagaaggatataaatcattctaccataaagactcatgtacatgaattttcattgcagtactattcacaatatcaaagacatggaatcaacctaaatgcccatcagtgacagattggataaagaaaacatggtacatagacactgtggaatactatgcagccataaaaaagaatgagatcacatcttttgcaggaacacggttggagctggaggctgttatccttagcaaactaatgcaggaatagaaaaccaaatactgcatgttctcacttataagtgggaactacatg

SEQ ID NO: 12328 - DNA, 21371 bp, Homo sapiens
  misc_feature (6392)..(6392): n equals a,t,g, or c
gtagtcggatagttggcgggtggttgagtagaagcggtcgccatgtccgcggggagcgcgacacatcctggagctggcgggtacggcttcaggggcgagggcatcggagcgagcactggggcgcaggagaggcggagggaccctgagaagctgcgtatagggtggaagggtccttaagtgggaagtaaagggctggacgtttggggagaaggatcttgagcaggcctggggcccttaaagggccggcggggatccgagggaggaggcaaacggggacttttggaagggcgagccaaggggaaggcgtaaactagagcgtgtaggatagagtggagtctttcgatataggtgacagtagaaacgaaagattttggggaagggttgaaagtgggggtttgttaaataagcaataattgtttaaggagaggggagttttagatttggaaggtgattcggaggtgtaaatggaatataatagagggaaaatggggtgctaaggcgtagtaaggaaagaataacatacacgaaagctttggggcctaatgttttcctttttctccatgtaggcgccgcagcaaatgggaccaaccagctccagccccacttctcttcctcccgccagcggccccaggtggggaggtcaccagcagtgggggaagtcctgggggcaccacagctgctccttcaggagccttggatgctgctgctgctgtggctgccaagattaatgccatgctcatggcaaaagggaagctgaaaccaactcagaatgcttctgagaaggtatttgaagttgaagggtctccactaattgcgaatttaatagttgttttgccgggcgcggtggcttacgcctgtaatcccagcactttgggaggccgaggcgggtggatcacaaggtcaggagtttgagaccagcctgaccaacatggtgaaaccccgtctctactgaaaatacaaaaatagtcgggcatggtggcacgcgcctgtaatcagctactcaggaggctgaggcagaactgcttgaacccgggaggcggaggttgcagtgagccgagattgtgccagtgcactctagcctgggcgacccaatgagactccgtctcaaaaaaaaaaaaaaaaagttgtttgtaatcctgtaatcgcataataatttgtgttagtaaaggataaatggatatagtagttgagagatcatttagttttggaatgttccagaacacattttgttacaaatacatatttacgaggcgtttttgattgggctgattacatttatggaccaaataccttgtcttgtccttgttcacttagttcagcttaagctgtatttccatagtcatttaaagcaacataacatgtttttaatatatgtgctttttccctgaagtcagaggagttcaggtaaatcaagtgagccccatagtgtcatctctaattagaacctgtagggttttatttatttatttatttattttgatagagtctcactctgtcaccagcctgaagtgcagtagtggggtgatctcggctcactacaacctctgtctcctgggttcaagtgattctgattctgctgcctcagcctcccgagtagctgggattacaggtgcatgccaccatgcccggctaatttttttttgtgtttttagtagacagggtttcaccatgttgaccaagctcatctctgcctcccaaagtgctgggattacaagtatgagccaccaggcgcagcctattgtttgcaaagattgtgtgagtcagtcatccatttataaggtttatgaggaaaaattaaaagcatcttgacaaagatgtagtgctccttgtatattaagatttttaatactgatgttaatcgtttaagctctttttttttcttaaaataataatctttaggtagttgacctcagcaggatacataaacactggatttagaatcataaaacctaaaaacccagaatccacagtttgaaacccagaatccacagttactggttacatggctttggcataatgaaactcagctttctcgttggtaatatatacctgcattgtgtagtgcagtagtcactagcttcatgtggcaatttaaattaaaattaaggggctgggtgtggtgactcacacctgtagtcccagctcctctgtaattcttcttggattcttggaaggctgaggtggaaagatcacctgagcctaggagcttgaggttgcattgagctgtcattttgccattgcactccagcctgagcagcagagtgacaccttgtctaaataatacaaataattaaatactctcaggctccatatctgtgagaaataaattcctgttgtttaagcaaaaagcaaagcaaaaccaaaatacaatttaaaatttagacctttagtcacattagccacctgccaagtgctcaagagacacatgtggctaatggctaccatattcgactgatagactagaacccttgtcaccaaaagttctcttggacaacattgataagtactattaaaggcggccataaggattcattgagatgataatgtaaatgaatactataaggggttaaataaaggtaaggtgatattgctgagtttgtatttagttttgcctccacatttaaaaaatgtatttaatgcacaaagtaaacaacagtatgttaccttcttgagcagattttctagacataggttggggagataggcccctgtagtcccagctactcaggaggttaaagcgggtgggtggatcacttgaggccaggagttcaagaacagcctgggcaacatggtgaaaccctgtctctacagaaaatacaaaaacaattagctaggtgtggtgcatgcctgtggttccagggtctggcttgattgcccaggcagtgactgtgcagtggcacagtctcttcctcccaggctcagcctcccaagtagctgcgactacagacgcatgccaccatgcccggctaattttttttattttttgaagagatgggtttgccatgttgcccaccctgcttcagcctcccaaagtgctgggattacaggcatgagcctgtttggttccttcgttcattctttctttctttctttctgtctttctgtcttttttttttttttttttggtgatagagtcttgctttgttgcccaggctggagttcagtggcacaatcactgctttctgctgcctcagcctgctgagtagctgagactacagtctcatgccaccgtgcccagctaatgttttgtatttttttagagatgtggttttgccatgttacccaggctggtctgaaactcttgggctcaagcgatccaccctcctcagcctcctaaagtgctaggattacagatgtgagccaccggtcccagcctttttttgtaatttatatatttatttttgagacagagttttgctcttgttgcccaggctggagtgcgatggcgtgatctcggctcattgcaacctctgcctcccggcttcaagcaattctgcctgagcctccggagtagctgggattacaggcacgaaccaccacacctggctaattttgtatgtttactagagacggggtttcaccatgttgaccaggctgatcacaaactccatgtagtttaaattgaaagaaaccggatcaggttttaccatcttactgttttttcattcttctttgttctgctgtaatagagtgaggaattattagttagatacaatttaagggtttttgagagctttacaaggatggagttagttggattttatgttaggattataggagtggcacaaagacaacttcctattgtatgcatgaggtatatgtattgtaggcattgctcctctaccttctattgtgttttactccatgtacagccaactaactgagctatagagtatcataacttggccctttaattttctttttgaaggttgtagcttctagtccctagagcttctgtaattaggtggtcataaaaatgcacatagggccaaggtcacagagaaatcttgattgtggccttcaagcagattgactttattattgactttatttaatgtcattttagtgagatttttgtttgcttgttaattcgtttatgaagaatgaccaactgtgtttacaggcagatgaagggaagggtagggaggtgtgggacttgggaaaggatagttgtacattggatgactaaaaggctttatctcagctgggcacagtggctcacgcctgtaatcccagcactttgggaggccgaggtaggtggatcacctgaggtcaggagttcgagaccagcctggccaacacggtgaaaccccgtctctactaaaaatccgaaaattagctgggcatggtgctgcacacctgtaatcccagctactcaggaggctgaggcaggagaattgcttgaacccaggaggcggaagttgcagtgagctgagatcacgccactgcactccatcctgggcgacagactccatctcaaaaaaatgaaaaaataaataagtaaataaataaaataaaaaaatagactttatctcatcataaaaactttttaatctaatttctcttttttctagcttcaggctcctggcaaaggcctaactagcaataaaagcaaggatgacctggtggtagctgaagtagaaattaatgatgtgcctctcacatgtaggaacttgctgactcgaggacagactcaagacgaggtgaggaggcattgagactctttggggagggcggtgagtggattcagataaagaagacctctaaatagacaggcgtcagatatttattagtgggtttgggtcatagtctctaaagtcaggattgggtttaatttaacttcagaggaagataatggaatggatataaatgaattctctgggttggtttgagtaagaaaccatggaatcaaaatttcagatacaggagagaattctttccttctttacttggttgaatgaatgaatgggaagaaaatctgtctgccattgaaatcaaccaattgccacatttttttaattgaacatttccttttttagatcagccgacttagtggggctgcagtatcaactcgagggaggttcatgacaactgaggaaaaagccaaagtgggaccagggtgcgtattctcttatcttgtttatggaagggttgggtgtatgactcacgttagcctcatgttttttatccttaggtaatacgtgtacacaatatttgattcaaggtttgaggggtatgtgtgtgcacactatagcagaattctggatatcaaacagatacaagatgttgggacctgtttttggacttttatttcacatttaatgtttttattggaggaaacaaattataggaaagtgtaaaagaagatactaaccactaacatttaatgtatatactcttttttcttctttctgttccatatgatctgcagaaataatgtatatactttttttttttttttttgagatggagtcttgctctgtcgcccaggctatagtgcagtggcgtgatctcggctcacttcaaactctgcctcctgggttcatgccattctcctacctcagcctcccgagtagctgggactacaggcacctgccaccacgcctggctaattttttgtatttttagtagagacagagcttcaccgtgttagccaggatggtcttgatctcctgaccttgtgatccacccccctcggcctcccaaagtgctgggattacaggcgtgagccaccacgcccggcattgtatatacttcttaacttttttctgtggaaatagttcccctcacaaatgggctctttttttttttttttttttttgtctttatgatggttatagtttgtgattattcaggtaaagacttaatctgtttcattttattccttccatcattccgtgtttgagtttctcttcactgtcagttgataggtacttagggaatgcaacatttttaacattagcttaaactacacaaaataaggtggcaaaatttaattcctaccccaagccaagaatttatttatttatttatttattagagaaggagtttttgctcttgttgcccaggctggagtgcaatggcgccatctcggctcactgcaacctctgcctcctgggttcaagcaattctctggcctcaccctcccgagtagctgggattacaagcatgcgccaccacacccggctaaattttgtatttttagtagagatggggtttcacgatgttggacaggctggtctcaaaagtcctgacctcgggtggttcccctgcctcggcctcccaaagtgctgggattacaggcatgagccaccgtgcccagccccaagaatgtatttaaactttctatatgtgttgattgctgatttgaactttgtctataaaaagtattnttacctgctactttttattaactatatatggttattgatcactttattataatttaagtcctcttcacatttagaatctaaattatcagttgatgtagaccttaagaggtttctctatatgcatgatcaatctttccccattaattttgtgtgtgtgtgtgtgtgtgtgtgtgtgtgtgtgtgtgtgtggttttttttttttttttttttttttttttggagacagagtcttgttctgttgccccggctggtgtgcaatggcatgatcttgggtcattgcaacctccacctcctgggttcaagtgattcttgtgcctcagcctcctgagtagctgggactacaggcgtgccaccatgcccggctaatttttgtaatttcagtagagatggggttttgccatgttggccaggctggtctcaaactcttggcctcatgtcatccacccacctcagcctcccaaagtgctgggattacagacatgagccacagcacccagcttgccccattgatttggatagacgagaccacatttgtttataacctattagacaaccagcaaaaaggaattctgttcttaaatattgggttatctcaatagactggaaaataatggtagtgaatccataagaacagatttgatctgaactctgtgggccagttgacttttaaaatcaagaagtttatttgttccccagctgttaaagcatgttctgagacattagctagcaaaaacccttctaatgtatatagtcccttttggttatttggaaacttgaaacattacaaattagatctggtgacccatttgactccttttttggttttgaccacattgagatcatccttttttgtttctctttatagggatcgtccattatatcttcatgttcagggccagacacgggaattagtggacagtaagtaatgtttttggctcacgtagcactttttgtgaagagcaaagtacagggctctgtatagcaagttggcaaagtgtccctgatggctgttctaacccttgttcatgaactatacacgaatttgtatgggagtttagagggatggagagccacatatttgggtaacgtataaagcagatttacggtgaataattgaacactggcctgcctgggcactagtcagttcattccattcagttttactgtctgtgtttttctaaggagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcaggggtatgttttggggagggatcgttaatagcattatcatttctataaaaatgatatgtgctggccaggcacagtggctcattcctgtaatcccagcactttgggaggccaaggtgggtggatcatttgaggtcaggaatttggaccagcctgaccaacgtggtgaaaccccgtcacgaacattacccgggcatggtggcaggcacctgtaaccccagctacttgggaggctgaggcaggagaattgcttgaagccgggaggtggaggttgcagggagctgagaccatgccactgcactccagcctgggccacagagcaagactccatctcaaaaaaaaaaaaaaaaaaaaaagtgccaagtaatacatacaaagaaaaaaaaatcgtgaaattccaaattccaatcccgaaagttacctgccataggtattctgtttgtgtgttatccagctctccacggtataatgaacacctgatcacacatttcttcatattgatatattctagaaaggagattgatagagcagaaggtatacatgttgtacattttgaagttagtggttttaatttgtatttgtaaacttgatgacaactggaggactaagaaggctgagtctgatgaagtaagactttgctgatacattcctcctagaaaaaagggttggagagagcagccttcactgaagagtatcacagggctgactgtactacccaacactctaccccagttttacaggagactgtctttgctataatttcttattgacttatttcaaagattgaggatttaattatatattctgtttaatctgaagtattctgttcttcctacagatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcaggtatggatggatagggcaggggacatgtgaattcttgtcaacttgttggtacagtcaggagtgattcagaaggagcaagagaaaactgggtgtaattaatagtaatgagggatttagataaatgctaggagtaattactttataattagttaaagaaattgtagaattggggcacggtggctcatgcctgtaatcccaacacttctggaggccaaggcgtaggaccacttgagcccaggagtttgaggccagcctgggcaacatagcaaaaccccatctctccaaaaaaattttaaaaattaggcgggcacggtggctcacacctgtaatcccagcactttgggaggccgaggcgggtggatcacgaggtcaggagatcgagaccatcctggctaacaaggtgaaaccccgtctctactaaaaataaaacaaaaaaaattagccgggtgtggtggcaggcgcctgtagtcccagctactcaggaggctgaggcaggagaatggcgtgaacccgggaggtggagcttgcagtgagctgagattgcgccactgcactccagcctgggtgacagagcgagactccatctcaaaaaaaaaaaaaaattagccaggtgttatggtgtacaccttaatcccagctgctcagtaggctgaggcaggaggatggcttgagcccaggagattaaggctgcaggtagctgtgtttgcaccactgcactccagactgggtgactgagtgagaccctgtcttaaaaaaaaaaccaggtgcggtggctcacacctgtaatcccagcactttgggaggccgaggcaggcggatcacttgaggtcaggagttcgagactaccctggccaacatggtgaaaccctgactctcctaaaagtataaaaattagccaggtgtggtggcaggcacctataatcccagctattcagcaggctgaggtaggagaattgcttgaaccctggaggcggaggttgcagtgagctgagactgctccattgcactccagcctgggcaacagagcaagactccatctcaaaaaaaaaaaaaaaaagagaaattattgaattaggagacggaattatctctttagtattcaagtcctttggttttgtacaagtctgtacaaaagtgaatcttggcctgtaatcccagcactttcagggccgaggcggatgaatcaggtcaggagattgagaccatcctggctaatacagtgaaatcccgtttctactaaaaataaaacaaaaaaattagccaggcatggtggcaggcgcctgtagtgccagcaactcgggggctgaggcaggagaatgacgtgaacccaggaggtggagcttgcagtgagctgagatcgcgccactgcactccagcctgggcaacagagcaagattctgtcgcctcctgcctcagcgtcccaagtagctgggactataggcacccgccaacatgcccggctaattttttgtatttttagtagagatggggtttcaccgtgttagccaggatggtctcgatctcctgacctcgtgatccgcctgtctcggtctcccaaagtgctgggattacaggcgtgaaccaccacgcccggccaaaaaaaagcaaatcttaaagtgagctgtgataagtctgaaataattttcatttaaacctatgtcaatattaatacgttttatagtaattttatgaactttaaacatttttatatcgagaagtaccattactcagagaaagactaataaaatatttgtggtaatgatagtggttatatcttaaaagacttatgttttgtgtttctgttttgtgattttcagaggcctagatttgagctacagtgaatgtattaatgtagatatgtaaaatagcatggaaaatgaaagcagaattctgcatcttttatttatttttctctcctttgaattcctggttatttctttgcagtcaccccaaaccagaaggcctggctgctgccaagaagctttgtgagaatcttttgcaaacagtgagttgtatttgtctgatactcattcagaagagcaattgccattttggagtatgtcttagctgtttctttcacctgtttagtttcctagtactgctataacaagttatggcagttgggtggcttaaaataacacaaatttattctatcacagtccaggaagcagagtctgaaatcaaggtgctggcagaattggttccttctggagtctttgagagagaaatcatcccatgcctttcctctctcctagcacctggtcattgtgttggttttctttggcttgtattagcataactccagtctgaagtaagggtagaactataataatttaaaaccagttagacatgtttgggggatgattgctcatttgattatgcattctttttattctataaacaaccaaaagttaaaccttaggactgtcttttttttttttttctgtcgcccaggctggagtgcagtggcgggatctcggctcactgcaagctccgcctcccgggttcacgccattctcctgcctcagcctcccaagtagctgggactacaggcgcccgccactacgcccggctacttttttgtatttttagtagagacggggtttcaccgttttagccgggatggtctcgatctcctgacctcgtgatccgcctgcctcggcctcccaaagtgctgggattacaggcgtgagccaccgcgcccggccaggactgtctttatagcacttagaggaaatcaggttttgcactgaatatgttcaaccttgtgttctctggtgccttattgggtagctcatggttggtttttttgtttgtttttttacttttgtacatagcacctgatttaccaacccttgtaccggataattttcttgactatttcccatctttgttggtacttgaggttatggacttaataatatataggaaggaagtatgaggaaaatacgaaacccttactaaatgtgagctccttgaggaaaagtcacccagtaaatgtgaatgaattgaggtctcaccagttatactaacaacttggaaatttcctagttacttaatttctgtggctttctaaatgattctgtaccccagaattgagtatggtttaggggattcaggattattctcctaattcccaaaattggcttaataatttatagatttgccttattaaaatgttgaggtgggttggacacggtggctcatgcctgtaatcccagccctttgggaggccaaggcgggcagataatgaggtcaggagttcgagaccagcctggccaacatcgtgaaacccccgtctctactaaaaatacaaaaactagctgggtgcggtggcacgcgcctgtagtcccagctacttgggaggctgaagcaggagaatcgcttaaaccgtgaaggtggaggttgcagtgagctgagaccatgccattgcattgtaccctgggtgacagagtgagactgtctcaaaaaaaaaaaaaaaaaaaagatttgcagtgatacaagatcgcgccactgcactccagcctgggtgacagagcaagactgtctcaaaaaaaaaaaaaaatgtgggttaaacaagtttaaatttgattggaacattggtagatatattttaattcctaatggctttggtcctagaattatgtaatcagacccttgtaaatgcacagcttcggctgtcccatgttaatttgtttccccctctctttcaggttcatgctgaatactctagatttgtgaatcagattaatactgctgtacctttaccaggtgtgtacatcttgaagtgtttaaaaaatattttgctagtgatagttatgtgtaactatgatacttgaggctagactgtgccagggcactattaatgttccctttaatttagggtaatttggaaagccattcatgcctcagtatttttcttccctagatattaagtttaatattcagctaaattgtctcattctgctgcagctgattaaacactttttttcttccccctcaggctatacacaaccctctgctataagtagtgtccctcctcaaccaccatattatccatccaatggctatcagtctggttaccctgttgttccccctcctcagcagccagttcaacctccctacggagtaccaagcatagtgccaccagctgtttcattagcacctggagtcttgccggcattacctactggagtcccacctgtgccaacacaatacccgataacacaagtgcagcctccagctagcactggacaggtaggatgtcaggatatgcaacaacatattactgaatttaggaaaaactggggaaagaggggaagtagtggtattccagaaataaatcatgtgatgtggaatgtctttttcctgctgtcttctgtgttcctaccaccaacctacctgaatattttggattagtgtgtatgtgtgtatgtcatcctgaagtttatattttcacaagtcttgcacaccaaatagctgtttaaagtggggatggtgggcacacttgctataaagggtcagatggcaaatattttaggctttaagggccatacattctctgtcacaactatcacactcggtggttgtagtgcagaagcagcccgtggataatacctcaatgaataagcatagctgttgtactccagtagaactttatttacaaaacaggtggcaggccacagtcatagtttgccatacccttggccattgtttgcctaaccttacctttgcagtgttaacaaagtcctcaaggagaatggggctaccttcaccacacctctcagtaattggaactgagttagcatttcaaatcttagaaggaaacataatctcagcatctggggaggccgaggcaggattgctttagcacagtttgagaccagcctaggcaacatagtgagactccatctctacaaaaaaaattaactggacatggtggcacatacctgtatttcagctacttaagaggctgagatggaagggtcccttgagcctaggaggtcatggatgcagtgaaccaagatggtgccagtgcactccagcctcagtgacagagtgagactgtctcaaaaaaaattttaaaaagcaacattatgtaagagatatataaacttttcaaatgtaaggattataaatgctggtatgtttcttttataacttaagaaatgtatacttaaaaaaattttttttttgagacagagtctcgctctgttgcccaggctggagtgcagtggcgcatctcagctcactgcaagctccgcctcccaggttcacgccattctcctgcctcagcctcccaagtagctgggactacaggcacccaccaccacgcctggctaatttttttgtatttttagtagagacggggtttcactgttagccaggatgatctcgatctcctgacctcatgatccaactgcctctgcctccccaagtcctgggattacaggtgtgagccaccgcacctggccacaatttcttaaatcatgaaagtagaattttaggaaaagagtagatgtctggataataatctggatggattatatatactggtcttggaggcaggggagagacttaatgagagcatggtaatggatttatggtgggtccttctctgtgggcctctcatagtgtacccatgccatagcaaatggcagcctcgaaccattgcccagtccccttacctgtgggctgtgagcactgaagggggttgcacagtgtgtaacaaaaaagctatgaactaaattttatttgtggtctctagtcaaatttattttattttatttatttattttatttttgtttattattattttttgagacagaatctcattctgtcacccaggctagagtgcagtggcaccatcttggctcactgcaagctccgcctcccaggttcacgcgattctcctgcctcagcctcccgagtagctgggactacaagcgcctgccaccatgcctggctaattgttttgtatttttagtggagatggggtttcaccttgttagccaggatggtcttgatctcctaacctcgtgatccgcccacctcagactcccaaagtactgggattacaggcgtgagccaccgcgcccggcctaatgtttgtatttttaatagagatggggtttcaccattttggccaggctggtcacaaactcctgacctcaggtgatccgcagcctcggacttccaaaatgctaggattatggtgcaaggattacaggcataagccaccgtgcccagccaaaattattttaatttttatatttagacagctctgtaggtctctacttttgaaggtcagtcctttgtaattgggaagcaatacagcagagtggttaaaagcagggagttaaggcagccgcagtggctcatgtagctgtaatcccagcactttgggaggttggggcgggtggatcacttgaggtcaggagttcaagaccagcctggtcaacatggtgaaaccctgtctctgctaaaaatacaaaaattagctgggcgcggtggcaggcatctgtaatcccagctacttgggaggctgaggcaggagaattgcttgaacccaggagtcagaggttgcagtgagccgagattgcatcactgcactccagcctgggtgacaagcaaaactcaaaaaaaaaaaaaaaaaaaaactgggagttagaattagattgacagggttgatcttgctttcccatttttgagctgtgtgatattgggatgtaacttgccctgtctagggtttggttttccttagatgtaaaatgggcacagtgataaaaatctcagaggtttgcaaggattaagtaagatgatccaatctgtcagtaaacgttagctgtgttattaatacagtcagccaccttacaacgttttagtcagtgatagactgcacatatgatgcttgtcctgtaaaattatagtagcatatttttactgtaccttttctacatttagatacacaaatacttaccattgtgttacagcattcagtacagtaacatgctatacaggattgtagcctagaagaataggccatatcgtatagcctaggtgtgtagtaggctattttcatctaagtttgtataagtacacatttgttaaatgacaaaattgccttgcagtgcatttctcaaaacatattcccactcagcgtagtggctcacacctgtaatcccagcactttgggaagctgagacagatggatcacaagtacaaaaaaaaattagttgtgcatggtggcacgtgcctgtagtccctcggcaggctgaggcaagagaatcgcttgaacctggtaggcagaggttgtagtgagccgagttggcaccattgcactccagcctgggagacagagcaagactgagactctgtctcaaaaacaagacaaaacaaaacacgtattaccattgctaagcaatgcatggctgtatagagttttctcttcagacctgcctattcctctgtaatatatactgtcttctgataccccttattcctttttggaacaacatcttcaaacattagacttaatcttgacatagtagcttagtgataactaagggagtggaagatgaaattgcttcttccacaagcattagcagcatttataaataacagaaagcttattacagaaagctaatcacatcgactgtcagtggttggagttctgtttgttaatggtcatgtttactcctagtagcccaaatgcataacagagttttcttaaaagttcaaagcactgtatataggttgtcaatttcatgtttccctaggatgaaggtgagaaggcttaggtgataatgttaccaaattatacatgaaggaaactaaggacctgaagatgcaaaattcatatgatacttattgatccttaaagtatattgtaatcattgtttacttattccttgggcattctcacactttttttcttccttggtttgttttggtcccagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccaggttaaataaaataccctgttttcctatcttcaccttattcttctactatattctccctttaaaaaagataaattcacatcattctcccagtactaggatttctgctttctggaattcattttggttaggttttttatcctattcaacagactcttgaaagcctctgagagttcttactttcttatacatctcactcaaagctcttgatctaccagtatgtggtttgtatttaaaaccttggctttcagtggtgctctctcttttaccctccacctaaaaaagagagtgatatctccctccagtctccccacccctcaagactgctagaaaaggagtgattctgtacatgtaattgtaaagttagccactaaagttaaaaagattcttaatttgtagttttggtgcaattttatcagaagtacctttccattttgccagaatccttgaatcattctttaaaccaaagcatttttttatagtttctagctaggtttatagaaactagtggagctatgggcagtcagttaaaaacaggccatagatagcataatgaattataacacccctgtccaagtcctatagagaaaaaaaaaaatccctacttttgactacagttacacagcagatcccaaagagctttgtagtagtttaacgtactacaacttatcagaaagatgaggcacttgacagttacattaaggagctaaagtcaatacggcagttgtagatttgctaatgccactgtatttttctgctcatagcatggacccattcatatgactaatttaggtacaggcttctccagtcagaatgagattgaaggtgcaggatcgaagccagcaagttcctcaggcaaagagagagagagggacaggtaagttggaataattatgcaaatgtattcagatgttatttgtttgcaccattagtgagagtaatgatcattgctatgagcttaagtattctgaaactgaaatgaaatctttgaatcaaatatgcttctgtttgttgtaattgatgcaatgaagtaaaatatgataggccttttacagatttagaagcagttatattcggttttgaataatttattacttgttcagacatctttcttgacttccattgtctgcatcttggccattttcctaagggtagacagtaacagaaatgttacataattcagctatttttgctactttagagtcattagaatatcatggatggaagtacatgaatgtgggagttcagcctgccacacagtgcttgaattttcctttcttatattagtatattaaccttcataagaaaggagctgatatctttctataacagttcattcgatttttgtcatggcaattgctgtgtagacaggccttatacttttataaaggggctgggggaaggtggaaggggttgaaattaatggttaaaatgaatttgaaggattgtctgcagacataattgcacttctaatccactggataagttaagaaaatttaaattgtctgaaagaaagtttcattttgtttttcaataggcagttgatgcctccaccagcctttccagtgactggaataaaaacagagtccgatgaaaggaatgggtctgggaccttaacagggagccatggtgagtgtgatatagctgggggaacaggggagtggctaagactggtctaaagctattagttttctcagccgggcgcagtggctcacgcctgtaatcccagcactttgggaggccgaggtgggcagatcacctaaggtcaggagttcaagaccagcttggccaacatagtgaaatcccatctctactaaaaatacaaaaactagcgggcatggtggtgggcgcctgtaattccagctactcagggggttgaggcaggagaatcgcttcaacctgggaggcagaggttgcagtgagccaagatcagaccactgccctccagcctgggcaatagagcaagactccatctcataaataaataaatacataaataaagctattaattttctaacctgatgttcattcaggtgtttaatccaacctctataatctgttggccagtgaaaatacttttgggctgggcacggtggctcacgcctgtaatcccagcactttgggaggccaaggtgggcggataacctgaggtcaggagtttgagaccagcgtggctaacatggtgaaaccccgtctctactaaaaatagaaaaattaagctgggcatggtggtgcatgcctgtaattccagcggcttggaaggctgaggcaggagaatcacttgaacttgggaggtggaggttgcagtgagccaagatcacaccactgcattccagcctgggcactagagtgagactctgtctcaaaaaaaaagaaagagaaagagaaaatagtttctaaaaaattgtatacagacaaccttttatttccaacaaacgtgtgccgagagagagagagagaaaatagttttaaaaaaattgtatacagacaaccttttgtttccaaccaacgtgtatctagaaaagagttagtcgacttattttatacatagcatcagtgaatagtaatgagtggtaggtcatttcaaaatcctgttgcctatattatgtgaataccaggaggtcatctgatacggacttaataaaggttgattttgctttatattgggagctgagccacacctccccttataactctattggtcagtaatggtcagtttgtggctgttaggaaaatgttgccttttagcattccagaactctaaatcctgtagaggtacatgggatattttattctttgcctgtactcataaaaatgaacagaagaaaatacgtttttttcttttcttaacttcttttcttttaactctttaaaaggtgaaatatcagccctcaagagactcacttgctaactttcctttttttctttttttttctttttttgtgtttcttttttctttctctgttttcttacatggttctggtggattcacatttgctgatgctggtgctgtttttcgtgtgatcttcaacgtttttgggtgaccattgaccctgtgacctcaaaatggtgtccaactaaccacttaaaattaacatcttttttttaattaacgaatttatggtatttttttttttcccttggcggggatggggttggggttgttttttctctattctagattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattctg

SEQ ID NO: 12329 - DNA, 945 bp, Homo sapiens
cgggcgccggtggcgccatcttactcggttgcgggaggggtcacaggtcagtgccggagcctccgcgagtgaaggaagacgaagtgcgtgacccgaccggctgtggtgttccagtccccactgaccagtaggagcagcagggcgtcggcttgtgaggtagaggggtggggagtctggcggcggagcagcagctgggggtggggagggggttcggaggagaatggggagggggcggaacctctgggtaccgcagacgtgagagaacccctgcggcctaaggggccgcatccctttcttcccaaaactttctccttgtccctactgtgccgagacgtaaatttatttgtatctttttatttttctctttggaaaaagtaaaacctgtgatgtgtcatgtgactgaactgtctaggagggagggtgaagatgggggggtttcttagggccacccgaaagggtgcagtggtgagcaagagggacaggccagagtaagagggacaggccagaatatgtatggaaaggtaaggcactggcttgagggctgtcgccgtggtgtctccatcctggattaagcatttcctcctccttttctaggtggcttttcctcggggcaaccgaggaaggccccaagaggacaatggattctggaactcgcccagttggtagctgctgtagcagccccgctgggctctcacgggagtacaaactagtgatgctgggtgctggtggtgtagggaagagtggtaggtaacattttccatttgacaggaagcatggatgaaaagtacttaaatgaccagatgggatacttgctatcttgcaatgttaatacttaaaattctctctgtgggtcacctttgtgaggatttgacttttatttcttcttttgaagccatgaccatgcagttcatcagccaccgattcccagaagatcatgatcccacc

SEQ ID NO: 12330 - DNA, 439 bp, Homo sapiens
tcaaccgttaagtacacagatgccagaacagggtgctccataacctatgcttgatcgcctctccagtactcaaccggctttttagcgtcccattcttaaacgctccagcaagatgagcagcttatcttcttcgacctttgcttaatatacaactctatcatacatatttgcctgcgtacctgccttgccacattgagagtaccagaatggcagggcctgcggcttattcatctttttatttttatattccctgcttggtgcacagaaatgaagcaaacaaacagagaaattctccaaatgatctttgcaacgaatccttttccttttcctaagtaacagaaacgtgaaacgggcaaaagccgcgggaaggctgtctccccagacagaaactaggactcaacacaaacgtagcggaatttgaggagaaacctgtttaatc

SEQ ID NO: 12331 - DNA, 2796 bp, Homo sapiens
  misc_feature (59)..(59): n equals a,t,g, or c
  misc_feature (941)..(941): n equals a,t,g, or c
acccgggctgggcgggggagaggaatgggcggggcagggatgtcgccagagtgcggggntccggtgcggacttcgagcacgagccctaaagacgctcagcactcgtcgcttctcctagcagaccctgcccggcttggcgatggagtttccggacctcggcgctcactgttcggagccgagctgtcagcgcttgggtgagggcggagcgcgcgagcgcggggcccagcggacagggactttgaaccgcaagttgcaagcgaaggctgggctcccagactgcaagtgccatcgggcggggcttgaagctaggcgggcctagtcagcggcagaggtggcctggccaaggagataatgggcttgggaaggggcggtgtgtcgaaaatagggtggcgttttccttcccgagtggaagacttgagtgagagagaaggacatgcgagtcccgctggacctgcaatccgaccaactctttgcagattttctgccgcttaagtgtgatgcctgctcaggcatcttctgcgcagaccatgtgcctacgcccagcatcactgtggatctgcttaccaaaaggtgagggggcgatcctcagggtgaaagcaggcagatggagaatgcgtgcagaatcccccaaatctgtgtctcacgtttcttctcccttttgtccttctgaggctgtcagtgctgggaaacactgtttttttgcgtgtttgtggtgggtcatatccaagttctttcaggaccagagatttgttggactggagtgggccacagactgacccttgctccttgactacaggatatccaggtacctgtgtgccctctctgtaatgtgcctgtgcctgtggccagaggggagccccctgaccgtgctgtgggagagcacattgacagagactgtcgctctgatccagcacagcaaaaacgtaaggtaaacattgtanggggtcagccacaacccagctgggactacggatgcctggaaacccaaacagctaatcagagtctcagcagagacaaccttctcacttcacctcagatcttcaccaataagtgtgaacgcgctggctgccggcacgagaaatgatgaaactgacctgtgaacgctgtagccgaaacttctgcatcaagcaccggcatccactggaccatgattgctctggggaggggcaccaaccagccgggcagggtaatggcagccaagtcctccacttgcttttgggaagcattcttttggaactgactcaagctctgttgttataaattggggagcttcaaccctaccctgtcggctaggggagtcttttagcttccttttcaagtgcatgtttttccagaactcccctcctgacttcctgggtaaggctagttcttggagacatgccaaaaatctctcttccctacagacttgctgccatctccagagcacaagctgtggcttctacaagcactgtccccagcccaagtcaaaccatgccttcctgtacctctcccagcaggtaggcctgcccgtttccctgctccccctttttccccttcacacctctgacctccacctcttcaatgtctgtcgtagagccacaacccgatctccgtcctggacagcccctccagtgattgctttgcagaatggcctggtgagttgggcagaggttggatggacagaaacaaacacacagagagtgaagtccaaggacgctggtcttctttctccctttgtagagtgaggatgaagctctgcagcgggccctggaaatgtccctggcagaaaccaaaccccaggttccaaggtaccttaccctcttgtgaaagagagcgcaagctgtgggcaagggcttggtctggaggcaggtaggtgggaccactctgacacaatgcaagataatcgctggcaacttggtctcaaaattaagatgaactatatgatctttgacaagttatttaacccatggagccttcatttcctctataaaacggggacaatactaatacccaccttgtagtgttgctatgaagattgagataatcctcagcagtgctcagcaccatgaggcccaacacacacagatcagatgttcaaatttcagatcttaccatcatccaacttaaactgtttctccctcccagttgtcaggaggaagaagacctagctttagacaagcactgtcagccagtgaggcagaataccagcggcagggtatgaggctgggctgaagatatatgctgcagtggaagggaggaagaagtcagggatgggggttcttcctagtggtgcagagttttggaatggtggttatcgtctggttttcagtatgactccagcccatgctgagctctgaaatgagggctgtccctcatttccttgacgttgcactgtgtcttcccctccttcccctctctttgctctaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctggccaggccctactcttagccccttcatcatgtcatctcccttatgctggagctgccccgatgtggagtgggcaggaaggggcctggaaaaaataaaggatcttggcagttgataaaacgtacaa

SEQ ID NO: 12332 - DNA, 894 bp, Homo sapiens
tcctcgcacagtccacatttttatttccccaaaagatgtttttcggaaaggtccctttcccttaccatagctagcaccataccccaagaccaggatgaaataagccagggaaaggagacacatcttattcccttctgggttagtctttgagagggaagtggccaaacttttgtcaccgttccatggtctgaggcttagtgtcttcagaggtttcttcctgtccctgctgcagctgccacatgtcagcatacaccccacctcgggacaacagagcctcgtgtctggggtgaggagaaaagtgtgagtcctaaccattagttttaccccgagggtccttgccaccagcccacagagaggacgggatgggaagggaggtcccctccagaagcccctgggacttcatgccccctttcctggagcccccaattcagaagacctgtccttttgatctatgtgtctcttaccgtcccctctccacgatgcagccatccttgatgacgaggatctggtcagcattgaccacagttgagagcctgagaagtcaaagatcagtcgcctactaccccacccaaagcgggccacatcaccagccgccccaggcctgtagtcctgtacctgtgtgccactacgatggtggtgcggttggcacagactttggccagagaagcctggatggccctctcattagatgtatccagcgctgacgttgcctatagagagggtccaggtaaaactgctcctgccactcaaaaccctcaatggaaggaggcaggctgctggctgaggcctcaagaatacacaagagccttgtttgggcttgagaactggaaagtgtgttttgtgagatttgaattcatggtatctgttctaggtggggacagtgcccaggaggaa

SEQ ID NO: 12333 - DNA, 147 bp, Homo sapiens; identical to SEQ ID NO: 11317

SEQ ID NO: 12334 - DNA, 3445 bp, Homo sapiens
aggactcagtggtctttgaggatgtggctgtggacttcaccctggaggagtgggctttgctggattctgctcagagggacctctacagagatgtgatgctggagacctttcagaacctggcctcagtaggtaaggatgacatcattccttccttcacgtagttattgagagaacaagtatttcttacacatcagacctgttccaaggcttggaatgtggaaagggaataaattggtaaataagacagacatagtcacagctgtcatagagctagaatgtaatgtttttccatgagaatgagaatctgtatttcagctttttatttttgtagagaaagctcccttcatgtcgtcattgtggatatagctttgataggcctagtgaaatttgtttgtgcaagccagtgaaaatttgatttttttttttttttttgagatggagtctcactctgtcgcccaggctggagtgcagtggtgtgatctcgactcactgcaacctctgcctcccgagttcaagcaattatctgcctcaggcgcccaagtagctgggattacaggcgagcgccaccatccctggccaatttttgtatttttagtagagacggggtttcaccatgtcagccaggctgctcttgaactcctgacgttgtgatccacccgcctcagcctcccaaagtgctgggattacaggcatgagccaccgcgcctggccgtgaatttttttttttaataatttttctatgcttactaatactgtgttgattgagttgcttacctttttgaccattttgtgtttaatgaagtcctgagatagctaaactcctcagtgtcgttttccgctaacaagtgccttcttatatgatttgtttactttttggtttcagatgatgaaactcaatttaaggccagtgggtcagtttctcagcaggatatttatggagagaaaatacccaaggaatctaaaatagccacgttcaccagaaatgtttcctgggcctctgttttaggaaaaatttgggacagtcttagcatcgaagatcaaaccacaaaccaggggagaaatctcaggtgagttgcactcacaagagaacatagtatttcaggagagaatcttagtctgtcattaaactttaaaaaagcaagcaaacagaaaactcatccaagcctagctccaatttgtttaatccacagaatttttacaaaaaaatatttctttaaatgtgacatagacagtgagtgacattagaaacataattcagatggaaaccattatcaagaaaccctaggccaggtacggtggctcacacctgtaatcctggcactttggaaggctgaagtgggcagatcacttgaggacaggagttcgagaccagcctggccaacatggtgaaaccctgtctctactaaaaatacaaacattagcagggcatggtgccgcaggcctgtaatcccagctactcgggaggctgaggcagaattgcatgaacccaggaggcagaggttgcagtgagctaagactgcaccactgcactccagcctgggtaacagagtaagactctgtctcaaaaaaaaaaaaagaaagaaagagaaagaaaccctatacataagaaacactgttttaataatggcagtggtcaaaccatcttccagggcattcagtttatttcattttcagacagttcccatggggtgaaaaacctatgctttcactgaaaatggttaagatgcagtcctaatcctaataaatactaacaaatcattattaatcaaaccaataacatgcttctcatttttagtagaaatcatgggttggagagactctgtgaaagtaatgatcaatgtggagaagccctcagccagattccacatcttaatctgtacaagaaaattccacctggagtaaaacagtatgaatacaacacgtacggaaaagtcttcatgcatcgccgcacatccctcaagagtcccatcacagttcacactggacacaaaccatatcagtgccaggaatgtgggcaggcctacagttgtcgttcacacctaagaatgcatgtgagaacccacaatggagagagaccctatgtgtgtaaattatgtgggaaaacctttcctcgtacttcctccctcaatcggcatgtaaggattcacactgctgagaaaacctacgaatgtaagcaatgtgggaaagcctttattgacttctcaagtcttactagtcatctcagaagtcacaccggagagaagccatataagtgtaaggaatgtgggaaagctttcagttattcctcaacgtttcgaagacacacaataacacacactggcgagaagccatataaatgtaaggaatgtgcggaagcctttagttattcctcaacttttcgaagacatatgatttcacacactggagagaagccacataaatgtaaagaatgtggggaggccttcagttattcttcggcttttcgaagacacatgataacacacactggagagaaaccctacgaatgcaaacaatgtgggaaaaccttcatttatctccagtcctttcgaagacatgaaaggattcacactggagagaaaccctacgaatgcaaacagtgtgggaagaccttcatttatccccagtcctttcgaagacatgaaaggactcatggtggagagaaaccctatgaatgcaaccagtgcgggaaagcattcagtcacccctcctcctttcgaggacacatgagggtgcacactggagagaaaccctatgagtgcaagcaatgtgggaaaactttcaattggcccatatctttacgaaaacatatgagaacacatactagagagaaaccctatgaatgtaagcagtgtgggaaagccttcagcttgtctgcttgctttcgagaacatgtgagaatgcaccctgaagacaaatcctatgaatgcaagctatgtgggaaagctttctattgccacatatccttacaaaaacatatgagaagacataccgcagagaaactctataaatgcaagcagtgtgggaaagctttcagttggcctgaacttttgcaacaacatgtgagaacgcacactgtagagaagccctatgaatgtaaggaatgtgggaaggtcttcaaatggccatcatctttaccaatacatatgagactgcacactggagagaaaccttatcaatgtaagcattgtgggaaagcattcaattgttcctcatccttaaggcgacatgtgagaatacacactacagaaaaacagtataagtgtaatgtaggacatcctcctgcaaatgaattcatgtgcagtgcttcagaaaagtcacaccaggagagagatctgatcaaagttgtaaatatggtgttgcctttatgagttccttatcctgaaagtggacactcaaggagtgtgtctgtagttcatttgcaaataaacatttagttgaaaaataa

SEQ ID NO: 12335 - DNA, 3446 bp, Homo sapiens
aggactcagtggtctttgaggatgtggctgtggacttcaccctggaggagtgggctttgctggattctgctcagagggacctctacagagatgtgatgctggagacctttcagaacctggcctcagtaggtaaggatgacatcattccttccttcacgtagttattgagagaacaagtatttcttacacatcagacctgttccaaggcttggaatgtggaaagggaataaattggtaaataagacagacatagtcacagctgtcatagagctagaatgtaatgtttttccatgagaatgagaatctgtatttcagctttttatttttgtagagaaagctcccttcatgtcgtcattgtggatatagctttgataggcctagtgaaatttgtttgtgcaagccagtgaaaatttgattttttttttttttttttgagatggagtctcactctgtcgcccaggctggagtgcagtggtgtgatctcgactcactgcaacctctgcctcccgagttcaagcaattatctgcctcaggcgcccaagtagctgggattacaggcgagcgccaccatccctggccaatttttgtatttttagtagagacggggtttcaccatgtcagccaggctgctcttgaactcctgacgttgtgatccacccgcctcagcctcccaaagtgctgggattacaggcatgagccaccgcgcctggccgtgaatttttttttttaataatttttctatgcttactaatactgtgttgattgagttgcttacctttttgaccattttgtgtttaatgaagtcctgagatagctaaactcctcagtgtcgttttccgctaacaagtgccttcttatatgatttgtttactttttggtttcagatgatgaaactcaatttaaggccagtgggtcagtttctcagcaggatatttatggagagaaaatacccaaggaatctaaaatagccacgttcaccagaaatgtttcctgggcctctgttttaggaaaaatttgggacagtcttagcatcgaagatcaaaccacaaaccaggggagaaatctcaggtgagttgcactcacaagagaacatagtatttcaggagagaatcttagtctgtcattaaactttaaaaaagcaagcaaacagaaaactcatccaagcctagctccaatttgtttaatccacagaatttttacaaaaaaatatttctttaaatgtgacatagacagtgagtgacattagaaacataattcagatggaaaccattatcaagaaaccctaggccaggtacggtggctcacacctgtaatcctggcactttggaaggctgaagtgggcagatcacttgaggacaggagttcgagaccagcctggccaacatggtgaaaccctgtctctactaaaaatacaaacattagcagggcatggtgccgcaggcctgtaatcccagctactcgggaggctgaggcagaattgcatgaacccaggaggcagaggttgcagtgagctaagactgcaccactgcactccagcctgggtaacagagtaagactctgtctcaaaaaaaaaaaaagaaagaaagagaaagaaaccctatacataagaaacactgttttaataatggcagtggtcaaaccatcttccagggcattcagtttatttcattttcagacagttcccatggggtgaaaaacctatgctttcactgaaaatggttaagatgcagtcctaatcctaataaatactaacaaatcattattaatcaaaccaataacatgcttctcatttttagtagaaatcatgggttggagagactctgtgaaagtaatgatcaatgtggagaagccctcagccagattccacatcttaatctgtacaagaaaattccacctggagtaaaacagtatgaatacaacacgtacggaaaagtcttcatgcatcgccgcacatccctcaagagtcccatcacagttcacactggacacaaaccatatcagtgccaggaatgtgggcaggcctacagttgtcgttcacacctaagaatgcatgtgagaacccacaatggagagagaccctatgtgtgtaaattatgtgggaaaacctttcctcgtacttcctccctcaatcggcatgtaaggattcacactgctgagaaaacctacgaatgtaagcaatgtgggaaagcctttattgacttctcaagtcttactagtcatctcagaagtcacaccggagagaagccatataagtgtaaggaatgtgggaaagctttcagttattcctcaacgtttcgaagacacacaataacacacactggcgagaagccatataaatgtaaggaatgtgcggaagcctttagttattcctcaacttttcgaagacatatgatttcacacactggagagaagccacataaatgtaaagaatgtggggaggccttcagttattcttcggcttttcgaagacacatgataacacacactggagagaaaccctacgaatgcaaacaatgtgggaaaaccttcatttatctccagtcctttcgaagacatgaaaggattcacactggagagaaaccctacgaatgcaaacagtgtgggaagaccttcatttatccccagtcctttcgaagacatgaaaggactcatggtggagagaaaccctatgaatgcaaccagtgcgggaaagcattcagtcacccctcctcctttcgaggacacatgagggtgcacactggagagaaaccctatgagtgcaagcaatgtgggaaaactttcaattggcccatatctttacgaaaacatatgagaacacatactagagagaaaccctatgaatgtaagcagtgtgggaaagccttcagcttgtctgcttgctttcgagaacatgtgagaatgcaccctgaagacaaatcctatgaatgcaagctatgtgggaaagctttctattgccacatatccttacaaaaacatatgagaagacataccgcagagaaactctataaatgcaagcagtgtgggaaagctttcagttggcctgaacttttgcaacaacatgtgagaacgcacactgtagagaagccctatgaatgtaaggaatgtgggaaggtcttcaaatggccatcatctttaccaatacatatgagactgcacactggagagaaaccttatcaatgtaagcattgtgggaaagcattcaattgttcctcatccttaaggcgacatgtgagaatacacactacagaaaaacagtataagtgtaatgtaggacatcctcctgcaaatgaattcatgtgcagtgcttcagaaaagtcacaccaggagagagatctgatcaaagttgtaaatatggtgttgcctttatgagttccttatcctgaaagtggacactcaaggagtgtgtctgtagttcatttgcaaataaacatttagttgaaaaataa

SEQ ID NO: 12336 - DNA, 10677 bp, Homo sapiens
aattaatggaactcgcctatcagactttactagaggcaacaaccagtagtgatcaatggtacgaattctgggttgtgtgaaaatggcaatgacttggttaaatgcatatctaactagatgtttatcaggaaaattagctggaattctttgggttttcatatcctagaagttaatgctttttctggaaacaaaacaaaacaaaacaaaaacccagtgcatcacacagatttatgtctatctctgacttttatttgcaatagcatagatgtttgagcaaggtgtaggaagtaggtgcacttgtatggatggacaaatggatttttttgacattaaaaattgttaatcactttttaacaaaaagttcttcaattgttgttgaatttttactttttatttgaattgaatgatattatatgagaaaacacatgcaaagaacttagaatcctacctggaaaatgattaatactcaaatgtttattattgtgttggcagtgggtaatagttatatcttctattccagcttgctcaggctctttagcttaacattctttttaccttttgaaacccagtccctaattcatttatattttaaatgtttatatttgaagcaataacaatttgttaggcagccaaaggtagaaggaaaagaatggaacatgccaaagatctggcttcactctttcaagatgacttctaatctatattgcattcacgttaccttaaattctactccattatcttatatggaatctgtttttgttcaataagcttcttccctactcctagactaaattgagaagaaaatggcagagcatggaccaagctgattgcagagcaggtttataaaagcttctttagtttgaatctgcatttagcaatttcattcttcctatcctcatagagaaaacagtttcagttagggtttggcccaatcaaattgcatctttagatggactttccaagttcaatttttatcgtgagataacctctttattttattctgctctaggaagaacatgtctcccaagatactttcctagctttaatgaatcattacattcacatgtccattcagagttaattgtaagaaggaagaaatgaatataggagtgactgttggcaaaatgaatataggactgtttcttcacatggcactctcctgaaatatatcagaccagaagttagagatgagggcaatatttcttaaattttttgggaacacaaaacaccaaacagtatttgtatactgactatctatggacattctttccactaaaagtaatagtttttaacaggacaaacaaaaccacagctacaatgcaacaaccccctttttcattatcaaactcaaacagcagctcctgcagcgaaaatgaaataatttaataaggtattataataatcaaatagtaacagggtttttgggtatgacttattttcctaaatatttatgaaatccctgtaagcttttaaggtacgtagcttaagatattcttatgtagaggtaagttacacaaaccttatgtttgccttttaaaagtgcattttaataataatctgtaggtgttttaaggctagatttaaagggcaaaaaatcttgagggctagattctatcctagaaatgttgattcacctccttgcattgaggtaagaaggagaaaaggtgaaagctgaaagtcagactgattctaaaagaaccaagcgagtgcttttattgataccttgccctttgcagagtgtgtcagtgagtaggtgacatttgcttgaggcttagctccatttgttactgaagggatactctgggtactggcagaacagaaattgataaatagaaaagaggctttgggttgaatgcggctcttcttacaatcattaatgcatccaggtgtttggaattgtagtctggttagtaaatactggttgagactatatttccatctagattaatggtgttttccagcaaccaaggcaggtgttctgtgcaactgtagttttagcttatgactctcactgaagatgcacttagtttaaatttttttcttgtttttagtgtattcttaggcatttctgttaagtctatgttttctttttagtgctgttcaacttttctactcagtgaggaatatcttccatttgttccatgatgttgtaccaacatatcacaagtaagtaccactgtatctcatttctatataataattgtatgtctaagatgtggaagttaagttaaaacaaataattttatattcccactaaagatattttgtttactaacattcacactaaaatgcagtaaatcattttaaaacgcatatttaaaggatttggtcatttattactaaattaattagggtattataatcttgcagtgtagttcatgatgcacattttaaaactcaaaagaactaccttgttttgctgctaagcattttcagaactgcctttacttaactttcagcctctagttcagttttctttatttgaattaaaatgtttagatgtttttcataaatatctttgataacatgtcaacaaagctattccttagccaagaactctgaatttcagagacaaaaatctgccaggcacagtggctcacacttgtaatcccagcaccttggaaggcagaggtgggaggattgtttgaggccagaagtttgagattagtttgagcaacatagtgagaccctcgcctctaattaaaacaaagaaacaaaaaaccaaaaaaaaaaacaaaagctgtttactatttaaagtattttttagttcagatttttgaatattgggatgtttttaactaggctcacctgttgtttttattataaaagcttattgtgaaccttattagttttatttgtattctctttactgtggtttaacattcttatttcattttttacttagtcaagcaaaagaaaagagaaaacatatttgcattagctgacagccttgtccttggggatttaaagacaggagtggagttagatttgcctgtctttctccttcgtataacctcggaactttagtgtgcatcagaatcacgtggaagtcttgttaaaacacagattgcttgatccatgcccaaggtttctgattcagtaggtctggaatggggcttggatttttagcaaatttccaggtgatgctgatgttgcctgtcatgggaccacattttgagaaccactgtccttagataacggttctcagctttggcagtatttttatatcgtttcatttcatttcaatttcattccattcatttaatttcatattttgagacagagtctaactctgttgcctaggctggagtgcagtggtgcaatcatggctcattgcagcctcgacctactgggctcaggtgatcttcccatcttagcctcccaagtagctgggaccacaggcacacaccaccacacctgtctaacatatttttgtaatgatagggtctgtatatgttgcccaggctggtcttgaactccttggctcaagtgatcctcctgccttggtctctcaaaatgatggtattacagttgtgagccactgcaccggccagactttgggcagtattttagaataacttatggagctttaaaaatatacatatttactctcttcctagggcatttgatttatgtctgatgtaaggcccaggtgtgtttttttctttttttttaagccccacaggtgattctgatgtgtagctggaaaagaggactatcttagttatcttagtttgttggcttctgacttgtatatcctagttttatattgagttagcaaactagaaactgttaattgaatgactgttagtgggtagatagcagaaatataagacaaaatttcttcccaagctgggtagataagactaatacgtgtagaagaattaaagtagtgattttcaatcctggatgaaaattaaaatcacctgggaagattttaaaacatataaatgctgtgatttcactcttagagcttgtgatttaatttgtttggggtaaagtctaaacatctgtggttttttaaaattcccaggtgactctaatctagtcagtttttgaaaactagtgaattagaaaataattgaacacttcattatatgactgaagtaggaatttggagaaaggtgaagtaaacctgtatttccatagatgtatccgtgtaaaatttcaaggacattattatgcatagctctgctaggttttcagtgcaaaaagttgactcaggcaaacatcttgattcccttaatctttctttattgttaatcaccaggatagttttataggataaaatcccattcaggcagaacagcctccctctgggagtgggagtgatgagattgtatcttgttatgtatagcatttagaaactagacagttattaaagcctagaaatacattagagaagttgtgactttcatcaaccccagcttcagtaacaggtggttgctttgtttttctacccctccttctggcctagggagaaccttcaaaaacttccccagttggctgctattcatcacaacaactgtatgtacattgctcaccacttgctgaccctcgggcatcagttcagattgcgtcttgcccccattctttgtgatggcactgctacttttgtggatcttgtacctggcttcaggagacttggtaactgatactttcaatgtaggaaagcatatggattatgcagcttgtcaacatagtatctttatagtttttgaatgagaaaattagaaattaggtggtggtcctgagctgtatcagaaagtgggagggcatttaatttgcaagtgtttccagttatataattttataaggtgagtgtagtctttgtgggagacttttttacttttttgtaacatgatttcatggtacgttagagttccaaactgcagtcctagtgtgcattgaatttgccaggtcaggattcacataataggatttataatgtgacaattttgtttgtattgttggtaagagctcactaatgtcagtgctagttcttttgcaaaaccccaagacagctcccccatcttacatctcccttagttttacttgggattactaaaagtcaaaagaaatgaaatgtggagtaaatcaatatgttgatcatagcagagaatctatgtgtttcacttagcttttcaattcttgatttttccctagttggtatagatacatcagaataataagtagttcctttttctatagtaatttttcttagctgactcgggctctaagcaaactactggaaaatattatctggagggtggggtttgaggaacgggctaatgtattcaaagtgattgtttctagtagctttagggcagctttatgatattatctagcaattatttttatataggcagaacagatacatggtttatgcatctcttgtctatcctggttttgcagtgtgtaattgagcagcttttaaaattttttattctgtttttccatcatagggacagaatgctttttggcccaaatgcgggcacagaaaggtgaacttctggaaagattatcaagtgctaggaacttttcaaatatggacgatgaagagaattattctgcagcaagtaaagcagtccggcaggtaggaggctcttgctagcactgaaatttgtattctatccttagatgcctttttttttgtttgcttttttaaagcagaaaacaatatgtaacaagtattcagttgattccctgcacccccacctttggaaaatctagataccttttacaatcatgtttaagaactttttcttcccctctcccaccaagacaacacgaaactatcttttcattgactcaataattgcaacttgttacctagaaagtctgttgtggcaagtagttgattcctgaacttagatttgggaatttgaaatattggcttttatcttaatgctcccctttcttaagtgatttatcttttttgctgcagttttcctatcctcaggttgatgagtctgcttttcatctaccagggatatcactatggttaaatgttcaagaagcatatgtccttagttactttacctcattttggcataatgccactttcccaatgaactcacaaatgataaatgtaaatctggaaaatacgagtcacagtaatctttcttccacgtaaatagctgtattcttctacaggtactgcaccaactaaagagacttggaattgtgtggcaggatgtcctgccagtgaatatatattgcaaggctatggggactttactcaatacagcaatttctgaggtcattggcaaaattactgccctagaggtaagggccattagatgctacactagccttgagatgcaattcatgtcccagattgtgactttgctaagaaagtgatgttgaagaaattgttcatgtttcatgtctaactcatgctgtttttttttttttcagttttgttttatatctgttttgctagaaactgtttaatctcttttatatgaaagtaggattgaactatttctcagcctaccatctagattataaatgaggaagttagaaactgggtagtggtcctgagatgcgttgtatagtgtaaagtcatttaatttgcaagtaaactcaataatttgatttagtaaagtgaatgcagtcttgtgcaggttccatttttccaacacactgttgcagtttaaattttacatgtgattcttcaggaaaattgtctggacttggccagctgatgcctctaaatcatagattgactaaatccctatttgtaatcacatcccctgctttgcaacaagctgtgcgacattctattggagaaacaggctctttcatgcaggcaaactaaattactgacaatctgttgaaacatattttgtgtcattcttatatagaagtattgtcagagaactgatgtagtgtctagtaagttgttccaaattggttggaaaacatgttgtagctgacccacctggacagcatgcatcaaagatctgctgccctttccccacttctgagctggcccaattctattctattgtgtttcctctgtgcaaaaccaggacatatctactgaagatggtgataggttatattccttatgcaaaacagtgatggatgaaggaccccaagtatttgcacctttatctgaagaaagcaagaacaagaaatatcaagaagaggttccagtctatgtgccaaaatggatgccattcaaggaattgatgatgatgctacaagccagcttgcaagaaattggggatcggtatgtataacccttctatagaggcatataactctccatagctacaagagagtaatagtgcccttgatagcagggcttttccctgtttcctgatgttagtcatgcaagactttcatattgagtagcagtagctggggccttttcatgatctatcataatgcagatctcattaccactttcccatatttgatagcataaagacttctcatccatattattttggtcttgagtatgtggtttggcatgctgtacaagtgatctggcaactgtaagaattatagccttctgacatctggatggaaattgttgctcactttaaggagcagtggatgcttttttttttttgagacatggtcttactctgtcacccaggttggagtgcagtggctcaatcattcctcactgcagcctcaaactcgtgggctcaagggatcctcccacctcagcctcctgagtagctgggattacaggtgcctaccaccacacctggctaatttattttattttattattttatttattatttatttgttttgttttgttttagagacgaggtttctctgtgttgtccaggctggtctcaaactcctggcctcccaaagtgctaggattacaggcatgagccactgcagccagcctggatgcattttcagaattactttgatatattaacagagaagtgacttttacctgtctgaaatattgagcatcagactactgtttgattgacctgcagtctttctgcagggagtgcagtagttttagaggttaagcaccatatacctagaagggattcatcttttctcaaacgtagtggatgatgttttctctcaacaccatcagttaatgttgctgtgcccagtgagtgtatgctatatcatatcatagtgtgcagaggccgttgcacaaagcagaatagatgtgggtcagttacacattcatggatgattttatattgtcttggtagattattggtcagtatgtataccttgcataaaggactctctgtagaggccttaaggtcatctccatccctataggtacttgtctatctgctttagcttggtttactacagatgtctggttatattagaccagtcatcctagatgtgtctgagttgtttgctgcaaatattagtcatttgtacaatgtcaatgagatctctgcttgaaaaaaaatcacatcagaatacctccaatcacatttactacaaagtttagatttattcatttattatttacaagtccttagcaggtaacaaagacacctttaagtaataggctccagagggcagcagataagaatttttctttctgttgttaaagggctttcttgcagtctaagaatgatcattaattccttgttataagaaaaattataacactagtacaactcaacttctttttactgcctaggaaatttttttcccccagagatttgtgtaaatataaggctaaagttgtaaaatatacatatgaaggaatacagtagatatactctgtatttataatgtaaagaaaaagaataaatttcatgtacctattacccaacttaagaaaaataataccagtattttgaagacccatgaatccccttctccaaatgctctccatgaggggtaaccattatcttgacttttatgttatttatttccttacctttctttatagttctaccccatttacatgtatcctaaataacataaagtttagacttgcctttttttgaacttggtataagtagaatcatctgtaacttgcttcttttgttcaatattattattatgtttttgaaatctattcctttttttttttgagacagagtctcactctgtcgcccaggctggagtgcagtggtgtgatattggctcactgcaacctctgcctcccacgctccagcaagtcttctgcctcagcctcccgagtagctgggattaaaggtgcccatcaccacatccgcctaatttttgtattttcagtagagatggggttttgccatgttggctaggctggtcttgaactcctgacctcatgtgatctgccttcctcggcctcccaaagtgttgggattacaggtgtgagccaccactcctggcctgaaatccattcttgatggtatgtgtagctgcagttcattttcaccatcgcatcattccattgtacaaatatttcatagtttatttgtcctgtttagtctcattttcaccagtatttggaattatcagactggaaagtttcagctgatctaattggcatgcaatgataggttattgtcattttaatttgcatttccctaaattctaatgatgttgagcatcttttcattggtcattcatgtttcttctattatgtaatgcctgttcatatttttttgcccgttattctaataggttgtttgtggtttcactattgattcatgggacttctttatatatttttgtactagtccttcatcagttaaaattggttgcctgtggttactttgtaatacagttataaagcctaaggcatgagagtatggtcatcattattagttcaaagaggccttggtatagaataagggagaatagtctcatattcctcacttggtctcttcatctggctgtgctgataaccagttgtagtgggtgagcaaagaggtcagacacattgaggggcagttctataaagaagaggaaagatgcccaggatttgttttatttccatttcaagcaaataagcatttggatcaaacaggcaatttttaagtcttgcttatacttcagagacctaataggaaatggaactctatctttcgttttgcaggtgggcagatggaaaaggacccctggcagctgcgttctcttccagtgaagtaaaagctttaattcgtgccttgtttcagaacacagaaagaagagcagctgcccttgctaaaattaaatagctccatcttcttaagaaagctatgtcttgaatatgtggattcttcccttggcataattactcccttaaagacttctttgaatcgcccattggttttggtgaaccagtacatcttggaagtttgactttacagaagaacgtcttacctcctggcctgtacgaggctttgtttaagaactgtttattaagataaattgtcaagtaaagcacctcaattcattgactttctagccatcttcctttgattagctaacaaactgtcaggcagcattatttcatgctgcttccagagccctctgggagctatatacattgtaaatgcaggccctagctttggaacgaggaattgggagattccaggagtcagggtagagaatttctgagcaaatcggagatattttaggggtgtggaggaggggaagggaggaatgggccaccatatttggccttacaggaattaaggagacttcctgtaatatttctttccaataaatattgctttttacaattaa

SEQ ID NO: 12337 - DNA, 10675 bp, Homo sapiens
aattaatggaactcgcctatcagactttactagaggcaacaaccagtagtgatcaatggtacgaattctgggttgtgtgaaaatggcaatgacttggttaaatgcatatctaactagatgtttatcaggaaaattagctggaattctttgggttttcatatcctagaagttaatgctttttctggaaacaaaacaaaacaaaacaaaaacccagtgcatcacacagatttatgtctatctctgacttttatttgcaatagcatagatgtttgagcaaggtgtaggaagtaggtgcacttgtatggatggacaaatggatttttttgacattaaaaattgttaatcactttttaacaaaaagttcttcaattgttgttgaatttttactttttatttgaattgaatgatattatatgagaaaacacatgcaaagaacttagaatcctacctggaaaatgattaatactcaaatgtttattattgtgttggcagtgggtaatagttatatcttctattccagcttgctcaggctctttagcttaacattctttttaccttttgaaacccagtccctaattcatttatattttaaatgtttatatttgaagcaataacaatttgttaggcagccaaaggtagaaggaaaagaatggaacatgccaaagatctggcttcactctttcaagatgacttctaatctatattgcattcacgttaccttaaattctactccattatcttatatggaatctgtttttgttcaataagcttcttccctactcctagactaaattgagaagaaaatggcagagcatggaccaagctgattgcagagcaggtttataaaagcttctttagtttgaatctgcatttagcaatttcattcttcctatcctcatagagaaaacagtttcagttagggtttggcccaatcaaattgcatctttagatggactttccaagttcaatttttatcgtgagataacctctttattttattctgctctaggaagaacatgtctcccaagatactttcctagctttaatgaatcattacattcacatgtccattcagagttaattgtaagaaggaagaaatgaatataggagtgactgttggcaaaatgaatataggactgtttcttcacatggcactctcctgaaatatatcagaccagaagttagagatgagggcaatatttcttaaattttttgggaacacaaaacaccaaacagtatttgtatactgactatctatggacattctttccactaaaagtaatagtttttaacaggacaaacaaaaccacagctacaatgcaacaaccccctttttcattatcaaactcaaacagcagctcctgcagcgaaaatgaaataatttaataaggtattataataatcaaatagtaacagggtttttgggtatgacttattttcctaaatatttatgaaatccctgtaagcttttaaggtacgtagcttaagatattcttatgtagaggtaagttacacaaaccttatgtttgccttttaaaagtgcattttaataataatctgtaggtgttttaaggctagatttaaagggcaaaaaatcttgagggctagattctatcctagaaatgttgattcacctccttgcattgaggtaagaaggagaaaaggtgaaagctgaaagtcagactgattctaaaagaaccaagcgagtgcttttattgataccttgccctttgcagagtgtgtcagtgagtaggtgacatttgcttgaggcttagctccatttgttactgaagggatactctgggtactggcagaacagaaattgataaatagaaaagaggctttgggttgaatgcggctcttcttacaatcattaatgcatccaggtgtttggaattgtagtctggttagtaaatactggttgagactatatttccatctagattaatggtgttttccagcaaccaaggcaggtgttctgtgcaactgtagttttagcttatgactctcactgaagatgcacttagtttaaatttttttcttgtttttagtgtattcttaggcatttctgttaagtctatgttttctttttagtgctgttcaacttttctactcagtgaggaatatcttccatttgttccatgatgttgtaccaacatatcacaagtaagtaccactgtatctcatttctatataataattgtatgtctaagatgtggaagttaagttaaaacaaataattttatattcccactaaagatattttgtttactaacattcacactaaaatgcagtaaatcattttaaaacgcatatttaaaggatttggtcatttattactaaattaattagggtattataatcttgcagtgtagttcatgatgcacattttaaaactcaaaagaactaccttgttttgctgctaagcattttcagaactgcctttacttaactttcagcctctagttcagttttctttatttgaattaaaatgtttagatgtttttcataaatatctttgataacatgtcaacaaagctattccttagccaagaactctgaatttcagagacaaaaatctgccaggcacagtggctcacacttgtaatcccagcaccttggaaggcagaggtgggaggattgtttgaggccagaagtttgagattagtttgagcaacatagtgagaccctcgcctctaattaaaacaaagaaacaaaaaaccaaaaaaaaaaacaaaagctgtttactatttaaagtattttttagttcagatttttgaatattgggatgtttttaactaggctcacctgttgtttttattataaaagcttattgtgaaccttattagttttatttgtattctctttactgtggtttaacattcttatttcattttttacttagtcaagcaaaagaaaagagaaaacatatttgcattagctgacagccttgtccttggggatttaaagacaggagtggagttagatttgcctgtctttctccttcgtataacctcggaactttagtgtgcatcagaatcacgtggaagtcttgttaaaacacagattgcttgatccatgcccaaggtttctgattcagtaggtctggaatggggcttggatttttagcaaatttccaggtgatgctgatgttgcctgtcatgggaccacattttgagaaccactgtccttagataacggttctcagctttggcagtatttttatatcgtttcatttcatttcaatttcattccattcatttaatttcatattttgagacagagtctaactctgttgcctaggctggagtgcagtggtgcaatcatggctcattgcagcctcgacctactgggctcaggtgatcttcccatcttagcctcccaagtagctgggaccacaggcacacaccaccacacctgtctaacatatttttgtaatgatagggtctgtatatgttgcccaggctggtcttgaactccttggctcaagtgatcctcctgccttggtctctcaaaatgatggtattacagttgtgagccactgcaccggccagactttgggcagtattttagaataacttatggagctttaaaaatatacatatttactctcttcctagggcatttgatttatgtctgatgtaaggcccaggtgtgtttttttctttttttttaagccccacaggtgattctgatgtgtagctggaaaagaggactatcttagttatcttagtttgttggcttctgacttgtatatcctagttttatattgagttagcaaactagaaactgttaattgaatgactgttagtgggtagatagcagaaatataagacaaaatttcttcccaagctgggtagataagactaatacgtgtagaagaattaaagtagtgattttcaatcctggatgaaaattaaaatcacctgggaagattttaaaacatataaatgctgtgatttcactcttagagcttgtgatttaatttgtttggggtaaagtctaaacatctgtggttttttaaaattcccaggtgactctaatctagtcagtttttgaaaactagtgaattagaaaataattgaacacttcattatatgactgaagtaggaatttggagaaaggtgaagtaaacctgtatttccatagatgtatccgtgtaaaatttcaaggacattattatgcatagctctgctaggttttcagtgcaaaaagttgactcaggcaaacatcttgattcccttaatctttctttattgttaatcaccaggatagttttataggataaaatcccattcaggcagaacagcctccctctgggagtgggagtgatgagattgtatcttgttatgtatagcatttagaaactagacagttattaaagcctagaaatacattagagaagttgtgactttcatcaaccccagcttcagtaacaggtggttgctttgtttttctacccctccttctggcctagggagaaccttcaaaaacttccccagttggctgctattcatcacaacaactgtatgtacattgctcaccacttgctgaccctcgggcatcagttcagattgcgtcttgcccccattctttgtgatggcactgctacttttgtggatcttgtacctggcttcaggagacttggtaactgatactttcaatgtaggaaagcatatggattatgcagcttgtcaacatagtatctttatagtttttgaatgagaaaattagaaattaggtggtggtcctgagctgtatcagaaagtgggagggcatttaatttgcaagtgtttccagttatataattttataaggtgagtgtagtctttgtgggagacttttttacttttttgtaacatgatttcatggtacgttagagttccaaactgcagtcctagtgtgcattgaatttgccaggtcaggattcacataataggatttataatgtgacaattttgtttgtattgttggtaagagctcactaatgtcagtgctagttcttttgcaaaaccccaagacagctcccccatcttacatctcccttagttttacttgggattactaaaagtcaaaagaaatgaaatgtggagtaaatcaatatgttgatcatagcagagaatctatgtgtttcacttagcttttcaattcttgatttttccctagttggtatagatacatcagaataataagtagttcctttttctatagtaatttttcttagctgactcgggctctaagcaaactactggaaaatattatctggagggtggggtttgaggaacgggctaatgtattcaaagtgattgtttctagtagctttagggcagctttatgatattatctagcaattatttttatataggcagaacagatacatggtttatgcatctcttgtctatcctggttttgcagtgtgtaattgagcagcttttaaaattttttattctgtttttccatcatagggacagaatgctttttggcccaaatgcgggcacagaaaggtgaacttctggaaagattatcaagtgctaggaacttttcaaatatggacgatgaagagaattattctgcagcaagtaaagcagtccggcaggtaggaggctcttgctagcactgaaatttgtattctatccttagatgcctttttttttgtttgcttttttaaagcagaaaacaatatgtaacaagtattcagttgattccctgcacccccacctttggaaaatctagataccttttacaatcatgtttaagaactttttcttcccctctcccaccaagacaacacgaaactatcttttcattgactcaataattgcaacttgttacctagaaagtctgttgtggcaagtagttgattcctgaacttagatttgggaatttgaaatattggcttttatcttaatgctcccctttcttaagtgatttatcttttttgctgcagttttcctatcctcaggttgatgagtctgcttttcatctaccagggatatcactatggttaaatgttcaagaagcatatgtccttagttactttacctcattttggcataatgccactttcccaatgaactcacaaatgataaatgtaaatctggaaaatacgagtcacagtaatctttcttccacgtaaatagctgtattcttctacaggtactgcaccaactaaagagacttggaattgtgtggcaggatgtcctgccagtgaatatatattgcaaggctatggggactttactcaatacagcaatttctgaggtcattggcaaaattactgccctagaggtaagggccattagatgctacactagccttgagatgcaattcatgtcccagattgtgactttgctaagaaagtgatgttgaagaaattgttcatgtttcatgtctaactcatgctgtttttttttttttcagttttgttttatatctgttttgctagaaactgtttaatctcttttatatgaaagtaggattgaactatttctcagcctaccatctagattataaatgaggaagttagaaactgggtagtggtcctgagatgcgttgtatagtgtaaagtcatttaatttgcaagtaaactcaataatttgatttagtaaagtgaatgcagtcttgtgcaggttccatttttccaacacactgttgcagtttaaattttacatgtgattcttcaggaaaattgtctggacttggccagctgatgcctctaaatcatagattgactaaatccctatttgtaatcacatcccctgctttgcaacaagctgtgcgacattctattggagaaacaggctctttcatgcaggcaaactaaattactgacaatctgttgaaacatattttgtgtcattcttatatagaagtattgtcagagaactgatgtagtgtctagtaagttgttccaaattggttggaaaacatgttgtagctgacccacctggacagcatgcatcaaagatctgctgccctttccccacttctgagctggcccaattctattctattgtgtttcctctgtgcaaaaccaggacatatctactgaagatggtgataggttatattccttatgcaaaacagtgatggatgaaggaccccaagtatttgcacctttatctgaagaaagcaagaacaagaaatatcaagaagaggttccagtctatgtgccaaaatggatgccattcaaggaattgatgatgatgctacaagccagcttgcaagaaattggggatcggtatgtataacccttctatagaggcatataactctccatagctacaagagagtaatagtgcccttgatagcagggcttttccctgtttcctgatgttagtcatgcaagactttcatattgagtagcagtagctggggccttttcatgatctatcataatgcagatctcattaccactttcccatatttgatagcataaagacttctcatccatattattttggtcttgagtatgtggtttggcatgctgtacaagtgatctggcaactgtaagaattatagccttctgacatctggatggaaattgttgctcactttaaggagcagtggatgcttttttttttttgagacatggtcttactctgtcacccaggttggagtgcagtggctcaatcattcctcactgcagcctcaaactcgtgggctcaagggatcctcccacctcagcctcctgagtagctgggattacaggtgcctaccaccacacctggctaatttattttattttattattttatttattatttatttgttttgttttgttttagagacgaggtttctctgtgttgtccaggctggtctcaaactcctggcctcccaaagtgctaggattacaggcatgagccactgcagccagcctggatgcattttcagaattactttgatatattaacagagaagtgacttttacctgtctgaaatattgagcatcagactactgtttgattgacctgcagtctttctgcagggagtgcagtagttttagaggttaagcaccatatacctagaagggattcatcttttctcaaacgtagtggatgatgttttctctcaacaccatcagttaatgttgctgtgcccagtgagtgtatgctatatcatatcatagtgtgcagaggccgttgcacaaagcagaatagatgtgggtcagttacacattcatggatgattttatattgtcttggtagattattggtcagtatgtataccttgcataaaggactctctgtagaggccttaaggtcatctccatccctataggtacttgtctatctgctttagcttggtttactacagatgtctggttatattagaccagtcatcctagatgtgtctgagttgtttgctgcaaatattagtcatttgtacaatgtcaatgagatctctgcttgaaaaaaaatcacatcagaatacctccaatcacatttactacaaagtttagatttattcatttattatttacaagtccttagcaggtaacaaagacacctttaagtaataggctccagagggcagcagataagaatttttctttctgttgttaaagggctttcttgcagtctaagaatgatcattaattccttgttataagaaaaattataacactagtacaactcaacttctttttactgcctaggaaatttttttcccccagagatttgtgtaaatataaggctaaagttgtaaaatatacatatgaaggaatacagtagatatactctgtatttataatgtaaagaaaaagaataaatttcatgtacctattacccaacttaagaaaaataataccagtattttgaagacccatgaatccccttctccaaatgctctccatgaggggtaaccattatcttgacttttatgttatttatttccttacctttctttatagttctaccccatttacatgtatcctaaataacataaagtttagacttgcctttttttgaacttggtataagtagaatcatctgtaacttgcttcttttgttcaatattattattatgtttttgaaatctattcctttttttttttgagacagagtctcactctgtcgcccaggctggagtgcagtggtgtgatattggctcactgcaacctctgcctcccacgctccagcaagtcttctgcctcagcctcccgagtagctgggattaaaggtgcccatcaccacatccgcctaatttttgtattttcagtagagatggggttttgccatgttggctaggctggtcttgaactcctgacctcatgtgatctgccttcctcggcctcccaaagtgttgggattacaggtgtgagccaccactcctggcctgaaatccattcttgatggtatgtgtagctgcagttcattttcaccatcgcatcattccattgtacaaatatttcatagtttatttgtcctgtttagtctcattttcaccagtatttggaattatcagactggaaagtttcagctgatctaattggcatgcaatgataggttattgtcattttaatttgcatttccctaaattctaatgatgttgagcatcttttcattggtcattcatgtttcttctattatgtaatgcctgttcatatttttttgcccgttattctaataggttgtttgtggtttcactattgattcatgggacttctttatatatttttgtactagtccttcatcagttaaaattggttgcctgtggttactttgtaatacagttataaagcctaaggcatgagagtatggtcatcattattagttcaaagaggccttggtatagaataagggagaatagtctcatattcctcacttggtctcttcatctggctgtgctgataaccagttgtagtgggtgagcaaagaggtcagacacattgaggggcagttctataaagaagaggaaagatgcccaggatttgttttatttccatttcaagcaaataagcatttggatcaaacaggcaatttttaagtcttgcttatacttcagagacctaataggaaatggaactctatctttcgttttgcaggtgggcagatggaaaaggaccctggcagctgcgttctcttccagtgaagtaaaagctttaattcgtgccttgtttcagacacagaaagaagagcagctgcccttgctaaaattaaatagctccatcttcttaagaaagctatgtcttgaatatgtggattcttcccttggcataattactcccttaaagacttctttgaatcgcccattggttttggtgaaccagtacatcttggaagtttgactttacagaagaacgtcttacctcctggcctgtacgaggctttgtttaagaactgtttattaagataaattgtcaagtaaagcacctcaattcattgactttctagccatcttcctttgattagctaacaaactgtcaggcagcattatttcatgctgcttccagagccctctgggagctatatacattgtaaatgcaggccctagctttggaacgaggaattgggagattccaggagtcagggtagagaatttctgagcaaatcggagatattttaggggtgtggaggaggggaagggaggaatgggccaccatatttggccttacaggaattaaggagacttcctgtaatatttctttccaataaatattgctttttacaattaa

SEQ ID NO: 12338 - DNA, 15244 bp, Homo sapiens
aaaaaattcagatttgccacttgacactgacctggaaaatgaaaaaacatctactgtcccattggctgagatgcttggagacatgatctgggaggacttgtctgagtgcctcatcaaaaactgtttggtttattcgattccaacaaatagcagcaaattacagcaatatgaagaggtaaagagccgagacagcacagaaggttttaagacactgttgtttcttattgctgtcttttgtttttccttggagatagtttgttctttagttatacctttaagtaaattattaataaggaatagagacaaattccatataacttcatttttctcctggcttcctacctctttaactgcagaagtttgtttccttactaaatatattttctttatgttcatttatacttatatcagctataatagctattgtgtgacattttactttttgcttctttttagtgtttccttgaatgctaaaataagtatatttgttttaaagatctttctatttttactaagtagagtcagacatttctactgaagatattctttctaatgaatttaaggctggaaatatgtatatttttatacctagtaattgatggtccattctaaaatgaccagcttggtcctcatttttttatacattggatttgaaattctaatattgtaatggaatatatgtatatgattcttttcttttttttcttttgtatctcagatcatacagtccactgaagaatttgaaaatgccctaaaggaaatgagatttttaaaaggagatactacagatttgctgaaatacgctcgtaacatcaattctcattttgcaaacaaaaagtgccaggatgtgattgtggcagccagaaatctaatgacctcagaaattcataacactgtgaaggtaccagtgttatattgcattgtatatgaaacattgtatatgagaaagcaactcattttgagatgcatatagtaaagtggaagagaggatgacggttgttgagctgagtcaagttatcaatcttttttacattggttttgtctcctttaaagtggtcctaatctccacctcttccattgggtattgtgaagtgcagatacgataatgcacatgaaagccttgtataaattgaaaaagtctacatacgtgtaatggattattattgttgaagtgagacagtagattattctcatctttatttctgaaggttttaggacacaactttgtgacaggtacacttgggctacattatgtccagaaattatatcctcttatgaaagtgttgacttcatctaatagagagactagttttaaagttaaaataataaaaaggtaaataaaaagataggatataaataattacctgtaaaggcagtggacctttgaccttttttttttcatatcttacatgtatgaaataatgtatataccttgaattgggctgtggtttcttttaacataaatgtcaattgattatgtcactcttctgcagaaagtccagtgtcttcccatcttatttagagaagacccagtagccttacagtggactgcaaggccttatctgatctgcctcctattgcctctctgactctattatctattgcattcatccttcactatgctgcaggcatcctggacttatttctgttccttgaatgtgctaggcctactttgtttcagaatctctgaaccacttgttacctctgcatggaatattcttaccgcagatcacatgatttgctttttaaaaagtactttctgatcacttaaaaaaaattataacctcccctatttcctgtaccccttccttggtgtatttttctttttattatatcatcaaccaacattttatatgaattgtttgttgtttctccctctagaaagtaagctccatgagggtagagttttgttgttgtttttttttttttttttgactgttttgtttactgttatatctccagcactaagaaaatacctggtacatacatactactactatgtactcagtgctcatgtgcttactgattacctttggtaaatgaattcatatatatctcacaactccttgatgtaaacagcattactgctgaattgctctgtgactctgggcttaatcttctcaccttgttgaacctcattttcctcttctgtactgtgagaggattgaactagataatctgagtttcctacttaagtaattttgagagtttgtaaaactgcattttttctgagtactcaaatcctaatgtagcttcctctaggtcaggacatctcagcagtggcagtgttaacatttgggaccggctaattcttcgctgtgggggactgtcctatgggatatttagcagcatccctgacctctgttccctagattctagtagcacctcttccagctgtgacaagcaaaaatatctcagacattgccaaatgccccctttaagacagagttttccctgattgagaaccactgctttagattccagctggttctttctcttggcatttaggccctggaattagattttctaaacttcccaactttgaaaaaagctcctcttcccttttctaaaaaacgttttcaacttaattgcttttcatggtctgtttctcaattctctttattcccctatgtgtactcactgttttcccaaaagatctatagttgtgttttttgttgttgtttggtttttacattttgtcttaagagacatcttactaggtctaacattcttccgtcttagtttcctttgcccctcctcatgaagtcaccttttcgaatcttatgtatccaggcccactatttttcagacaaagattagcattttaaataaactctgtaagtaaattttttcatcatcattctaatcttagccataatttttgactacccagtccctgatatttgtgttctcatttaaacttcataacagctctctaaagtagatattattataccattttacagattagacagccaagtccactgacttaaatagttttattagactttgaaccttttctgccagaaaatctctgtcgaagtccagtatgtgcaaagttgttattcttgcagtgggagtagggagcctgctgcctctacatgctttatctttttttttttttttaatccctgaagcatctttgaggaacaaggttcaaaagccattattagtatattatttattttacagtgagaaaattgagatccagagaggttaaatgactttgttaaaagttagggtgaaaaatattactgttttcacattcacagcctactgttctttcatttagtcccaacaaaagaaattttctattgaagcttttttttttaataaggggaggatatgctagtttgaatgagaatgagttatttcttagactaagccaacacatgtgcctggtacaaaataatttgttcaagaatctagacagtggaaccccaaattatgctgctctgtaatactaatagtctagtatgagacagatgatttttgaaggtctttttatttagctgaaatcttaggccagttgcacagctttgctatttcagccaagattaagaatgcttggggccgggtgcgtttgctcatgcctataatccatgcactttgggaagtcgaggagggagaatgacttgagcccaggtgttcgagacccgcctgggccatatagcaagaccttttctctactaaaaataaaagtaaattagctgggtgtggtgggtgcctgtagtcccagctacatgggaggttgaggctacagtgagctatgattgtgccactgcactccagcctgggtgacagagcaagaccctgtctcaaaaagagtgcttagaagaatgtcacagtaaaggggattaagggaattgtttatcacttatgacatgctttcatctaggattcagcagtcattaaaatattgtcatatttattgaaatcttttaattactctgtagagccgtagctgtatcatgaaagcaagcagtatcttattcttcaccgtgtgcttatatttgttttttttgagacggagtcttgctctgtcgcccaggctggagtgcagtggcatgatctcagctcactacaagctccgctcactgcaagctccgcctcccgggtttgcgccattctcctgcctcagcctcccgagtagctgggactacaggcgcacgctgccacgcccggccaattttttgtatttttagtagagacggggtttcaccgtgttagccaggatggtctcgatctcctgacctcgtgatctgcccgcctcggcctcccaaagtgctgggattacaggcgtgagccgccatgcccggccgtgtgcttatatttgaattattctgaaaacaatatattttctgtatttttgtgtttgaatcttagattattcctgattctaagataaatgtgccagagttacccactcctgatgaggataacaaactggaagtacagaaagtatccaatactcagtaccacgaagtgatgaatttagagcctgaaaatacattggaccaacattccttttccttgcccacatgccgtatcagtgagtctgtgaagaaattaatggaactcgcctatcagactttactagaggcaacaaccagtagtgatcaatggtacgaattctgggttgtgtgaaaatggcaatgacttggttaaatgcatatctaactagatgtttatcaggaaaattagctggaattctttgggttttcatatcctagaagttaatgctttttctggaaacaaaacaaaacaaaacaaaaacccagtgcatcacacagatttatgtctatctctgacttttatttgcaatagcatagatgtttgagcaaggtgtaggaagtaggtgcacttgtatggatggacaaatggatttttttgacattaaaaattgttaatcactttttaacaaaaagttcttcaattgttgttgaatttttactttttatttgaattgaatgatattatatgagaaaacacatgcaaagaacttagaatcctacctggaaaatgattaatactcaaatgtttattattgtgttggcagtgggtaatagttatatcttctattccagcttgctcaggctctttagcttaacattctttttaccttttgaaacccagtccctaattcatttatattttaaatgtttatatttgaagcaataacaatttgttaggcagccaaaggtagaaggaaaagaatggaacatgccaaagatctggcttcactctttcaagatgacttctaatctatattgcattcacgttaccttaaattctactccattatcttatatggaatctgtttttgttcaataagcttcttccctactcctagactaaattgagaagaaaatggcagagcatggaccaagctgattgcagagcaggtttataaaagcttctttagtttgaatctgcatttagcaatttcattcttcctatcctcatagagaaaacagtttcagttagggtttggcccaatcaaattgcatctttagatggactttccaagttcaatttttatcgtgagataacctctttattttattctgctctaggaagaacatgtctcccaagatactttcctagctttaatgaatcattacattcacatgtccattcagagttaattgtaagaaggaagaaatgaatataggagtgactgttggcaaaatgaatataggactgtttcttcacatggcactctcctgaaatatatcagaccagaagttagagatgagggcaatatttcttaaattttttgggaacacaaaacaccaaacagtatttgtatactgactatctatggacattctttccactaaaagtaatagtttttaacaggacaaacaaaaccacagctacaatgcaacaaccccctttttcattatcaaactcaaacagcagctcctgcagcgaaaatgaaataatttaataaggtattataataatcaaatagtaacagggtttttgggtatgacttattttcctaaatatttatgaaatccctgtaagcttttaaggtacgtagcttaagatattcttatgtagaggtaagttacacaaaccttatgtttgccttttaaaagtgcattttaataataatctgtaggtgttttaaggctagatttaaagggcaaaaaatcttgagggctagattctatcctagaaatgttgattcacctccttgcattgaggtaagaaggagaaaaggtgaaagctgaaagtcagactgattctaaaagaaccaagcgagtgcttttattgataccttgccctttgcagagtgtgtcagtgagtaggtgacatttgcttgaggcttagctccatttgttactgaagggatactctgggtactggcagaacagaaattgataaatagaaaagaggctttgggttgaatgcggctcttcttacaatcattaatgcatccaggtgtttggaattgtagtctggttagtaaatactggttgagactatatttccatctagattaatggtgttttccagcaaccaaggcaggtgttctgtgcaactgtagttttagcttatgactctcactgaagatgcacttagtttaaatttttttcttgtttttagtgtattcttaggcatttctgttaagtctatgttttctttttagtgctgttcaacttttctactcagtgaggaatatcttccatttgttccatgatgttgtaccaacatatcacaagtaagtaccactgtatctcatttctatataataattgtatgtctaagatgtggaagttaagttaaaacaaataattttatattcccactaaagatattttgtttactaacattcacactaaaatgcagtaaatcattttaaaacgcatatttaaaggatttggtcatttattactaaattaattagggtattataatcttgcagtgtagttcatgatgcacattttaaaactcaaaagaactaccttgttttgctgctaagcattttcagaactgcctttacttaactttcagcctctagttcagttttctttatttgaattaaaatgtttagatgtttttcataaatatctttgataacatgtcaacaaagctattccttagccaagaactctgaatttcagagacaaaaatctgccaggcacagtggctcacacttgtaatcccagcaccttggaaggcagaggtgggaggattgtttgaggccagaagtttgagattagtttgagcaacatagtgagaccctcgcctctaattaaaacaaagaaacaaaaaaccaaaaaaaaaaacaaaagctgtttactatttaaagtattttttagttcagatttttgaatattgggatgtttttaactaggctcacctgttgtttttattataaaagcttattgtgaaccttattagttttatttgtattctctttactgtggtttaacattcttatttcattttttacttagtcaagcaaaagaaaagagaaaacatatttgcattagctgacagccttgtccttggggatttaaagacaggagtggagttagatttgcctgtctttctccttcgtataacctcggaactttagtgtgcatcagaatcacgtggaagtcttgttaaaacacagattgcttgatccatgcccaaggtttctgattcagtaggtctggaatggggcttggatttttagcaaatttccaggtgatgctgatgttgcctgtcatgggaccacattttgagaaccactgtccttagataacggttctcagctttggcagtatttttatatcgtttcatttcatttcaatttcattccattcatttaatttcatattttgagacagagtctaactctgttgcctaggctggagtgcagtggtgcaatcatggctcattgcagcctcgacctactgggctcaggtgatcttcccatcttagcctcccaagtagctgggaccacaggcacacaccaccacacctgtctaacatatttttgtaatgatagggtctgtatatgttgcccaggctggtcttgaactccttggctcaagtgatcctcctgccttggtctctcaaaatgatggtattacagttgtgagccactgcaccggccagactttgggcagtattttagaataacttatggagctttaaaaatatacatatttactctcttcctagggcatttgatttatgtctgatgtaaggcccaggtgtgtttttttctttttttttaagccccacaggtgattctgatgtgtagctggaaaagaggactatcttagttatcttagtttgttggcttctgacttgtatatcctagttttatattgagttagcaaactagaaactgttaattgaatgactgttagtgggtagatagcagaaatataagacaaaatttcttcccaagctgggtagataagactaatacgtgtagaagaattaaagtagtgattttcaatcctggatgaaaattaaaatcacctgggaagattttaaaacatataaatgctgtgatttcactcttagagcttgtgatttaatttgtttggggtaaagtctaaacatctgtggttttttaaaattcccaggtgactctaatctagtcagtttttgaaaactagtgaattagaaaataattgaacacttcattatatgactgaagtaggaatttggagaaaggtgaagtaaacctgtatttccatagatgtatccgtgtaaaatttcaaggacattattatgcatagctctgctaggttttcagtgcaaaaagttgactcaggcaaacatcttgattcccttaatctttctttattgttaatcaccaggatagttttataggataaaatcccattcaggcagaacagcctccctctgggagtgggagtgatgagattgtatcttgttatgtatagcatttagaaactagacagttattaaagcctagaaatacattagagaagttgtgactttcatcaaccccagcttcagtaacaggtggttgctttgtttttctacccctccttctggcctagggagaaccttcaaaaacttccccagttggctgctattcatcacaacaactgtatgtacattgctcaccacttgctgaccctcgggcatcagttcagattgcgtcttgcccccattctttgtgatggcactgctacttttgtggatcttgtacctggcttcaggagacttggtaactgatactttcaatgtaggaaagcatatggattatgcagcttgtcaacatagtatctttatagtttttgaatgagaaaattagaaattaggtggtggtcctgagctgtatcagaaagtgggagggcatttaatttgcaagtgtttccagttatataattttataaggtgagtgtagtctttgtgggagacttttttacttttttgtaacatgatttcatggtacgttagagttccaaactgcagtcctagtgtgcattgaatttgccaggtcaggattcacataataggatttataatgtgacaattttgtttgtattgttggtaagagctcactaatgtcagtgctagttcttttgcaaaaccccaagacagctcccccatcttacatctcccttagttttacttgggattactaaaagtcaaaagaaatgaaatgtggagtaaatcaatatgttgatcatagcagagaatctatgtgtttcacttagcttttcaattcttgatttttccctagttggtatagatacatcagaataataagtagttcctttttctatagtaatttttcttagctgactcgggctctaagcaaactactggaaaatattatctggagggtggggtttgaggaacgggctaatgtattcaaagtgattgtttctagtagctttagggcagctttatgatattatctagcaattatttttatataggcagaacagatacatggtttatgcatctcttgtctatcctggttttgcagtgtgtaattgagcagcttttaaaattttttattctgtttttccatcatagggacagaatgctttttggcccaaatgcgggcacagaaaggtgaacttctggaaagattatcaagtgctaggaacttttcaaatatggacgatgaagagaattattctgcagcaagtaaagcagtccggcaggtaggaggctcttgctagcactgaaatttgtattctatccttagatgcctttttttttgtttgcttttttaaagcagaaaacaatatgtaacaagtattcagttgattccctgcacccccacctttggaaaatctagataccttttacaatcatgtttaagaactttttcttcccctctcccaccaagacaacacgaaactatcttttcattgactcaataattgcaacttgttacctagaaagtctgttgtggcaagtagttgattcctgaacttagatttgggaatttgaaatattggcttttatcttaatgctcccctttcttaagtgatttatcttttttgctgcagttttcctatcctcaggttgatgagtctgcttttcatctaccagggatatcactatggttaaatgttcaagaagcatatgtccttagttactttacctcattttggcataatgccactttcccaatgaactcacaaatgataaatgtaaatctggaaaatacgagtcacagtaatctttcttccacgtaaatagctgtattcttctacaggtactgcaccaactaaagagacttggaattgtgtggcaggatgtcctgccagtgaatatatattgcaaggctatggggactttactcaatacagcaatttctgaggtcattggcaaaattactgccctagaggtaagggccattagatgctacactagccttgagatgcaattcatgtcccagattgtgactttgctaagaaagtgatgttgaagaaattgttcatgtttcatgtctaactcatgctgtttttttttttttcagttttgttttatatctgttttgctagaaactgtttaatctcttttatatgaaagtaggattgaactatttctcagcctaccatctagattataaatgaggaagttagaaactgggtagtggtcctgagatgcgttgtatagtgtaaagtcatttaatttgcaagtaaactcaataatttgatttagtaaagtgaatgcagtcttgtgcaggttccatttttccaacacactgttgcagtttaaattttacatgtgattcttcaggaaaattgtctggacttggccagctgatgcctctaaatcatagattgactaaatccctatttgtaatcacatcccctgctttgcaacaagctgtgcgacattctattggagaaacaggctctttcatgcaggcaaactaaattactgacaatctgttgaaacatattttgtgtcattcttatatagaagtattgtcagagaactgatgtagtgtctagtaagttgttccaaattggttggaaaacatgttgtagctgacccacctggacagcatgcatcaaagatctgctgccctttccccacttctgagctggcccaattctattctattgtgtttcctctgtgcaaaaccaggacatatctactgaagatggtgataggttatattccttatgcaaaacagtgatggatgaaggaccccaagtatttgcacctttatctgaagaaagcaagaacaagaaatatcaagaagaggttccagtctatgtgccaaaatggatgccattcaaggaattgatgatgatgctacaagccagcttgcaagaaattggggatcggtatgtataacccttctatagaggcatataactctccatagctacaagagagtaatagtgcccttgatagcagggcttttccctgtttcctgatgttagtcatgcaagactttcatattgagtagcagtagctggggccttttcatgatctatcataatgcagatctcattaccactttcccatatttgatagcataaagacttctcatccatattattttggtcttgagtatgtggtttggcatgctgtacaagtgatctggcaactgtaagaattatagccttctgacatctggatggaaattgttgctcactttaaggagcagtggatgcttttttttttttgagacatggtcttactctgtcacccaggttggagtgcagtggctcaatcattcctcactgcagcctcaaactcgtgggctcaagggatcctcccacctcagcctcctgagtagctgggattacaggtgcctaccaccacacctggctaatttattttattttattattttatttattatttatttgttttgttttgttttagagacgaggtttctctgtgttgtccaggctggtctcaaactcctggcctcccaaagtgctaggattacaggcatgagccactgcagccagcctggatgcattttcagaattactttgatatattaacagagaagtgacttttacctgtctgaaatattgagcatcagactactgtttgattgacctgcagtctttctgcagggagtgcagtagttttagaggttaagcaccatatacctagaagggattcatcttttctcaaacgtagtggatgatgttttctctcaacaccatcagttaatgttgctgtgcccagtgagtgtatgctatatcatatcatagtgtgcagaggccgttgcacaaagcagaatagatgtgggtcagttacacattcatggatgattttatattgtcttggtagattattggtcagtatgtataccttgcataaaggactctctgtagaggccttaaggtcatctccatccctataggtacttgtctatctgctttagcttggtttactacagatgtctggttatattagaccagtcatcctagatgtgtctgagttgtttgctgcaaatattagtcatttgtacaatgtcaatgagatctctgcttgaaaaaaaatcacatcagaatacctccaatcacatttactacaaagtttagatttattcatttattatttacaagtccttagcaggtaacaaagacacctttaagtaataggctccagagggcagcagataagaatttttctttctgttgttaaagggctttcttgcagtctaagaatgatcattaattccttgttataagaaaaattataacactagtacaactcaacttctttttactgcctaggaaatttttttcccccagagatttgtgtaaatataaggctaaagttgtaaaatatacatatgaaggaatacagtagatatactctgtatttataatgtaaagaaaaagaataaatttcatgtacctattacccaacttaagaaaaataataccagtattttgaagacccatgaatccccttctccaaatgctctccatgaggggtaaccattatcttgacttttatgttatttatttccttacctttctttatagttctaccccatttacatgtatcctaaataacataaagtttagacttgcctttttttgaacttggtataagtagaatcatctgtaacttgcttcttttgttcaatattattattatgtttttgaaatctattcctttttttttttgagacagagtctcactctgtcgcccaggctggagtgcagtggtgtgatattggctcactgcaacctctgcctcccacgctccagcaagtcttctgcctcagcctcccgagtagctgggattaaaggtgcccatcaccacatccgcctaatttttgtattttcagtagagatggggttttgccatgttggctaggctggtcttgaactcctgacctcatgtgatctgccttcctcggcctcccaaagtgttgggattacaggtgtgagccaccactcctggcctgaaatccattcttgatggtatgtgtagctgcagttcattttcaccatcgcatcattccattgtacaaatatttcatagtttatttgtcctgtttagtctcattttcaccagtatttggaattatcagactggaaagtttcagctgatctaattggcatgcaatgataggttattgtcattttaatttgcatttccctaaattctaatgatgttgagcatcttttcattggtcattcatgtttcttctattatgtaatgcctgttcatatttttttgcccgttattctaataggttgtttgtggtttcactattgattcatgggacttctttatatatttttgtactagtccttcatcagttaaaattggttgcctgtggttactttgtaatacagttataaagcctaaggcatgagagtatggtcatcattattagttcaaagaggccttggtatagaataagggagaatagtctcatattcctcacttggtctcttcatctggctgtgctgataaccagttgtagtgggtgagcaaagaggtcagacacattgaggggcagttctataaagaagaggaaagatgcccaggatttgttttatttccatttcaagcaaataagcatttggatcaaacaggcaatttttaagtcttgcttatacttcagagacctaataggaaatggaactctatctttcgttttgcaggtgggcagatggaaaaggacccctggcagctgcgttctcttccagtgaagtaaaagctttaattcgtgccttgtttcagaacacagaaagaagagcagctgcccttgctaaaattaaatagctccatcttcttaagaaagctatgtcttgaatatgtggattcttcccttggcataattactcccttaaagacttctttgaatcgcccattggttttggtgaaccagtacatcttggaagtttgactttacagaagaacgtcttacctcctggcctgtacgaggctttgtttaagaactgtttattaagataaattgtcaagtaaagcacctcaattcattgactttctagccatcttcctttgattagctaacaaactgtcaggcagcattatttcatgctgcttccagagccctctgggagctatatacattgtaaatgcaggccctagctttggaacgaggaattgggagattccaggagtcagggtagagaatttctgagcaaatcggagatattttaggggtgtggaggaggggaagggaggaatgggccaccatatttggccttacaggaattaaggagacttcctgtaatatttctttccaataaatattgctttttacaattaa

SEQ ID NO: 12339 - DNA, 357 bp, Homo sapiens
tggaggaatatattatgttaaggttattctgaacctgtctaggactctggattgtatctcttcatactgaaatacaatttcttattctgaaaagaggataaggggtatgacctttaggtccttttgaggtaggtgctgtctgaagaaagttgctaatacaaacctggccaacatagtgaaaccccatctctagtgaaaatacaaaaattagctgggcatggtggtgggcacctgtagtcccagctactcgggaggctcaggcagaggaattgcttgaacccgggaggtggaggttgcagtgagcggagattgcaccactgcactccagcctgggcaacggaataagaccctgtctcc

SEQ ID NO: 12340 - DNA, 197 bp, Homo sapiens
cgccattctcctgcctcagcctcccgagtagctgggactacaggcgcacgctgccacgcccggccaattttttgtatttttagtagagacggggtttcaccgtgttagccaggatggtctcgatctcctgacctcgtgatctgcccgcctcggcctcccaaagtgctgggattacaggcgtgagccgccatgcccgg

SEQ ID NO: 12341 - DNA, 357 bp, Homo sapiens; identical to SEQ ID NO: 12339

SEQ ID NO: 12342 - DNA, 231 bp, Homo sapiens
ctccgctcactgcaagctccgcctcccgggtttgcgccattctcctgcctcagcctcccgagtagctgggactacaggcgcacgctgccacgcccggccaattttttgtatttttagtagagacggggtttcaccgtgttagccaggatggtctcgatctcctgacctcgtgatctgcccgcctcggcctcccaaagtgctgggattacaggcgtgagccgccatgcccgg

SEQ ID NO: 12343 - DNA, 1146 bp, Homo sapiens
caggaaatgacctgattcctttctaatacttgctccacggggtctggtcagtcttcacagcaccaggcagacaaagggcctggaagtagaggcaggaggtcccagatctaccgacctgccaagtcacagcctctctgggctgctggagaatctgtaagcaagaccgaattgtaaaagtaaagcacagcacagctttgagacccagaagccgttgctgtgaacttactgtttttgagctgcattctggagaattgcagctccaagtttattttacccattatgtatcaaagaagaccccatatagttaatgttgccatccgcccttggacccgggtctcatgtttagaccctggcatgggctgctgcctggcagtcgtctcgtgccctgggggcttgttagacttgtgggagctcccaatccgtgtgcacactgatgtgtgacagcttgactgtagagggcccagctgtgccctccccacagggcagagggccgacccagagcccacactctctggacctcactcctgtactctccaccctgggatttcctgctcaaagggaccaagcctgcttccaggacctgtattggcctcttcccccaagccatggtgccccaaccccaagggatggccaaagagtgactgggggagttggcaaggggctgttgcgggtgtggggtggagcttggacgtgagggcttgaaggtccttgcttgtgtgcacgagactcctcacattgcaggatggagttgtggggagggtggaaagagaagagtacagacactgtcggctacaagcgttctcttttacttgtcctgggtcctaaaattgtcagagtggcctatgcgattttataaaataatttttctaggtctgtgggaatctacaattccactgttaaggtgagagagggataattagaaagttttcttagaggaggggcattggagctgggttttgacagatgcgtaggagttcagtagtagaaacagagggaattaaaactatgtaaacaaaaatatggcagaagggaagtgaggtatttgtgggaaaagatgtgctttttgctacagtctccacagtttgggatcagatcacgagggtcttgaattccagatggggggtttggtgggagggagccctcgag

SEQ ID NO: 12344 - DNA, 436 bp, Homo sapiens
ctggcatgtgaccttcctctgagaactctcaactggtaagagaaaaacacctcaagtgagcatgtgtacaattttagtaaacacactgtgcatacggcccctcccaaatgctggcaggccactgtgcatgtgaacagcctgccccaagggaaaatcaagggaggagagatgcaaccgccaggaagcatgacaacgtgtaaacaaggtcagaggtcaaaggtcagacagcccacttggattcctcaagtcacccgcttggttctcttccaagtgtactttacttccttttgttcctgctctaaaacatttttgtttgttttttaagagatagatctcgctatgttgaccatgctggtctctggtctcgtactcctggcctcaagcgatggtcccatctcagcctcccaaagtgctgggattacagggatgagccacc

SEQ ID NO: 12345 - DNA, 4167 bp, Homo sapiens
  misc_feature (268)..(1267): n equals a,t,g, or c
ttttttttttttttttttttcttttctttttttttttttttttttttcttttttttttttttttttttttttttttcttttttttttttctttttttttttttttttttttctcttctttttttttttttttttttttttctttttttttttcttctttctttttctctcttttttttttcttttttcttttttcttttttttttttttttttcttttttttttcttctttttttttttttctttttttttttttttttttttttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactacaacctccacctcccagccgcctgccttggcctcccaaagtgccgagattgcagcctctgcccggccgccaccccgtctgggaagtgaggagtgtctctgcctggccgcccatcgtctgggatgtgaggagcccctctgcccggccgcccagtctgggaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccaccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccagcagccaccccatctgggaagtgaggagcatctccgcccggcagccaccccatccgggagggaggtgagggggggtcagccccccgcccggccagctgccccatccgggagggaggtggggggtcagccccccgcccggccagccgtgccatccgggagggaggtgggggggtcagccccctgcccggccagccgcccggtccgggaggtgaggggcgcctctgcccggccgcccctactgggaagtgaggagcccctctgcccggccagccgccccgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcggccccccgcccggccagccgccccgtccgggagggaggtgggggtgtcggccccccgcccggccagccgccccgtccgggagggaggtggggggggtcagcccccctgcccggccagccgccccgtccgggaggtgaggggcgcctctgcccggccacccctactgggaagtgaggagcccctctgcccggccagccgccccgtccgcgagggaggtgggggggtcagccccccgcccggccagccgccccgtccgggagggaggtggggggggtcagcccccctgcccggccagccgccccgtccgggagggaggtggggggggtcagcccccctgcccggccagccgccccgtccgggaggtgaggggcgcctctgcccggccgcccctactgggaagtgaggagcccctctgcccggccagctgccccgtccgcgagggaggtgggggggtcagccccccgcccggccagccgccccgtccgggagggaggtggggggggtcagcccccctgcccggccagccgccccgtccgggaggtgaggggcgcctctgcccggccgcccctactgggaagtgaggagcccctctgcccggccagccgccccgtccgcgagggaggtgggggggtcagccccccgcccggccagccgccccgtccgggagggaggtggggggggtcagcccccctgcccggccagccgccccgtccgggaggtgaggggcgcctctgcccggccgcccctactgggaagtgaggagcccctctgcctggccagccgccccgtccgggagggaggtggggggtcagccccccgaccggccagccgccccgtccgggagggaggtgggggggtcagccccccgcccggccagccgccccgcccaggaagtgaggggcgcttctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaatattccatgctcatggataggaagaatcaatattgttaaaatggccatactgcccaaagcaatctacacattcaacactattcctatcaaactaccaatgtcacttttcacagaattagaaaaaaactaccacaaaattcatatggaaccaaaaaagaacctaaatagccaagataatcctaagcaaaaagaacaacgacagaggtatgacattacctgacttcaaactatgctatcagactacaagaaccaaaagagcatggtacttgtacgaaaacagacacatagaccaatggaacagattagagagcccagaaataaagctgcacacctataaccatctgatctttgacaaagttgacaaaaataagcaatgggaaaaggactccctatgtaacaaatgatgttgggataactagctagccatatgcagaagaatgaaactgaaccccaacttttcaccatacataa

SEQ ID NO: 12346 - DNA, 384 bp, Homo sapiens
ccttgggaagctgttgatctatgaccttacaccccaacccggtgctctctgaacatgtgctgtgtcagctcaggattaaatggattaagggcggcgcaagatgtgctttgttaaacagatgcttgaaggcagcatgctcgttaagagtcatcaccactccctaatctcaagtaccgagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaataaaaaaataaataaaaattaaaaaaaacgaaaaacaaaataagaaactgg

SEQ ID NO: 12347 - DNA, 572 bp, Homo sapiens
acccctgtctgggaggtgtacccaacagctcagtgagaacagggccatgatgacaatggcagtttttgtggaatagaaaggggggaaaggtggggaaaagattgacaaagccgatggttgccgtgtctgtgtagaaagaagtagacatgggagacttttcattttgttctgtactaagaaaaattcttctgccttgggatcctgttgatctgtgaccttacacccaaccctgtgctctctgaaacatgtgctgtgtccactcagggttaaatggattaagggcggtgcaagatgtgctttgttaaacagatgcttgaaggcagcatgctggttaagagtcatcaccactccctaatctcaagtacccagggacacaaacactgcggaaggccacaggatcctctgcctaggaaaaccagagacctttgttcacttgtttatctgctgaccttccctccactattgtcctatgaccctgccaaatccccctctgcaagaaacacccaagaatgatcaataaaaataaataaataaagaaagaaagaaagaactctccaaaaattatactaaaa

SEQ ID NO: 12348 - DNA, 429 bp, Homo sapiens
tgggagacttttctttttgttctgtactaagaaaaatcttctgccttgggatcctgttgatctatgaccttacccccaaccccttgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttacctgctgaccttccctccactattgtcctatgaccctgccaaatccccctctgcgagaaacacccaagaatgatcaattaaaaaaaaaaaaaagaatttgacaaagtaaaaaaaaaaaaaaaaaaaaaaaaaggggg

SEQ ID NO: 12349 - DNA, 353 bp, Homo sapiens
ccccaaccccagtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacccttgttcacatgtttatctgctgaccttccctccactattgtcctatgaccctgccaaatccccctcttcgagaaacacccaagaatgatcaataaatactaaaaaaataaataaataaataaataaaggtgctgagaacataaaaaaa

SEQ ID NO: 12350 - DNA, 315 bp, Homo sapiens
  misc_feature (34)..(34): n equals a,t,g, or c
cactcagggttaaatggattaagggcggtgcaanatgtgctttgttaaacagatgcttgaaggcagcatgctcgttaagagtcatcaccaatccctaatctcaagtaatcagggacacaaacacttcggagggccgcagggtcctctgcctaggaaaaccggagacctttgttcacttgtttatctgctgaccttccctccactattgtcccatgaccctgccaaatccccctctgtgagaaacacccaagaattatcaataaaaaaataaattaaagaaaaaaaaaaaaagtgaaaaagcttacaaaaaaaaaa

SEQ ID NO: 12351 - DNA, 466 bp, Homo sapiens
ggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaaaaattaaaaaacaaaaaacaaaaaacaaagttaa

SEQ ID NO: 12352 - DNA, 420 bp, Homo sapiens
tgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaaaaaaaattattaaaaaaaaaaaaagataa

SEQ ID NO: 12353 - DNA, 399 bp, Homo sapiens
cattctgtactaagaaaaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaaaccggagacctttgttcacttgtttatctgctgaccttccgtccactcttgtcctctgaccctgccaaatccccctctgcgagaaacacccaagaatgatcaataaaaaaaataaaaataaaataaaaataaaaataaataaataaaat

SEQ ID NO: 12354 - DNA, 308 bp, Homo sapiens
tccactcagggttgaatggttaaagggcggtgcaagatgtgctttgttaaacagatgcttgaaggcagcatgctccttaagagtcatcaccactcctaatctcaagtacccagggacacaaacactgcggaaggccgcagggtcctctgcctaggaaaaccagagacctttgttcacttgtttatctgctgaccttccctccactattgtcctgtgaccctgccaaatcctcctctgtgagaaacacccaagaatgatcaattaaaaaataaataaataaataaataaaataaaaagtaaggaaaaga

SEQ ID NO: 12355 - DNA, 579 bp, Homo sapiens
cccggcacgacccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcattaagaggcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaataaataaataaataaataataataataataaataaaataaaaataaaaa

SEQ ID NO: 12356 - DNA, 538 bp, Homo sapiens
ttgagaacaggccatgatgacaatggcagttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctgtgaccttacacccaaccctgtgctctctgaaacatgtgctgtgtccactcagggttaaatggattaagggcggtgcaagatgtgctttgttaaacagatgcttgaaggcagcatgctggttaagagtcatcaccactccctaatctcaagtacccagggacacaaacactgcggaaggccacaggatcctctgcctaggaaaaccagagacctttgttcacttgtttatctgctgaccttccctccactattgtcctatgaccctgccaaatccccctctgcaagaaacacccaagaatgatcaataaaaataaataaataaagaaagaaagaaagaactctccaaaaattatactaaaa

SEQ ID NO: 12357 - DNA, 394 bp, Homo sapiens
gaaaaaacctcctttcttgtgatcctgttgaacggtgaccctacccccaccctgtgctctctgaaacatgtgctgtgtccactcagggttaaatggattaagggtggtgcaagatgtgctttgttaaacagatgcttgaaggcagcatgctagttaagagtcatcaccactccctaatctcaagtacccagggacacaaacactgcggaaggccgcagggtcctctgcataggaaaaccagagacctttgttcacttgtttatctgctgaccctccctccactattgtcctatgaccctgccaaatccccctctgtgagaaacacccaagaatgatcaataaaaataaataaataaataaataaataaataaataaataaataaaaataaaata

SEQ ID NO: 12358 - DNA, 368 bp, Homo sapiens
ttgatctgtgaccttacccccaaccctgtgctctctgaaacatgtggtgtatccactcagggttgaatggattaagggcggtgcaagatgtgctttgttaaacagatgcttgaaggcagcatgctcgttaagagtcatcaccactccctaatctcaagtacccagggacacaaaaactgcagaaggccgcagggtcctctgcctaggaaaaccagagacctttgtgcacttgtttatctgctgaccttccctccactattgtcctgtgatcctgccaaatccccctctgcgagaaacacccaagaatgatcaattaaaaaaaaaaaagaaaagaaaaaaaaaaaaaaatgaacaaaacctccaagaag

SEQ ID NO: 12359 - DNA, 437 bp, Homo sapiens
tgtagaaagaagtagacacgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcaggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaaaaaaaaaaaagaaaaaaaaaaaaaaaga

SEQ ID NO: 12360 - DNA, 372 bp, Homo sapiens
ctgttgatatatgaccttacccccaaccctgtgctctctgaaacatgtgctgtgtccactcagggttaaatggattaagggcagtgcaagatgtgctttgttaaacagatacttgaaggcagcagactcgttaagagtcatcaccactccctaatctcaagtacccagggacacaaacactgcggaaggctgcagggtcctctgcctaggaaaaccagagacatttgttcacttgtttatctgctgaccttccctccactattgtcctatgaccctgccaaatccccctctgcgagaaacatccaagaatgatcaataaaaaaaaaattccaaaaaaaaaaaaaaaagaaataggaaggaagataaaatgag

SEQ ID NO: 12361 - DNA, 455 bp, Homo sapiens
aaggttgccaagtctgtgagaaagaagtagacaggggagacttttcatttgttctgcactaagaaaaattcctctgcttgggatcctgttgatctgtgacctacccccaacccggtgctctctgaaacatgtgctgtgtccactcagggttaaatggattaagggcggtgcaagatgtgctttattaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaagaaaaatttaaactgaaaaacacaataa

SEQ ID NO: 12362 - DNA, 459 bp, Homo sapiens
tgagaaatcggatggtgctgtgtctgtgtagaaagaagtagacatgggagacttttcattttgttctgtactaagaaaaattcttttgccttgggatcctgttgatctatgaccttgcccccagccctgtgctctctgaaacatgtgctgtgtccactcacggttaaatggattaagggtggtgcaagatgtgctttgttaaacatatgcttgaaggcagcatgctcattaagaatcatcaccactccctaatctcaagtacccagggacacaaacactgcggaaggctgcagggtcctctgcctaggaaggccagagacctttgttcacttgtttgtctgctgaccttccctccactattgtcctatgaccctgccaaatccccctctgcgagaaacacccaagaatgatcaataaaaataaaataaaataaaataaaatggagcaaaaagaaaaaga

SEQ ID NO: 12363 - DNA, 312 bp, Homo sapiens
gtccactcagggttaaatgattaaaggcggtgcaagatgtgctttgttaaacagatgcttgaaggcagcatgctcgttaagagtcatcgccactccctaatctcaagtacccagggacacaaacactgcggagggcgcagggtcctctgcctaggaaaaccagagacctttgttcacttgtttatctgctgaccttccctccactattgtcctatgaccctgccaaatccccctctgcgagaaacacccaagaatgatccataaaaaaaaataaaaaaataaaaataaaaaaaaaagaactgaataaacata

SEQ ID NO: 12364 - DNA, 399 bp, Homo sapiens
ctaagaaaaattcttctgccttgggatcctgttgatcggtgaccttacccccaaccctgtgctctctgaaacatgtgctgtatccactcagggttgaatggattaagggcggtgcaagatgtgctttgttaaacagatgcttgaaggcagcatgctccttaagagtcatcaccactccctaatctcaagtacccagggacacaaacactgcagaaggccgcagggtcctctgcctaggaaaaccagagacctttgttcacttgtttatctgctgaccttccctccactattgtcctgtgaccctgccaaatccccctctgcgagaaacacccaagaatgatcaattaaaataataataataataataataataataataataataaaattaaaaaaaaa

SEQ ID NO: 12365 - DNA, 333 bp, Homo sapiens
tggggcatgtgctgtgtccactcagggttgaatggattaagggcggtgcaagatgtgctttgttaaacagatgcttgaaggcagcatgctcattaagagtcatcaccactccctaatctcaagtacccagggacacaaacactgcggaaggctgcagggtcctctgcctaggaaaaccagagacctttgctcacttgtttatctgctgaccttccctccactattgtcctatgaccctgccaaatccccctctgcgagaaacacccaagaatgatcaataaaaaaaaaaaaaaaaagaatttttataattttaatgagaaaaattaagaaaca

SEQ ID NO: 12366 - DNA, 455 bp, Homo sapiens
tgttactgtgtctgtgtagaaagaagtagacataggagactccatttgttctgtactaagaaaaattcttctgccttgggatgctgttaatctataaccttacccccaaccccgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacccttgttcacatgtttatctgctgaccttccctccactattgtcctatgaccctgccaaatccccctcttcgagaaacacccaagaatgatcaataaatactaaaaaaataaataaataaataaaggtgctgagaacataaaaaaaaatg

SEQ ID NO: 12367 - DNA, 451 bp, Homo sapiens
aaagaggtagacatgggagacttttcattttgttctgtactaagaaaaattcttctgcctgtgatcctgttgatctgtgaccttacccccaaccctgtgctctctgaaacatgtgctgtgtccactcagggttaaatggattaagggcggtgcaagatgtgctttgttaaacagatgcttgaaggcagcatgcttgttaagagtcatcaccactccctaatctcaagtacccagggacacaaacactgcggaaggcctcagggtcctctgcctaggaaaaccagagacctttgttcacttgtttatctgctgaccttccctccactattgtcctatgaccctaccaaatccccctctgcaagaaacacccaagaatgatcaataaaaaataaataaataaataaaaataataataaataaataaataaaaataaaaataaaaaataaaaaa

SEQ ID NO: 12368 - DNA, 381 bp, Homo sapiens
ccttgggatgctgttgatctatgaccttacccccaacctggtgctctctgaaacatgtgctgtgtccactcagggttaaatggattaagggcggtgcaagatgtgctttgttaaacagatgcttgaaggcagcatgctcgttaagagtcatcaccactccctaatctcaagtatccagggacacaaacactgcggaaggccccagggtcctctgcctaggaaaaccagagacctttgttcacttgtttatctgctgaccttccctccactattgtcctatgaccctgccaaatgcccctctgcgagaaacacccaagaatgatcaattaaaaaaaaaatatataaatcaaaaccaaaaagaaataaaaaaataaaaaaata

SEQ ID NO: 12369 - DNA, 371 bp, Homo sapiens
ctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgcgaaatccccctctgtgagaaacacccaagaattatcaataaaaaaataaatttaataaaaaaaaaaaaaaccaaccagaaaaaaaaaaaaaaa

SEQ ID NO: 12370 - DNA, 372 bp, Homo sapiens
tgggatgctgccgatctatgaccttacccccaacccggtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggtaggccgcagggtcctctgcctaggaaaaccagagacctttgttcacttgtttatctgctgaccttccctccactattgtcctatgaccctgccaaatccccctatgcgagaatcacccaagaatgatcaataaaaaataaaaataaataaaaataaaataaaataaaataaaatgaaga

SEQ ID NO: 12371 - DNA, 639 bp, Homo sapiens
gggaggtggggggtgcctccgcccggccgccccttctgggaagtgaggagcccctctgcctggccaccaccccgtctgggaggtgtacccaacagctcattgagaacgggccatgatgacgatggcagttttgtggaatagaaaagggggaaaggtggggaaaagatagagaaatcagattgttgctgtgtctgtgtagaaaggagtagacatgggagacttaattttgttctgtactaagaaaaattcttctgccttgggatgctgttgatctatgaccttacccccaaccctgtgctctctgaaacatgtgctgtgtccactcagggttaaatggattaagggcggtgcaagatgtgctttgtcaaacagatgcttgaaggcggcatgctcattaagagtcatcaccactccctaatctcaagtacccagggacacaaacactgtggaaggctgcagggtcctctgcctaggaaagccagagacctttgttcacttgtttacctgctgaccttccctccactattgtcctatgaccctgccaaatccccctctctgagaaacacccaagaatgatcaataaaaaaaaaataataaaaaaaaaaagaagaagaagaagaaaagaggaagaggaagagg

SEQ ID NO: 12372 - DNA, 441 bp, Homo sapiens
aaaaagaggtgaacatgggagacttttcatttgttcttgtactagaaaaaattcttcttccttgggatcctgttgatctgggccttgcccccagccctgtgctctctgaaacatgtgcctgtgtccactcagggttgaatggataaagggtggtgcaagatgtgctttgttaaacagatgcttgaaggcagcatgctcgttaagagtcatcaccactccctaatctcaagtacccagggacacaaacactgcagaaggccgcagggtcctctgcctaggaaaaccaaagacctctgttcacttgtttatctgctgaccttccctccactattgtcctgtgaccctgccaaatccccctctgcgagaaacacccaagaatggtccataaaaaaaaaaaaaaaaaaaggaaagaaaaagaagaagaagaaaaaaaaaaaaagg

SEQ ID NO: 12373 - DNA, 521 bp, Homo sapiens
tttatggaatagacagggggaaaggtgggcaaaagattgagaaatcggatggttgccgtgtctgtgtagaaagaggtagacatgggagacttttcattttgttctgtactaagaaaaattcttctgccttgtgatcctgttgatctgtgaccttacccccaaccctgtgctctctgaaacatgtgctgtgtccactcagggttaaatggattaagggcggtgcaagatgtgctttgttaaacagatgcttgaaggcagcatgcttgttaagagtcatcaccactccctaatctcaagtacccagggacacaaacactgcggaaggcctcagggtcctctgcctaggaaaaccagagacctttgttcacttgtttatctgctgaccttccctccactattgtcctatgaccctaccaaatccccctctgcaagaaacacccaagaatgatcaataaaaaataaataaataaataaaaataataataaataaataaataaaaataaaaataaaaaataaaaaa

SEQ ID NO: 12374 - DNA, 254 bp, Homo sapiens
gcttgaaggcagcatgctcgttaagagtcatcaccactccctaatctcaagtacccagggacacaaacactgaggaaggccgcagggtcctctgcctaggaaaaccagagacctttgttcacttgtttagctgctgaccttccctccactattgtcctaagaccctgccaaatccccctctgtgagaaacacccaagaattatcaataaaaaataaataaataaataaataaattaaaaaatatatatatataa

SEQ ID NO: 12375 - DNA, 435 bp, Homo sapiens
tctgtgtaaaaagtagaagactgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatactctttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaaaaaaaaaagaactggtaaa

SEQ ID NO: 12376 - DNA, 354 bp, Homo sapiens
cttatccccaaccctgtgctctctgaaacaagtgctgtgtcactcagggttaaatggattaagggcggtgcaagatgtgctttgttaaacagatgcttgaaggcagcatgctccttaagagtcatcaccactccctaatctcaagtacccagggacacaaacactgcggaaggccacagggtcctctgtctaggaaaaccagagacctttgttcacttgtttatctgctgaccttccctccactattgtcctatgaccctgccaaatccccctctgcgagaaacacccaggaatgatcaataaaaaaataaataaataaaaaaataaataaataaatcaataaaaaataaaaaa

SEQ ID NO: 12377 - DNA, 418 bp, Homo sapiens
tgggagacttttcattttgttctgtactaagaaaaatcttccgccttgggatcctgttgatctgtgaccttacccccaaccctgtgctctctgaaacatgtgctgtgtccactcagggttaaatggattaagggcggtgcaagatgtgctttgttaagcagatgcttgaaggcagcatgctcgttaagagtcatcaccactccctaatctcaagtacccagggacacaaacactgcggaaggccacagggtcctctgcctaggaaaaccagagacctttgttcacttgtttatctgctgaccttccctccactattgtcctatgaccctgccaaatccccctctgtgagaaacacccaagaattatcaataaaaaataaatttaaaaaaataaataaataaaaaaaataaaataaaaa

SEQ ID NO: 12378 - DNA, 360 bp, Homo sapiens
gaccttaccccccaaccctgtgctctctgaaacatgtaccgtgtccactcagggttaaatggattaagggctgtgcaagatgtgctttgttaaacagatgcttgaaggcagcatgctccttaagagtcatcaccactccctaatctcaagtacccagggacacaaacactgcggaagttcccagggtcctctgcctaggaaaaccagagacctttgttcacttgtttatctgctgaccttccctccactattgtcctatgaccctgccaaatccccctctgcgagaaacacccaagaacgatcaaaaaaaaaaaaaaaaaaaaaatgtaaatcataattattctcagcaaagtattaaaa

SEQ ID NO: 12379 - DNA, 284 bp, Homo sapiens
taagggcggtgcaagatgtgctttgttaaacagatgcttgaaggcagcatgctcgttaagagtcatcaccactccctaatctcaagtacccagggacacaaatactgtggaaggcagcagggtcctctgcctaggaaaaccagagaccttttttcacttgtttatctgctgaccttccctccactattgtcctatgaccctgccaaatccccctctgcgagaaacacccaagaatgatcaattaaaaaaaaataataaattaaaaaaaaaaaaagaaaatctaa

SEQ ID NO: 12380 - DNA, 410 bp, Homo sapiens
gagacttcattttgttctgtactaagaaaaattcttctgccttgggatgctgttgatctatgaccttacccccaaccctgtgctctctgaaacatgtgctgtgtccactcagggttaaatggattaagggcggtgcaagatgtgctttgttaaacagatacttgaaggcagcatgctccttaagagtcatcaccactccctaatctcaagtacccagggacacaaacactgcagagggccgcagggtcctctgcctaggaaaaccagagacctttgttcacttgtttgtatgttgaccttccctccactgttgtcctgtgaccctgccaaatccccctctgcgagaaacacccaagaatgatcaatgaaaaaaataaaaataaaaaaaataaaaaaaaggaagttaaata

SEQ ID NO: 12381 - DNA, 419 bp, Homo sapiens
agacttttcattttgttctgtactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaattaaaaaaaaaataaaataaataaaataaaataatacttccaatttaaactaa

SEQ ID NO: 12382 - DNA, 465 bp, Homo sapiens
ggatggttgctgtgtctgtgtggaaggaagtagacatgggagacttttcattttgttctgcactaagaaaaattcctctgccttgggatcctgttgatctgtgaccttacccccaaccctgtgctctctgaaacatgtgctgcgtccactcagagttaaatggattaagggcggtgcaagatgtgctttgttaaacagatgcttgaaggcagcatgctcgttaagagtcatcaccaatccctaatctcaagtaaccagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaattaaaaaaaaaaaaaataaataaataaataaataaataaataaataaaagaaaatgtgg

SEQ ID NO: 12383 - DNA, 382 bp, Homo sapiens
aattcctccgccttgggatcctgttgatctgtgacacttacccccaaccctgtgctctctgaaacatgtgctgtgtccactcagggttaaatggattaagggcggtgcaagatgtgctttgttaaacagatgcttgaaggcagcatgctcgttaagagtcagcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaataaacaaacaaacaaaaaaaaaaa

SEQ ID NO: 12384 - DNA, 414 bp, Homo sapiens
catttagttctgtactaagataaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggcggcagggtcctctgcctaggaaaaccagagacctttgttcacttgtttatctgccaaccttccctccactattgtcctatgaccctgccaagtccccctttggggggaacaccccaggatggtccaaaaaaggaaaaaaaaaaaaaaaaaaaagaaaacaaattctaagaggttataaaagg

SEQ ID NO: 12385 - DNA, 218 bp, Homo sapiens
ccactccctatctcaagtacccagggacacaaacactgcggaaggccgcagggtcttctgcctaggaaaaccagagacccttgttcacttgtttatctgctgaccttccctccactattgtcctatgaccctgccaaatccccctctccgagaaacacccaagaatgatcaataaatactaaaaaaaaaaaaaaaaaaaaaagtaaaagttcataaaa

SEQ ID NO: 12386 - DNA, 4129 bp, Homo sapiens
gcagtggcgtgatcttggctcactgcagccttgaactcccaggctcaagtggatcctccctcttcagccccgcaagtagctgggactacaggagtgcaccaccacccccatctaatatttttttgttgttattctagggacgagttctcactatgttgcccaggctggcctcgaactcctgggctcaagcaatcctcctgcgttggcctcccaaagtcctgggattacaggtgtaagccactacggctggcctattattgctgtattctaacttattcatctcctatggtacgatttttcattttttctaatttatgttttcatacttttatatatcgtgctatgttaaatagcttcatatagttttcttttatgcagtgattttagcctcttgatgatcttctttatcagttatggcactggtgacttaaaatggatgttcttcctctgtcattcctccgacgtttgttagctggcatttttaacaaagagctttcacttctcctttttatttcggtatctctgctgactaatgcacttgcattttattccatgggttattttccatcactgtcattgttctttctgatgcctatgctgtcccagattcgaccgtgggagccttcagcctgtgtcctgtgtcctttcaactgtctctattaatctttgagcatttcttactttctcacagaacaaaagtatccaggcttatgttgccctctttctgccttgggcctggactcagccatttctcttaaggattatcttaagcatcatttagcttagaaattaatcagctttccaaaagatgtacaaaatgctaactttccttttgagcaatttttttctaaaattagattttttttagaggattattcctttattctttctataagttcatttgaagtgtggtgttaggaaaccatgcctgagtttaactcttccagtgtttatcagatcattttttccctgtgctgtatcatcttaaacatcttaaacaattccttgacatttttatatttctttgtattttcattgactgtattgccatttctagattagctggttaatgtacaaattggattattttgcatttccttggtaatataggctgttgatgctaaaggaggaaaaacaaatggacttgaaaactggtcgaatgcatcggaaagccatttttggagatgattctatgctaacatcctctctcctttcttgatctcttaattttttttttcttacccaagtatatacaggttgattttgtctttctggaagatccaagatctttggtttagagatatattctcttaatgttaactggtattagaatactcttttctgtattttatttcaatacacttgagaatagaaatgattgtattttcttttaacttgtgcagtagagtgtggcatacaaatgttgtattctcagtatttcaaaaaattaccttcttactgtacaagttgtattcagcatataaagtctattccagctttgttgtagatgcagtgtgattattacatgccgataaggtatgaattggagatgggatccaaaattactgtacttagtgtaatttttaagctaattacagggttggtggtgaatattttacttctgcaaaatgaaaacagcatttcatcagaagttgttttatggtctttcagacattttattgtatatctttggtgctttttgcccatgaagtatctcttttgtgtgtttgtgtgtatgtgtattgatctgctgtaaatttcacagcactcattgtcagggatcagcagaatcaggcctaggcagagagctgagcagtactctcagtacgtctctgtgtccttgttgccacattatctctgttgtttatttataagttggagaactctctgacctgtaacaaaggttggataggtcagagacaattgggagaggaatcctctgctctattgtcacctgtgcctcactccaaaatatgctctgaaatcaatatttaaatattaaatttgtatggtgaatgtattcttttttaatgttaattaaatgattggtcagcccacttaatatttacaatgcaggacttactttgcgtattctctgtcttgtatttttgctttatttaagctaggctagcctccaagctggaagctgaattgacagttgaaaaataatgacatgtatacaaggtatgtttgaaggattgcagatgcaggggcaccatatgctaaaggagtgttggaagctcactgcagaagatgacaaaagcagactgatatgtattatttgctgaaatataagctggaggcacaggtgaagattgccaaacctaatgaacagtttggcaaataagacaggctgtcaggccatggcagttcagcagtgggcgtgctgcctgtgaaccaagtcatttgttccagaggactacacttaaataccacaaataaaatcttccttgtcactgatatcacagtgaaatagatgttgtctttcagatttctggttgaattaccagccattaacatctggtgatttgggttgtaaaattatttttagttttgcctgttcatatttcatccagaaagcccaaacaagatatattttcccacataagaatgtaagcagtataatgccccgtccgggagggaggcggggggcagcccccacctggccagccgccccttccaggagggaggtggggggcgcctctgcccggctgccccgtctgggatgtggggggggcccctctgcccggccgccaccccgtctgggaggtgtacccagcagctcattgagaacgggccatgatgacgatggcggttttgtcgagtggaaggaggggaagtgtggggaaaggaaaaagaaatcagattgttgctgtgtctgtgtagaaagaagtagacatgggagactccattttgttctgtactaagaaaaattcttctgccttgggatgctgttaatctatggccttacccccaaccccttgctctctgaaacgtgctgtgtccactcagggttaagtggattaagggcggtgcaagatgtgctttgttaaacagatgcttgaaggcagcatgctccttgagagtcatcaccactccctaatctcaaatacccagggacacaaaaactgcggaaggccgcagggtcctctgcctaggaaaaccagagacccttgttcacatgtttatctgctgaccttccctccactattgtcctatgaccctgccaaatccccctctccgagaaacacccaagaatgatcaataaatactaaaaaaaaaaaaaaaaaaaaaaaaagaactctgcaagaacatctgccccagaactgcctgtccaacctggactgacatcatccttgttattgatctttgtagccaaatataattattttaaaacaaacaaaaaagaagaatgtaagcagtataagactttaaaacacacaaatgaaaaatatacatgactacatgcttcagtgaactaaaactttcatctgtgatctttattttgcaacgttctgaagtaacattacagtcttttcagtgtgctgtgtcatttatatcccttactttatcctgggaatcctgtattgccattgagcatatgcaaattgagacatgtgcatagcttctccccgttgagcccatcagtggggaggagctatgtaccggggacatttggcaaagattttcatgagtctgttggatgtaacagctccttaagaaaacctcagtttaccttccctattttttaccatttgtaaaactaaggctcagtgatgtaaaatataacacattctgtgctgtggcataactgcagcttaggtttttatattcaagacaagcagaggtatagttgaaaaggtatgaacacttattatgcttcaagatccctttgttggtttagttgtggcattttagaacagcggacttgggactaaagcatctttctatctgggatcagtatttctaagttgcctttaagctgaataaacatttggtttttatatttaattgcttcgatgtgaaacactgcaatttaaaaaattacacatatgtaatacagtattttacactaaataatagtgactggcagtccattggccgaagaagtattatttttcagatattc

SEQ ID NO: 12387 - DNA, 649 bp, Homo sapiens
cagccgccccgtccgggaggtgaggggcgcgtctgcccggccgcccctgctgggaagtgaggagcccctctgcccggccaccaccccgtctgggaggtgtgcccagcggctcattgagaacgggccatgatgacagtggcagttttgtggaatagaaaggggggaaaggtggggaaaagattgagaaatcggatggttgccgtgtctgtgtagaaagaagtagacatgggagacttttcattttgctctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagtgtcatcaccactccctaatctcaagtacccagggacacaaacactgccgaaggcctcagggtcctctgcctaggaaaaccagagacctttgttcacttgtttatctgctgaccttccctccactattgtcctatgaccctgccaaatccccctctacgagaaacacccaagaatgatcaattaaaaaaaaataaaaataaaaataaaaataaaagaaaaaaaaaaaaagaaaa

SEQ ID NO: 12388 - DNA, 374 bp, Homo sapiens
tgccttgggatcctgttgatctgtgaccttacccccaaccctgtgctctctgaaacatgtgctgtgtccactcagggttaaatggattaagggcggtgcaagatgggctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatacccctctgtgagaaacacccaagaattatcaataaaaaaataaatttaataaaaaaaaaaaaaaaaacaggtgaaaaa

SEQ ID NO: 12389 - DNA, 428 bp, Homo sapiens
gtagacatgggagacttttcattttgttccgtactaagaaaaattcttctgccttgggatcctgctcatcggtgaccttacccccaaccctgtgctctctgaaacatgtgctgtgtccactcagagttgaatggattaagggcggtgcaagatgtgctttgttaaacagatgcttgaaggcagcatgctcgttaacaatcatcaccactccctaatctcaagtacccagggacacaaacactgaggaaggccacagggtcctctgcctaggaaaaccagagacctttgttcacttgcttatctgctgaccttccctccactattgtcctatgaccctgccaaatccccctctgcgagaaacacccaagaatgatcaataaaaaataaaaaataaaaaaaaaggtaaaaaaaaaaaaaaaaaaaaagaa

SEQ ID NO: 12390 - DNA, 4461 bp, Homo sapiens
gcagtggcgtgatcttggctcactgcagccttgaactcccaggctcaagtggatcctccctcttcagccccgcaagtagctgggactacaggagtgcaccaccacccccatctaatatttttttgttgttattctagggacgagttctcactatgttgcccaggctggcctcgaactcctgggctcaagcaatcctcctgcgttggcctcccaaagtcctgggattacaggtgtaagccactacggctggcctattattgctgtattctaacttattcatctcctatggtacgatttttcattttttctaatttatgttttcatacttttatatatcgtgctatgttaaatagcttcatatagttttcttttatgcagtgattttagcctcttgatgatcttctttatcagttatggcactggtgacttaaaatggatgttcttcctctgtcattcctccgacgtttgttagctggcatttttaacaaagagctttcacttctcctttttatttcggtatctctgctgactaatgcacttgcattttattccatgggttattttccatcactgtcattgttctttctgatgcctatgctgtcccagattcgaccgtgggagccttcagcctgtgtcctgtgtcctttcaactgtctctattaatctttgagcatttcttactttctcacagaacaaaagtatccaggcttatgttgccctctttctgccttgggcctggactcagccatttctcttaaggattatcttaagcatcatttagcttagaaattaatcagctttccaaaagatgtacaaaatgctaactttccttttgagcaatttttttctaaaattagattttttttagaggattattcctttattctttctataagttcatttgaagtgtggtgttaggaaaccatgcctgagtttaactcttccagtgtttatcagatcattttttccctgtgctgtatcatcttaaacatcttaaacaattccttgacatttttatatttctttgtattttcattgactgtattgccatttctagattagctggttaatgtacaaattggattattttgcatttccttggtaatataggctgttgatgctaaaggaggaaaaacaaatggacttgaaaactggtcgaatgcatcggaaagccatttttggagatgattctatgctaacatcctctctcctttcttgatctcttaattttttttttcttacccaagtatatacaggttgattttgtctttctggaagatccaagatctttggtttagagatatattctcttaatgttaactggtattagaatactcttttctgtattttatttcaatacacttgagaatagaaatgattgtattttcttttaacttgtgcagtagagtgtggcatacaaatgttgtattctcagtatttcaaaaaattaccttcttactgtacaagttgtattcagcatataaagtctattccagctttgttgtagatgcagtgtgattattacatgccgataaggtatgaattggagatgggatccaaaattactgtacttagtgtaatttttaagctaattacagggttggtggtgaatattttacttctgcaaaatgaaaacagcatttcatcagaagttgttttatggtctttcagacattttattgtatatctttggtgctttttgcccatgaagtatctcttttgtgtgtttgtgtgtatgtgtattgatctgctgtaaatttcacagcactcattgtcagggatcagcagaatcaggcctaggcagagagctgagcagtactctcagtacgtctctgtgtccttgttgccacattatctctgttgtttatttataagttggagaactctctgacctgtaacaaaggttggataggtcagagacaattgggagaggaatcctctgctctattgtcacctgtgcctcactccaaaatatgctctgaaatcaatatttaaatattaaatttgtatggtgaatgtattcttttttaatgttaattaaatgattggtcagcccacttaatatttacaatgcaggacttactttgcgtattctctgtcttgtatttttgctttatttaagctaggctagcctccaagctggaagctgaattgacagttgaaaaataatgacatgtatacaaggtatgtttgaaggattgcagatgcaggggcaccatatgctaaaggagtgttggaagctcactgcagaagatgacaaaagcagactgatatgtattatttgctgaaatataagctggaggcacaggtgaagattgccaaacctaatgaacagtttggcaaataagacaggctgtcaggccatggcagttcagcagtgggcgtgctgcctgtgaaccaagtcatttgttccagaggactacacttaaataccacaaataaaatcttccttgtcactgatatcacagtgaaatagatgttgtctttcagatttctggttgaattaccagccattaacatctggtgatttgggttgtaaaattatttttagttttgcctgttcatatttcatccagaaagcccaaacaagatatattttcccacataagaatgtaagcagtataatgccccgtccgggagggaggcggggggcagcccccacctggccagccgccccttccaggagggaggtggggggcgcctctgcccggctgccccgtctgggatgtggggggggcccctctgcccggccgccaccccgtctgggaggtgtacccagcagctcattgagaacgggccatgatgacgatggcggttttgtcgagtggaaggaggggaagtgtggggaaaggaaaaagaaatcagattgttgctgtgtctgtgtagaaagaagtagacatgggagactccattttgttctgtactaagaaaaattcttctgccttgggatgctgttaatctatggccttacccccaaccccttgctctctgaaacgtgctgtgtccactcagggttaagtggattaagggcggtgcaagatgtgctttgttaaacagatgcttgaaggcagcatgctccttgagagtcatcaccactccctaatctcaaatacccagggacacaaaaactgcggaaggccgcagggtcctctgcctaggaaaaccagagacccttgttcacatgtttatctgctgaccttccctccactattgtcctatgaccctgccaaatccccctctccgagaaacacccaagaatgatcaataaatactaaaaaaaaaaaaaaaaaaaaaaaaagaacactgcaagaacatctgccccagaactgcctgtccaacctggactgacatcatccttgttattgatctttgtagccaaatataattattttaaaacaaacaaaaaagaagaatgtaagcagtataagactttaaaacacacaaatgaaaaatatacatgactacatgcttcagtgaactaaaactttcatctgtgatctttattttgcaacgttctgaagtaacattacagtcttttcagtgtgctgtgtcatttatatcccttactttatcctgggaatcctgtattgccattgagcatatgcaaattgagacatgtgcatagcttctccccgttgagcccatcagtggggaggagctatgtaccggggacatttggcaaagattttcatgagtctgttggatgtaacagctccttaagaaaacctcagtttaccttccctattttttaccatttgtaaaactaaggctcagtgatgtaaaatataacacattctgtgctgtggcataactgcagcttaggtttttatattcaagacaagcagaggtatagttgaaaaggtatgaacacttattatgcttcaagatccctttgttggtttagttgtggcattttagaacagcggacttgggactaaagcatctttctatctgggatcagtatttctaagttgcctttaagctgaataaacatttggtttttatatttaattgcttcgatgtgaaacactgcaatttaaaaaattacacatatgtaatacagtattttacactaaataatagtgactggcagtccattggccgaagaagtattatttttcagatattctgctctgtcatcagctgtagacactgacctggtatttatctggaaaggcttgctgtcaggggttcacagtgctgcttgtgggttatctccagaccctttacatacagcactttaggacagcgtgagtcacaggttgcactagaatttgcctttgaaattagacctaaactatgtggaactggaacccttgtacacaaagctctctatcatccaaatcctgctgaactctcttaggaaagaacagttttacagattcattctttccacacacaagatttccccactgcccagttactctcacctttttattttcttgactgttatgttttact

SEQ ID NO: 12391 - DNA, 526 bp, Homo sapiens
ccatgatgacaatggcggttttgtggaatagaaaggggggaaaggtggggaaaagattgagaaatcggatggttgccgtgtctgtgtagaaagaagtagacataggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgcttcgttaaacagatgtttgaaggcagcatgctcgttaagagtcatcaccactccctaatctcaagtacccagggacacaaacactggggaaggccgcagggtcctctgcctaggaaaaccagagacctttgttcacttgtttatctgctgaccttccctccactattgtcctatgaccctgccaaatccccctctgtgagaaacacccaagaatgatcaataaaaaataaataaataaataaataaataaataaataaataaataaacaaaaaa

SEQ ID NO: 12392 - DNA, 395 bp, Homo sapiens
aaaaatcttctgcctgggatctgttgatctgtgaccttacccccaaccctgtgctctctgaaacatgtgctgtatccactcagggttgaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaattaaaaaaaaaataaataaataaataaataaaaataataaaatgaa

SEQ ID NO: 12393 - DNA, 481 bp, Homo sapiens
ggaaaaaattgagaaatcggatggttgccgggtctgtgtggatagaagtagacatgggagacttttcattttgttctgtactaagaaaagttcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcttctgcctaggaaaaccagagacctttgttcacttgtttatctgctgaccttccctccactattgtcctatgaccctgccaaatccccctctgcgagaaacacccaagaatgatcaaaaaaaataaataaataaataaataaataaataatgaaagctggaagataaatgaatg

SEQ ID NO: 12394 - DNA, 280 bp, Homo sapiens
atgtgcttagataaacagatgcttgaaggcagcatgctcgttcagagtcatcaccactccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaataaaaataaaaataaaaaaaaataaagcaa

SEQ ID NO: 12395 - DNA, 416 bp, Homo sapiens
catgctgcaggtctcatttagttctgtactaagaaaaattcttctgccttgggatcctgttgatctatgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccacagggtcctctgcctaggaaaaccagagacctttgttcacttgtttatctgctgaccttccttccactattgtcctatgaccctgccaaatccccctctgtgagaaacacccaagaatgatcaataaaataaataaataaataaataattaattaaacacactgaaaa

SEQ ID NO: 12396 - DNA, 468 bp, Homo sapiens
tgatggtgccagtctgtgtagaaagaagtagacatgggagactttcatttagttctatactaagaaaaattcttctgccttgggatcctgttgatctgtgaccttacccccaaccctgtgctctctgaaacatgtgctgtgtccactcagggttaaatggattaagggcggtgcaagatgtgctttgttaaataaacagatgcttgaaggcagcatgctcgttaagagtcgtcaccactccctaatctcaagtacccagggacacaaacactgcggaaggccgcagggtcctctggctaggaaaaccagagacctttgttcacttgtttatctgctgaccttccctccactattgtcctatgaccctgccaaatccccctctgtgagaaacacccaagaatgatcaataaaaaataaataaataaataaataaaataaaataaaataaaataaaatgggagaagggtg

SEQ ID NO: 12397 - DNA, 407 bp, Homo sapiens
ttttgttttgttctgtactaagaaaagttattctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttgagagtcatcaccactccctaatcttaagtacccagggacacaaacactgcggaaggccacagggtcctctgcctaggaaagccagagacctttgttcacttgtttatctgctgaccttccctccactattgtcctatgaccctgccaaatccccctctgcgagaaacacccaagaatgatcaataaataaataaataaataaataaagacctacaaacaaaataaataa

SEQ ID NO: 12398 - DNA, 370 bp, Homo sapiens
ggatgctgttgatctatgaccttacccccaaccctgtgctctctgaaacatgtgctctgtccactcagggttcaatggattaagggcggtgcaagatgtgctttgttaaacagatgcttgaaggcagcatgctcgttaagagtcatcaccactccctaatctcaagtacccagggacacaaacacctcggaaggccgcagggtcctctgcctaggaaaaccagagacctttgttcacttgtttatctgctgaccttccctccactattgtcctatgaccctgccaaatccccctctgtgagaaacacccaagaatgatcaataaaaaaataaataaataaaaaataaaaaataaaaaaaataaaaaaaaa

SEQ ID NO: 12399 - DNA, 406 bp, Homo sapiens
tctactaagaaaaatcttctgccttgtggatctgttgatctgtgaccttacccccaaccctgtgctctctgaaacatgtgctgtatccactcaggattgaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaattaaaaaaaaaataaataaataaataaataaaaataataaaatgaa

SEQ ID NO: 12400 - DNA, 439 bp, Homo sapiens
tgtgtagaaagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcgcaagtaccgagggacacaaacactgcggaaggccgcagggtcctctgcctaggaaaaccagagacctttgttcacttgtttatctgctgaccttcccgccactattgtcctgtgtccctgccaaatccccctctgcgagaaacacccaagaatgatcaataaaaaaaaaaataataaaataaaataaaaaaataaaaaaaaaaacata

SEQ ID NO: 12401 - DNA, 523 bp, Homo sapiens
tgatgacaatggcggttttgtagaatagaaagaggggaaaggtggggaaaagattgagaaatcggatggttgccgtgtctgtgtagaaagaggtagacgtgggagacttttcattttgttctgtactgagaaaaattcttctgccttgggatcctgttgatcggtgaccttacccccaaccctgtgctctctgaaacatgtgctgtatccactcagggttgaatggattaagggtggtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccttctgcgagaaacacccaagaatgatcaataaaaaaaaaataataataataataataaaattaaattaaattaaaaaaaaaaa

SEQ ID NO: 12402 - DNA, 371 bp, Homo sapiens
ggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcgtcaccacaccctaatctcaagtacccagggacacaaacactgcggaaggccgcagggtcctctgcctaggaaaaccagagacctttgttcacttgtttatctgctgaccttccctccactattgtcctatgaccctgccaaatccccctctgtgagaaacacccaagaatgatcaataaaaaataaataaataaataaataaataaataaataaataaataaaaaa

SEQ ID NO: 12403 - DNA, 394 bp, Homo sapiens
ttaatttttttttttagtatttatttatcattcttgggtgtttctcggagaggaggatttggcagggtcataggacaatagtggagggaaggtcagcagataaacatgtgaacaaaggtctctggttttcctaggcagaggaccctgcagccttccacagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacggggttgggggtaaggttatagattaacagcatcccaaggcagagtaatttttcttagtacagaacaaactggagtctcccacct

SEQ ID NO: 12404 - DNA, 3334 bp, Homo sapiens
tacacattaccttcttttcaagggcctgtttcctttgcctccataactgttgtgggtattgacggccaggcttctaaacctcttaaaactccccaactctggtgccaacttagacaatactcttttaagcactcctttttagttatccccacctgcccagttcccttattaggctgagacactttaactaaattatctgcttccctgactattcctggactacagctatatctcattgcctcccttcttcccaatccaaagcctcctttgcatcctcctcttgtatcccccaccttaacccacaagtataagatacgactactccctccttggcaaccgatcatgcaccccttaccatctcattaaaacctaatcacccttaccccactcagtgccaatattccaccccgaagcatgctttaaaaagattaaagcctgttatcactcgcctgctacaacatagccttttagaacctataaactctccttacaattcccccattttacctgtcctaaaaccagacaagccttacaagttagttcaggatctgcaccttatcaacaaaattgttttgcctatccaccccatggtgccaaacccatatactctcctatcctcagtacctgcctctacaacccattattctgttctagatctcaaacatgctttctttactattcctttgcatccttaatcccagcctctcttcgctttcacttggactgaccctgacacccatcaagctcagcaaattacctaggctgtactgccgcaaagcttcacagacagcccccattacttcaatcaagcccaaatttcttcctcatctgttacctatcttggcataattctcataaaaacacacgtgctctccctgccaatcatgtccgactgatctctcaaaccccaaccccttctacaaaacaacaactcctttccttcctgggcatggttggatactttcacctttggatacctggttttgccatcctaacaaaaccattatataagctcacaaaaggaaacctagctgaccccatagatcctaaatcctttccccactcctctttccgttccttgaagacagctttagaaactgccccactctagctctccctgactcatcccaacccttttcattccacacagctgaagtgcagggctgtgcagttggaattcttacataaggaccaggatcgcatcctgtagcctttttgtccaaacaacttgaccttactgttttaggctggccatgatgtctccatgcagccactgctgctgccctaatacttttagaagccctcaaaatcaaaaactatgctcaactcactctctacagttctcgtaacttccaaaatctattttcttcctcatacctgacgcatatgctttctgcttcctggctccttcagctgtactcactctttgttgagtctcccacaattaccattgttcctggcccagacttcaatccggcctcccacattattcctgataccacacctgacccccatgactgtatctctctgatccacctgacattcaccccatttccccaaatttccttctttcctgttcctcaccctgatcacgcttgatttattgaaggtggttccaccaggcctaatcgccacacaccagcaaaggcaggttatgctatagtacaagccactagcccacctcttagaacctctcatttcatttccatcgtggaaatctatcctcaaggaaataatttctcagtgttccatctgcttttctactactcctcagtgattattcaggccccctcccttccctacacatcaagctcgaggatttgccccacccaggactggcaacttagctttactcaacatgccctgagtcagataactaaaatacctcttagttcaggtagacactttcactggataggtagaggcatttcctacagggtccgagaaggccaccgcagtcatttcttcccttctgtcagacataattcctcagtttagccttcccacctcaatacagtctgataacagacgagcctttattagtcaaatcagccaagcagtttttcaggctcttagtattcagtgaaacctttatatcccttacagtcctccgtcttcaagaaaagtagaatggactaaaggtcttttaaaaacacacctctccaagctcagccaccaacttaaaaaggactggacaatacttttaccactttcccttctcagaattcaggcctgtcctcagaatgctacagggtacagcccatttaagctcctgtatagatgctcctttttattaggccccagtcttattccagacaccagaccaacttagactgtgccccaaaaaaacttgtcatccctgctatcttctgtctagtcatactcctattcaccgttctcaactactcatacatgccctgctcttgtttacactgccctgctcttgtttacattgtttttctaagccatcacagctgatatctccaggtgctatccacaaactgccactcttaactcttgaagtaaataaataatctttgctggcaggactatgctgaatctccttaggcactctctaatcagatatcctgagtcatcccaattcttagaccttttatacctgtttttctccttttgttattccatttggtttctcaattcatccaaaaccatatccaggccatcaccaatcattctatatgacaaatgtttcttctaacatccccacaatatcaccccttaccacaagacctcccttcagcttaatctctcccactctaggttcccacgccacccctaatcccgcttgaggcagccctgagaaacatcgctcattctctctccataccaccccccaaaaatttttgccgccccaacacttcaacactatttttatttttcttattaatataagaaggcaggaatgtcaggcctttgagcccaagccaagccatcgcatcccttgtgacttgcacatataagcccagatggcctgaaataagtgaagaatcacaaaagaagtgagtatgccctgccccaccttaactgatgacattccaccacaaaagaagtgtaaatgaccggtccttgccttaagtgatgacattaccttgtaaaagtccttttcctagctcattctggctcaaaaagcacccccactgagcaccttgcgacccccactcctgcccgtgagagaacaagccccctttgactgtaattttcctttacctacccaaatcctataaaacagccccacccttatctcccttcgctgactctcttttcggactcagcccacctgcacccaggtgaaataaacagctttattgctcac

SEQ ID NO: 12405 - DNA, 2713 bp, Homo sapiens
agtatatttaaatcaaagcaagaaatcccatttccaaatggcaataaagcatgtgttacatagaatcagtgcatgaaagtgttttagtagcccagattagattgtaccctggcaaataagcaagagttctttttcattttcatcttgcaattcaactgggtatttgggttctttttctattcactcatgtcagatagagacatacatgttgtaaattattttgtcagaatgaaagcctggcagattaaatgctttcttctcttcttgctttacttgatatcaatctcttgttcatttcttgataatatgtttggttatttttgttttcattgcttttagtgtcagagatggctttggattccccgttctgtgtgctgctgtctggctcctgaacccagctgtagaggtgtgtcaatcccaactggtgaagtactgagaggaagctacacaaaaggcagcaaagtattagtaagtgtacctctgacattttaaccacctctgacttttccatggaatggacaagtagtagtctctgtcagagctacattttaaaggagaaaaagaaacgtgaagtcatgaactgttaatttatgctgttatttttgtgtttactcacctcatttatattgacttgtaaattagtaatttgtgaactattatttatcaattcattgcctacatgtcaggaaacaaattttcttcttaataaagaatccggttgctgggcacaatggttcacacctgtaatctcagcacgtttggagggcaaggcaggaggattccttgaggccaggagttcaagaccagtctgggcaatatagcaagatttcatctctacaaaaaaatgaaaacattggctgggcatggtggctcattcctatagttcaggctactgaggagcctgatgtaggaggatcatgtgaccccagtagtttgaggctgcagtgagctatgatcctaacactgctctccagcctgggtgacacaccaagttgccctctcttcaaaaaaggaatctagagacatcagtgtgtgcacaagcatggtttgtgaatttggaagtgcgtatgtgcatagttgtgctcaagaatgtgttgatgattataccttctcagaatgaaggtaattttttttctttttttttttttgagatggagtcttgctctgttgccaggctggagtgcagtggtgctctcagctcactgcaacctctgcctcccgggttcaagcaattctcctgcctcagcctcccaagtagctgggactacaggcacacaccaccactcccggctaattttttgtgttttagtagagatggggttttaccatgttggccaggatggtctcgatcccccgaccttgtgatccatccaccttggcctcccaaagtgttgggattacaggtgtgagccaccgtgcctggcctgaaggtcatttttataaagatctctccatgtcttagatttgattcttcctttgaatatttttctcattgacatttgaaagcacctgaccttatataaaatgaacaattttcataactccataaaaggagaattatggcatcatctactatttctttctcttgtctcataaatctaaaccatcaacctgcttatttttgtatactgtcacactgtgtattccctgcattgaatgcctttctattgacattgtctataaaaattgtgggaagttttctgcaccctgaaatttctgttatgcggattaaatatccactatccgtgtttttccgagtcttacagcagaaagggtaaatgcagccctcacagcagcctgttgttcgtcctgcaattgtgtttccatcacattacacaaagcctctttgtcttcgtggttctaccctactaataagttttttaaaaaattatgtaatgtgtgtatatacaaatacctatatgtttgtgtgtacacatacagctaatatctgctgagattatgtatgcatgaactatagaattaacttgtaattttaagaaaataaattattttgtaaagataaatctcatgtttaagaagaggaattacaattgaatcatttagggatgcctcagcctaaacataatatggaaaaagccataaccaaaagtcattttagagtactgctaggttactcaacctatcatcacatttaattaaaatgtcagtttgaaccatggccagtctattttggttaatatgttatttaaatcaacttgtgaagtcttcattttaaatatagaatttgtgttaatgaactggaaaataacattctattcttggaagatgtgttaaagtctaaagatttatgactttgtaaaagaagaaaaccagctggtgatcagttggcattagtatatgaggatgtactcatatttggtaatagccatttttttctaactagagtaagggagttgggaatgggaggcagaaacaaggacacagacatgtaaaaaatcatagaacaaaactgtattgagttctgcgtatgggtctgtgatccatggttcagtttgagaggttcatgtgtcccttatgagaagggacaggaaagccaggaggacaggagtatgtttgggcctgtgcctctgcttccaccacagaagtcagcagctctacctttctcttttctcctctttatctaataattgtctcctcttcaaatttgggaaatgaacttaatcaaagatttgttgtgtttttttgtttgttt

SEQ ID NO: 12406 - DNA, 242 bp, Homo sapiens
catttttcaagagaccccaaatattcctcaaataccacgccatcttccataggttgcttttttgttttttaagagacctgaggccacttggctttcttttggtggccaaaacactagagcagaaacagggagtttgtggctgtccagaagccacatgccttgtctctgaaagttttatttagattatgttgtattatctcctatgggtaggtttccactgatgtgtggcttatgtgaattat

SEQ ID NO: 12407 - DNA, 171 bp, Homo sapiens
agctcaaggaggcctgcctgcctctgtagactgcacctctgggggcagggcatagccaaacaaaaggcagcagaaacctctgcagacttaaatgtcccagtctgacagctttgaagagagtaatggttctcccagcacgcagctggagatctgagaacggacagactgcct

SEQ ID NO: 12408 - DNA, 131 bp, Homo sapiens
ttttttttttgagacggagtctcgctctgttgcccaggctggagtgcagtggcacaatctcagctcactgcaagctcctcctcccgggttcacgccattctcctgcctcagcctcccgagtagctgggact

SEQ ID NO: 12409 - DNA, 8538 bp, Homo sapiens
aaacttgatcttcttacccatgagtatagtttacttttcagcttatagatttttgtctttcaataaaactttttactttttctctatatttcaactaaatgtcttcaatatgccctatttttgtgctattgcaaatgatatcctttatgacacttattgctttggaatagaaattataaattgatcttctattcaccagtgttattcaactagtattaattcttgttgtttttctgttgccatcctcaagtaatggcagtttattactttttccctaatttcttattaatacaatcttgtaccagcaagagtctcatagccaatgctggattatgtagtgatgatgtctgttttgatcctgattttaaaagcaatgtttctgagaactcttctttacatgtattttagccattgattttggatagtctttatcagattcacttttgtttctgtatctcattttctaagactaattatgaataggttttgatttttaaaacaaataaattgaaaatatctattgagatatttttctgctttaatctgctaatgtggtcaattgtgtcgatattcttatctctaaaacattttgtattcattggacaaatcttagtcatgatgtatttttaaaataaatcaatagatacttttgccaaaactggtttaaaatttttgattccatgttcatgcataaaatcatttggtgattattccccatttttcttttctctgagagagtttgtataaagatagaattatatgttttccaaaattttagtagaacatctccagtatctccccttctcgcagaactcttaaccctattttttaaatcctatgtcttactaagagagtatagatgtgtgcttctggaactaacatttcccttgaaggatatttccactgttttattaatcctttgtttcttctattatatacatctttttttcaaaaccacatatattatcatttctgatagtctgttattatctccactaccttattttgcttaccttgctgtaacagaatacatgagactgtgtatttataaaagaaacaagtttatttggctcatggttgtggaaactgggcagtcttaagagtatggctgtagcctctggtgagggtttgaattacatcataacatggcagaggagaagagaaagcaggcagatgcgaaaggggcaccaatgaggtagttaatccagtcctgagagaatgagaactcactcccaccagaactaacccaatctcctaagagtagcattcattccttgtaaccacctaatcaccttttaaaggccttgtctcccagcaccaccacaccaatgaccaaattttcaacacaaggattctgggtaataactcaaaccacagcattcattctgccttccctttattctatcttaagatctaatttgtttggttatttatttattggggggagcaataaagacatttcttaaatatttcccttccatcaaactcatcctaatttcaagtagtgccagaatgtctctgggattgggagaatcaggccaagaggaagttgagttgggtacatgtagtttgggattaataggatacaattaattagcttaaacagtcaatttcatttaagttatgttattgctacacaccctggtgtatgactagccccccagtatactgctaccagtgattgtgcccatctactcatcattgtaagtcaaaggtgcgagttcacaagttattctatgaagtgaatgttcccttcagcaactggcactgggggcatgttagcagtgagagaaaagcaatatttaaaagcacagagcaagaaattgatctgttagaaattattcccatcattaggtaggtaaaattataattaaatgtctttgtttctcctgaatacctaggaaaaaatgaagagttgttttcccagaattatagaagtatatccagtaaagcaattatagatacaccatacttttttactgttgggaattacacaaaatagagttgactaatctctgtgctttagtgcacagatctgtagtgagactagaaagagtcatacatttgcatgagaatatgtgtgttgaatgtaccccaacgtatgagattgtattttagcaagtgacatattttgtcttgttgaagtctaattgtcccgaacagagtggatttctagaatgccacccacatagtaaactggcctaaagataaatgatttctagtgaccaaaatctaatgtataccaattagtgagtcaatgtgaaaaaggagtaacttgattatacaatctgcagttattagaatgtagaagcaatttcaaaatgcacttaaattgcctgtgtatgtgttaatttcaggttaaatttgtatgtgactttttcaaaattattcatcataccaaaatgcaaatgtaatagaaagccaagaatttactccagaaaagaaaacttgtaactttaaaatataaaataattctagtttttcacaatgagtgctagttatccacaacttttgatgctgtaagaaactcaaactaggtttccattccaagatggctgaataggaacagctccagtctgcagctcccagcgtgatcgatgcagaagacaggtgatttctgcatttacaactgaggtacctggttcatttcactgggactggttggacagtgggtgcagcccacggagggcaagccaaagcagggcggggcattgcctcacctgagaaatgcaaggggtcaagggatttccctttcctagccaagggaagctgtgacagactacctggaagaatgggacactcacgcccaaatactgcacttttcccacagtcttagcaactggcagaccaggagattttctcccatgcctggttcggcaggtccaatgcccacagagccttgctcactgctactgcagaagtctgagatttaccagcaaggctgcagcctgtctaggggaggggcatccaccattgctgaggcttgagtaggtaaacaaagtggccgggaagcttgaactggggcagagcccactgcagctcaacaaggcctactgcctctatagacaccacctctgtgggcagggcatacctgaacaaaaggcagcagaaacttctgcagacttaaacgtccctgtctgacagctctgaagagagcagtggttctcccagcatggcgtctgagctctgagaacagacagactggctcctcaattgggtccctgacccctgtgtagcctaactgggagacacctcccagtaggggccgacagacacctcatacaggtgggtgcccctctgggatgaagcttccagaggaaggatcaggcagcaatatttgctgttctgcaatatttgctgttctgcagccaccactggtgatacccatgcaaacagggtatggagtggacctccagcaaactccaacagatctgcagctgagggacctgactattagaaggaaaactaacaaacagaaaggaatagcatcaacatcaatgaaaaggacatctacaccaaaaccccatctgtaggtcaccagcatcaaagatcaaaggtagataaaaccacaaagatggggagaaaccagagcagaaaagctgaaaattctaaaaaccagagtgcctcttctcctccaaaggatcacagctccttgccagcaaaggaacaaagctagagggagaatgactttgatgagttgacagaagtaggcttcagaaggttggtaataccaaacttctcctagctaaagaagcatgttctaacccattacaaggaagctaaaaaccttgaaaaaaggttagatgaatggctaactagaataaacagtgtagagaagaccttaaatgacctgatggagctgaaaaccatggcaagagaacttcatgatgcatgcacaagcttcaatagctgatttgatcaagtggaagaaagagtatcagtgattgaatatcaaattaatgaaataaagtgagaagacaagtttagaaaaaaaaagggtaaaaagaaacaaacaaagcctccaagaaatatgggactatgtgaaaagacaaaatctacgtttgattggtgtacctgaaagcaatggggagaatggaaccaagttgaaaaacagtcttcaggatatcatccaggggaacttccccaacctagcaaggcaggccaacattcaaattcaggaaacacagagaacaccacgaaggtactcctcgagaagagcaacccaagacacataattatcagattcactaaggtagaaatgaaggaaaaaatgtaaagagcagccagagagaaaggtcgagttacccacaaaaggaagcccatcagactaatggcggatctctcagcagaaactctacaagccagaagagagtgggggccaatttcaacattcttaaagaagagaagtttcaacccagaatttcatatccagccaaactaagcttcataagtgaaagagaaataaaatcctttacagacaagcaaatgctgagagatttttttaccaccaggcctgccttacaagagctcctgaagtaagcactaaacatggaaaggaacaactggtatcagccactgcaaaaacattgcaaattgtaaaggccaccaatgctatgaagaaactgcatcaattaatgggcaaaataaacagcgaacatcataatgacaggatcaaattcacacataacaatattaaccttaaatgtaaatgggctaaatgccccaattaaaagatacagactggcaaattggataaagagtcaagacccatcagtgtgctgtattcaggagacccatctcatgtgcagagacacacataggctcaaaataaagggatagaggaagatctaccaagcaaatagaaagcaaaaaaaaagcaggagttgcaatcctagtctctgttataaaacagactttaaaccaacaaagatcaaaagagacaaagaaggccatttcataatggtaaagggatcaattcaacaagaagagctagctatcctaaatatatatgcacccaatacaggagcacccagattcaaaaagcaagtccttagaaactacaaagagacttagactcccacacaataataatgggagactttaacaccccactgtcaatattagacagattgagacagaaggttaacaaggatatccaggacttgaactcagctctgcaccaagcagacctaatagacattgacagaactctccaccctaaatcaacagaatatacattcttctcagcaccacatcacacttattctaaaatagaacacaaaattggcagtaaagcacacctcagcaaatgtaaaagaaaagaaatcacaacaaactgtctttcagacaacagtgcaatcaaattagaattctggattaagaaactcactcaaaactgcaaaactacatggaaattgaacaaccttctcctgaatggctactgggtaaataatgaaatgaaggcagaaataaagatgttgtttgaaaccagtgtgaacaaagacacaatgtacgagaatctctgggacacattaaaagcagtgtgtagaggaaaatttatagcactaaatgcccacaagagaaagcaggaaagatctaaaattgacaccctaacatcacaattaaaagaactagacaagcaagagcaaacacattcaaaagctagcagaaggcaagaaataacaaagatcagagaagaactgaaggagacagacaaaaaaacctttcaaaaaatcaatgaatccaggagctggttttctgaaaagatcaacaaaattgatagactgctagcaagactaataaagaagaaaacagaggagaatcaaatagacacaataaaaaatgataaaggggatatcaccaccgatcccacagaaatacaaactaccatcagagaatactataaacacctctatgcaaataaactggaaaatctagaagaaaatctaggataaattcctggactttttttggttggtaggctattaattattgcctcaatttcagagcctgttattggtctattcagagattcagcttcttcttggtttagtcttgggagggtgtaagtgtccaggaatttatccagatggattcacagctgaattctactagaggtaagaaggaggagctggtaccgttccttctgaaactattccagtcaatagaaaaagaaggaatcctccctaactcattttatgaggccagcatcatcctgataccaaagcctggcagagacccaacaaaaaagagaattttagaccaaaagccctgatgaacattgatgcgaaaatcctcaataaaatcctggcaaactgaatccagcagcacatcaaaaagcttatccaccaaaatcaggttggcttcatccctgggatgcaagactggttcaacatatgcaaatcaatacacgtaatccgtcacataaacagaaccaatgacaaaaaccacatgattatctccattgatgcagaaaaggccttcgacaaaattcaacaacccttcatgctaaaaactctcaataaacaaggtatcgatggaatgtatctcaaagtaataacagctatttatgacaaacccacagccaatatcatactgaatgggcaaaaactggaagtattccttttgaaaactggcacaagacagggatgccctctctcaccactcctattcaacatagtattggaagttctggccagggcaatcaggcaggagaaggaaaaaaagggtattcaattaggaaaagaggaagtcaaattgtccctgtttgcagatgacatgattgtatatttagaaaacccccattgtctcagccccaaatctccttaagctgataagcaacttcagcaaagtctcaggacacaaaatcaatgtgcaaaaatcacaagcattcctatacaccaataacagacaaacagagagccaaatcatgagtgaactcccattcacaattgctagaaagagaataaaatactaggaatccaacttaccagggaggtgaaggacctcttcaaggagaactacaaaccactgctcaacgaaataaaagaggacacaaacaaatggaagaacattccatgctcatggataggaagaatcaatatcgtgaaaatgaaaatgaccatactgcccaaggtaatttatagattccatgccatccccatcaatctaccaatcactctcttcacagaattggaaaaaactactttaaagttcatatggaaccaaaaaagagcccacatttccaagacaatcctaagcaaaaagaacagagctggaagcatcacgctacctgacttcaaactatactacaaagctacagtaaccaaaacagcatggtactggtaccaaaacagatatatagactaatggaacagaacagaggcctcagaaataacactacacaactacaaccatctgatctttgacaaacctgacaaaaacaagaaatggcaaaaggattccctatttaataaatggtgctaggaaaactggctagctatatgtagaaagctgaaactggatcccttccttacaccttacaaaaaaattaattcaagatagattaaagacttaaatgttagacctaaaaccataaaaaccctggaagaaaagctaggcaataccattcaggacataggaatgggcaaggaatttatgactaaaacaccaaaagcagtgacaacaaaagccaaaatagacaaatgggatctaatgaaactaaagagcttctgcactgcaaaagaaactactgtcagagtgaataggcaacctacagaatgggagaaaatttttgcaatctacccatctgacaaagggctaataccaaaatctacaaagaacttaaacaaatttacaagaaaaaaacaaccccatcgaaaagtgagcaaaggatataaacagacacttctcgaaagaagacatttgtgcagccaacagacacatgaaaaaatgctcatcatcactggccatcagagaaatgcaaatcaaaaccacaatgagataccatctcatgccagttagaatggcaatcattaacaagtcaggaaacaacaggtgctggagaggatgtggagaaataggaatgcttttacactgtaggtgggagtgtaaattagttcaaccactgtggaagatagtgtggtgattcctcaaggatctagagctagaaataccatttgacccagccatcccgttactgggtatatacccaaaggattataaatcatgttaatataaagacatatgcacatgtatgtgtattgcagcactattcacaatagcaaagacttggaaccaacccaaatgtccatcaataatagtctggattaagaaaatgtggcacatatacaccatggaatactatgcagccataaaaaaggatgagttcatgtcctttgcagggacatggatgaagctggaaaccatcattctcagcaaactatcacaaggacagaaaaccaaacaccgcatgttctcactcataggtgggaactgaacaatgaggacacttggacacagggcagggaacatcacaca

SEQ ID NO: 12410 - DNA, 8536 bp, Homo sapiens
aaacttgatcttcttacccatgagtatagtttacttttcagcttatagatttttgtctttcaataaaactttttactttttctctatatttcaactaaatgtcttcaatatgccctatttttgtgctattgcaaatgatatcctttatgacacttattgctttggaatagaaattataaattgatcttctattcaccagtgttattcaactagtattaattcttgttgtttttctgttgccatcctcaagtaatggcagtttattactttttccctaatttcttattaatacaatcttgtaccagcaagagtctcatagccaatgctggattatgtagtgatgatgtctgttttgatcctgattttaaaagcaatgtttctgagaactcttctttacatgtattttagccattgattttggatagtctttatcagattcacttttgtttctgtatctcattttctaagactaattatgaataggttttgatttttaaaacaaataaattgaaaatatctattgagatatttttctgctttaatctgctaatgtggtcaattgtgtcgatattcttatctctaaaacattttgtattcattggacaaatcttagtcatgatgtatttttaaaataaatcaatagatacttttgccaaaactggtttaaaatttttgattccatgttcatgcataaaatcatttggtgattattccccatttttcttttctctgagagagtttgtataaagatagaattatatgttttccaaaattttagtagaacatctccagtatctccccttctcgcagaactcttaaccctattttttaaatcctatgtcttactaagagagtatagatgtgtgcttctggaactaacatttcccttgaaggatatttccactgttttattaatcctttgtttcttctattatatacatctttttttcaaaaccacatatattatcatttctgatagtctgttattatctccactaccttattttgcttaccttgctgtaacagaatacatgagactgtgtatttataaaagaaacaagtttatttggctcatggttgtggaaactgggcagtcttaagagtatggctgtagcctctggtgagggtttgaattacatcataacatggcagaggagaagagaaagcaggcagatgcgaaaggggcaccaatgaggtagttaatccagtcctgagagaatgagaactcactcccaccagaactaacccaatctcctaagagtagcattcattccttgtaaccacctaatcaccttttaaaggccttgtctcccagcaccaccacaccaatgaccaaattttcaacacaaggattctgggtaataactcaaaccacagcattcattctgccttccctttattctatcttaagatctaatttgtttggttatttatttattggggggagcaataaagacatttcttaaatatttcccttccatcaaactcatcctaatttcaagtagtgccagaatgtctctgggattgggagaatcaggccaagaggaagttgagttgggtacatgtagtttgggattaataggatacaattaattagcttaaacagtcaatttcatttaagttatgttattgctacacaccctggtgtatgactagccccccagtatactgctaccagtgattgtgcccatctactcatcattgtaagtcaaaggtgcgagttcacaagttattctatgaagtgaatgttcccttcagcaactggcactgggggcatgttagcagtgagagaaaagcaatatttaaaagcacagagcaagaaattgatctgttagaaattattcccatcattaggtaggtaaaattataattaaatgtctttgtttctcctgaatacctaggaaaaaatgaagagttgttttcccagaattatagaagtatatccagtaaagcaattatagatacaccatacttttttactgttgggaattacacaaaatagagttgactaatctctgtgctttagtgcacagatctgtagtgagactagaaagagtcatacatttgcatgagaatatgtgtgttgaatgtaccccaacgtatgagattgtattttagcaagtgacatattttgtcttgttgaagtctaattgtcccgaacagagtggatttctagaatgccacccacatagtaaactggcctaaagataaatgatttctagtgaccaaaatctaatgtataccaattagtgagtcaatgtgaaaaaggagtaacttgattatacaatctgcagttattagaatgtagaagcaatttcaaaatgcacttaaattgcctgtgtatgtgttaatttcaggttaaatttgtatgtgactttttcaaaattattcatcataccaaaatgcaaatgtaatagaaagccaagaatttactccagaaaagaaaacttgtaactttaaaatataaaataattctagtttttcacaatgagtgctagttatccacaacttttgatgctgtaagaaactcaaactaggtttccattccaagatggctgaataggaacagctccagtctgcagctcccagcgtgatcgatgcagaagacaggtgatttctgcatttacaactgaggtacctggttcatttcactgggactggttggacagtgggtgcagcccacggagggcaagccaaagcagggcggggcattgcctcacctgagaaatgcaaggggtcaagggatttccctttcctagccaagggaagctgtgacagactacctggaagaatgggacactcacgcccaaatactgcacttttcccacagtcttagcaactggcagaccaggagattttctcccatgcctggttcggcaggtccaatgcccacagagccttgctcactgctactgcagaagtctgagatttaccagcaaggctgcagcctgtctaggggaggggcatccaccattgctgaggcttgagtaggtaaacaaagtggccgggaagcttgaactggggcagagcccactgcagctcaacaaggcctactgcctctatagacaccacctctgtgggcagggcatacctgaacaaaaggcagcagaaacttctgcagacttaaacgtccctgtctgacagctctgaagagagcagtggttctcccagcatggcgtctgagctctgagaacagacagactggctcctcaattgggtccctgacccctgtgtagcctaactgggagacacctcccagtaggggccgacagacacctcatacaggtgggtgcccctctgggatgaagcttccagaggaaggatcaggcagcaatatttgctgttctgcaatatttgctgttctgcagccaccactggtgatacccatgcaaacagggtatggagtggacctccagcaaactccaacagatctgcagctgagggacctgactattagaaggaaaactaacaaacagaaaggaatagcatcaacatcaatgaaaaggacatctacaccaaaaccccatctgtaggtcaccagcatcaaagatcaaaggtagataaaaccacaaagatggggagaaaccagagcagaaaagctgaaaattctaaaaaccagagtgcctcttctcctccaaaggatcacagctccttgccagcaaaggaacaaagctagagggagaatgactttgatgagttgacagaagtaggcttcagaaggttggtaataccaaacttctcctagctaaagaagcatgttctaacccattacaaggaagctaaaaaccttgaaaaaaggttagatgaatggctaactagaataaacagtgtagagaagaccttaaatgacctgatggagctgaaaaccatggcaagagaacttcatgatgcatgcacaagcttcaatagctgatttgatcaagtggaagaaagagtatcagtgattgaatatcaaattaatgaaataaagtgagaagacaagtttagaaaaaaaaagggtaaaaagaaacaaacaaagcctccaagaaatatgggactatgtgaaaagacaaaatctacgtttgattggtgtacctgaaagcaatggggagaatggaaccaagttgaaaaacagtcttcaggatatcatccaggggaacttccccaacctagcaaggcaggccaacattcaaattcaggaaacacagagaacaccacgaaggtactcctcgagaagagcaacccaagacacataattatcagattcactaaggtagaaatgaaggaaaaaatgtaaagagcagccagagagaaaggtcgagttacccacaaaaggaagcccatcagactaatggcggatctctcagcagaaactctacaagccagaagagagtgggggccaatttcaacattcttaaagaagagaagtttcaacccagaatttcatatccagccaaactaagcttcataagtgaaagagaaataaaatcctttacagacaagcaaatgctgagagatttttttaccaccaggcctgccttacaagagctcctgaagtaagcactaaacatggaaaggaacaactggtatcagccactgcaaaaacattgcaaattgtaaaggccaccaatgctatgaagaaactgcatcaattaatgggcaaaataaacagcgaacatcataatgacaggatcaaattcacacataacaatattaaccttaaatgtaaatgggctaaatgccccaattaaaagatacagactggcaaattggatagagtcaagacccatcagtgtgctgtattcaggagacccatctcatgtgcagagacacacataggctcaaaataaagggatagaggaagatctaccaagcaaatagaaagcaaaaaaaaagcaggagttgcaatcctagtctctgttataaaacagactttaaaccaacaaagatcaaaagagacaaagaaggccatttcataatggtaaagggatcaattcaacaagaagagctagctatcctaaatatatatgcacccaatacaggagcacccagattcaaaaagcaagtccttagaaactacaaagagacttagactcccacacaataataatgggagactttaacaccccactgtcaatattagacagattgagacagaaggttaacaaggatatccaggacttgaactcagctctgcaccaagcagacctaatagacattgacagaactctccaccctaaatcaacagaatatacattcttctcagcaccacatcacacttattctaaaatagaacacaaaattggcagtaaagcacacctcagcaaatgtaaaagaaaagaaatcacaacaaactgtctttcagacaacagtgcaatcaaattagaattctggattaagaaactcactcaaaactgcaaaactacatggaaattgaacaaccttctcctgaatggctactgggtaaataatgaaatgaaggcagaaataaagatgttgtttgaaaccagtgtgaacaaagacacaatgtacgagaatctctgggacacattaaaagcagtgtgtagaggaaaatttatagcactaaatgcccacaagagaaagcaggaaagatctaaaattgacaccctaacatcacaattaaaagaactagacaagcaagagcaaacacattcaaaagctagcagaaggcaagaaataacaaagatcagagaagaactgaaggagacagacaaaaaaacctttcaaaaaatcaatgaatccaggagctggttttctgaaaagatcaacaaaattgatagactgctagcaagactaataaagaagaaaacagaggagaatcaaatagacacaataaaaaatgataaaggggatatcaccaccgatcccacagaaatacaaactaccatcagagaatactataaacacctctatgcaaataaactggaaaatctagaagaaaatctaggataaattcctggactttttttggttggtaggctattaattattgcctcaatttcagagcctgttattggtctattcagagattcagcttcttcttggtttagtcttgggagggtgtaagtgtccaggaatttatccagatggattcacagctgaattctactagaggtaagaaggaggagctggtaccgttccttctgaaactattccagtcaatagaaaaagaaggaatcctccctaactcattttatgaggccagcatcatcctgataccaaagcctggcagagacccaacaaaaaagagaattttagaccaaaagccctgatgaacattgatgcgaaaatcctcaataaaatcctggcaaactgaatccagcagcacatcaaaaagcttatccaccaaaatcaggttggcttcatccctgggatgcaagactggttcaacatatgcaaatcaatacacgtaatctgtcacataaacagaaccaatgacaaaaaccacatgattatctccattgatgcagaaaaggccttcgacaaaattcaacaacccttcatgctaaaaactctcaataaacaaggtatcgatggaatgtatctcaaagtaataacagctatttatgacaaacccacagccaatatcatactgaatgggcaaaaactggaagtattccttttgaaaactggcacaagacagggatgccctctctcaccactcctattcaacatagtattggaagttctggccagggcaatcaggcaggagaaggaaaaaaagggtattcaattaggaaaagaggaagtcaaattgtccctgtttgcagatgacatgattgtatatttagaaaacccccattgtctcagccccaaatctccttaagctgataagcaacttcagcaaagtctcaggacacaaaatcaatgtgcaaaaatcacaagcattcctatacaccaataacagacaaacagagagccaaatcatgagtgaactcccattcacaattgctagaaagagaataaaatactaggaatccaacttaccagggaggtgaaggacctcttcaaggagaactacaaaccactgctcaacgaaataaaagaggacacaaacaaatggaagaacattccatgctcatggataggaagaatcaatatcgtgaaaatgaaaatgaccatactgcccaaggtaatttatagattccatgccatccccatcaatctaccaatcactctcttcacagaattggaaaaaactactttaaagttcatatggaaccaaaaaagagcccacatttccaagacaatcctaagcaaaaagaacagagctggaagcatcacgctacctgacttcaaactatactacaaagctacagtaaccaaaacagcatggtactggtaccaaaacagatatatagactaatggaacagaacagaggcctcagaaataacactacacaactacaaccatctgatctttgacaaacctgacaaaaacaagaaatggcaaaaggattccctatttaataaatggtgctaggaaaactggctagctatatgtagaaagctgaaactggatcccttccttacaccttacaaaaaaattaattcaagatagattaaagacttaaatgttagacctaaaaccataaaaaccctggaagaaaagctaggcaataccattcaggacataggaatgggcaaggaatttatgactaaaacaccaaaagcagtgacaacaaaagccaaaatagacaaatgggatctaatgaaactaaagagcttctgcactgcaaaagaaactactgtcagagtgaataggcaacctacagaatgggagaaaatttttgcaatctacccatctgacaaagggctaataccaaaatctacaaagaacttaaacaaatttacaagaaaaaaacaaccccatcgaaaagtgagcaaaggatataaacagacacttctcgaaagaagacatttgtgcagccaacagacacatgaaaaaatgctcatcatcactggccatcagagaaatgcaaatcaaaaccacaatgagataccatctcatgccagttagaatggcaatcattaacaagtcaggaaacaacaggtgctggagaggatgtggagaaataggaatgcttttacactgtaggtgggagtgtaaattagttcaaccactgtggaagatagtgtggtgattcctcaaggatctagagctagaaataccatttgacccagccatcccgttactgggtatatacccaaaggattataaatcatgttaatataaagacatatgcacatgtatgtgtattgcagcactattcacaatagcaaagacttggaaccaacccaaatgtccatcaataatagtctggattaagaaaatgtggcacatatacaccatggaatactatgcagccataaaaaaggatgagttcatgtcctttgcagggacatggatgaagctggaaaccatcattctcagcaaactatcacaaggacagaaaaccaaacaccgcatgttctcactcataggtgggaactgaacaatgaggacacttggacacagggcagggaacatcacaca

SEQ ID NO: 12411 - DNA, 53075 bp, Homo sapiens
ttcttttcttttcttttcttttttttttttttttttttttttgaggcagagtcttgctctatcacccaggctggagtgcagtggcacaatctcagctcactgcagcctccacctcctgtgttcaagcgattctcctgtctcagcctcctgaatagttggaactacagacgtgcaccaccacactgggctaatttttgtatttttagtagagatgaggtttccccatgttggccaggctggtctcaaactcctgatgtctagtgatccacccacccctgcctcccaaagtgctgggattacgggtgtgagccattgcgcccagcccatctggggaacttttgaaggtctagaaaagagtaagactgatgatagtgacctttgctgtgaatttcataaccattcacttatactttttctgatagatccttaaaaatgaaatttcaaagcaaaatggggagatttgcaccctaacttcagtggggttgtgagtggacaaaatgtacaaggttgtcgacaaagtagcatgcttccacacgttgaccatgtgcagcttcaacctagatgatgcacagtgaacatttcatgaataaagcctgatatgggattgtctacaggttcctccaacccctgagtagagatgttccctcctagagacttgctgtagatcacgtttcatcctccaaccgtgggggaagtgtgctgtgttattacctgatcaatgtagtatctttattttgggggaaaagctgagcctcatttttctcatttgttatattgctttccttttgtgtggtcatttgctgtcccaggcatcaaatggtccataaacaaaacacttacccactgcacacacactccaaaaaagagcaaacaaatttcagagcaaccaaaatgttgttgctaacccagtccatgaaagctcatgcatttttcttggagcaatgtctgacttttaggtaaagcaccttgcaaactgccttgacacagcaggtgcctgcaaaacattttctttttctcttcctttcctgggttagaattcagatccagtaaggagtgaggctaagtactggaaatggaatgatgaaggagatggacatccgtcctgacctcagaaaggtgtggggaggctgggcacaatggcttatgcctgtaatcccagcactttcagaggccaacgtgagaggatggcttgagcctaggagttcgagaccagccttggaaacacagcaagaccccgtctctacaaaaataaaaaaatcagccaggcatgctggtgcatgtctgtagtcccagcaactcaggaggctgaggtgggaggatcacttgagcctaggaagtcgagggtgctgtgagctatgattgcgccactgcactgcagcctgggtgacagagcaagaccctgtttcaaaaaaaaaaaaaaaaaaaaaaaggtatgaggaaaacaagaattgaaaataaatgaaagtattaatgtgagtaaggaagaaaaggaaaaggaatgttacaatataatattatattgaagtcctatcacccagtacccccagaatgtgacttaactgcagatgcaattagttgagatgaagcacactggagtaggatgagtccctaatccaatatgactggtctccttataacaaagggaaatttggatgcagacacacacagagaatgccatgtgaagacagaagcagagatccccaagccaagaaatgtcaaaggttgccaggtaaccatcagaagctaggagagaatcatggagaaccctcccaaggaactatccctgctaataccatgacctcagacttctagctctggggactgtgagattatagatatatttccattgtttaagccactccatttgttgttctctgttatattaccttagcagatgaatacagggagctacaggggtatttagtgaggggatgaagattagggaggtcggttggtgggcatggtagaaggaagatgctcaaggcagaaggaagtttcattccatagaggtggctcaatgctgaacctccagattcttcctgatatgtgctaggggcagcttagcttgacggaagaaacatcgatgttgccatcacacaaacctggcatcgaatcctgatgttgttacaacatgctgtgtgactttgggaaagccactcaacttctctgagctttggtttccttctttgtaaaatagaattgttatacttagagatatgagggtaaaaagtttttacgtggttaatgtgcctttttatttggcctttctgagtacacgacttttgtctgagttagcctgtggtaaccatctgctttggagagaaaggagagagaacgatgtggaaggcatgtgtttaagctgagacctgaaagatggctcagagttagtttggggaaaacataaaggagagcagaggattttacagaagaaaactgtatttttacatatggttaattgttacatgacaatttatcctaacgagcttgagtatctggtttctaatttcctaacacattagaactgcgagtaaagaaggctgcctctcactatgtggctggtaaaacagactgacaatgatggaagacaaaggaagactacacgatagaaggaattaggaggagagggacgcagagggaggagaagagaaggggcagaaactaaacagccatagtaggctggggctattgagtgaaggggcaaacatctcctgttaatagtatctcattaaattggatgaagtggctgctgtgggcataaaacaccctttagtcttttttttttttttatgctttaagttttagggtacatgtgcacgttgtgcaggttagttacatatgtatacatgtgccatgctggtgcgctgcacccactaacttgtcatccagcattaggtatatctcccaatgctatccctcccccctccccctaccccacaacagtccccagagtgtgatattccccttcctgtgtccatgtgttctcattgttcaattcccacctatgagtgagaatatgcaaaacaccctttagtctttagaatgatgatggtgagccaccaagggtgagttatgggacgttagggatgttctgtttcagaactgataacaatacattgtggtttcttcgtccacatatacatgatgctacttcaaatcaaaatggaactcctcctcttctttttgctgcctttgaaactcttgcagaatacagatgagcaaggccccctgccttctaaaactggattaggtggccctctcttgtgcttgcgcgggaacctctgttttgctgcttcacatcattcaccgttgctggttgcaactagttcttcatgtatcccgccatgctgcggatctgcctcctaccctagactgttatctatttgcagcacaaccgggattttgaaatgaatctctgtcccccagagcctgcataaaaactggctgaaagtgagcattaaataaatatttaacaactctagttttaaaatatttccatcctaaatggttcaaattttttttttaagttttcatgctcaaacatataaactcttgggtaacaccaatgcctcattttccaaaggttttatgattatatatgtgtttttttttctttattgcaaattcctgctggtctctctgccaccaagattcaaaaagattcaattctccttctacataaaccttttctgatgtaagcctaggctgctatattctcttttgacaaattcagggtaattttgagttggattggatacttcttttttccttgcttgtggacagaaaaaaacctacatggtatttcaaaccataattttaaggatttccctcaaaaaggttgctggcataaagatttggaaaggttagaaagaaaaacagtgctaaaagccagagctctgttctgatttctgaatgtctattctccttttttgttcttatgagactaactagtgcaattggccccagcagggacatctcctgcccattccctgtcattagtctggttttgaggcaatggaacaatctagactatgtccaagaattctgagcccagagaggaccttatggaaacctaacatcctcttttcctcatggccacctgttatgttgtcttggctttctaaacaattggaggcaatcaagcaagctttagctaccatatgttgggtgcttactatgtttcagtgcgttgctaagcatgatgatcataatgtatttgaacctcacagtgaccccatgaggaagctgttatggtcccaatttagagcttagaagactgaggcttatataggctttataagacacccaaagatgctgttggtaagtggaagagcaaaaatttgagtccaaaatggactgactaaaaactccattcttatttcattatgttgtcctggatcgtgctgtctgtggagagagagatggctgaggccacatcatagggtatagaaggtgtgttgcaaacagtggagatgaagaatgtccctgggcaggaccagtgtggcctcatgggctaggcaaaagcatggtccctcttgagtattgaaagctttagtagaattttatacaaaaaagacaccagtacttgtatgttcatcgcagcactattcacaatagcaaagttatggaaccaatgaagtggaaggagtgagggttggaaactgttgatgtgctcatcaacagttgactggataaagaaaatgtggtatatacacactatggaattctatgcagccatgaaaaagaatgaaatcatgtcctttgcagcaacatggatggagctggaggccatttttctaagtgaactaactcagaaacagaaaataaaatactgcatgttctcacttatggatgggagctaaacagtaagtatgcagggacatgaagatggaaatcacagatactagggactgcaaaagggaggtggatgggaaaggagtgagtgttgaagattacctttcaggtacaatgttcactatttgggtgatggctacactaggaccccgaccctgacctttatataatatgcccatgtaacaaatatgcacaaatatgtatctaaaataaaataaaatttgaaaaagaaagctttggaaaaattttatgaaattctttagtaagtggtataagagctgggaatcgttaaccaagcacaatgcctggaacaccatagacactaaaatatgtgaggaagaatggatggatgaaccaagctgaagaggcaagcacataggtaggttccaccaggaagcagggtatttctaatttgggaggaaacttgtttattatctgcatagaacagtaagttctgttctctggatagaagaaacaggccgaggcgggtggatcacgaggtcaggagatcgagaccatcctgactaacacggtgaaaccccatctctgctaaaaatacaaaaaattacccgggcgtggtggcacgcacctgtggtcccagctacttgggaggctgaagcaggacaatcacttaaaccccagaggtggaggttgcagtgagctgagatagcaccattgcacttcagtctgggctacagagcaagactccatctcaaaaaaaagagaagaagaagaaagaaggaggaggaggagaagaggaggaagaagaggaggaagaggaagaagaagaaggaggaggaggaaaagaagaagaaggagaagaagaaacaaaaaagcatagatctggccagcagttttctcatctgactgggaaattttgcaggaagaaggaagttattcaagacagaaggaagtttctgtccacagaggtggttcaatgcgtggttcaatgctgaacttccaggctcttcttgatccattctgggggcagcctagcttggtgaaggaaacattagttttgccaacagacaaccttgacatcaaatcctgatactgttataacatgctgtgtggctttgggcactcaacctctctgagctttggtttccttgtttgtaaaataggatggtttaacttaagagatgtgagggaaagttgtttttacatggttaatgtgccttttcctttttatttggcctttttattttttagatggagtcttgctctgttgctcaggctggagcacagtggcataatctcagctcactgtgacctctgcctcctgggttcaagcgattctcctgcctcagcctcccgagtagctggtattacagctaccatgcccggctaatttttgtattttttagtagagatggagtttctccatgttggtcaggctggtctcgaactcctgacctcaggtgatccacccgccttggactcccaaagtgctgtgattacaggcatgagccaccgcgcctggccaatttggcctttctgagcacatgacttttgtctgagttagcctgtgataaccatctgcttaggagagaaaggagggagaatgaagtggaaggaaacccagtccacacaactgtgtagggcccattgccccatagtggcaggttctgtggtaagaccccagctcttggggtatctggtatctcagagttattggggagtgccaaccaggcaaccttttggttagattatatccctctgtttcttaactggctcagctgccctgtgacagctcagagcttcactatgagctcctgctagagtctcagaggaagcaggacaagagactcctgcctcaagcatttcccacaactcatccaacattcctcccctaccctgcatctgaaacccaaagagggaaagtcggtgacatgatcttagtcttcctcctctctctttcttttccttctcacatccccccaagaactggaggagtcagacatcccatcccattcctctctggtccattcttgtaaaaatcctgtggtcttgccaaccaagtgcggtccttaatatgccgaaaggtggagattaaaaaaaaaaattagaacaaaacaccttccaaagacaaatgtcttccaaatgtgcgtgacttcacattgtattactgtctggctgccaaatcatttctgaatgttagagatttgaatattacctccttcagcagcaataaggaagtgcctaagtccacagattctagagtcagactgtcaggttcaaagcttggctctgctgtttccagtgatgtaactttgggccaaacctctctgtgccttggttttctcctctacaaaatggagttgataatagtatctcataaggatgcctgggataattcgattagctagtatatggaatagtgtggggtacctcataacccctttatgtttattatgtatacaagtgtgtcttcaccttcctcatcattatcaatatcatcattttttgtgttacttctgtaataaatctcaattcctcaaccctacccaggcatatggaagtcatgggccatccagagccaagcccacacactcaggaagacaagaagagaaaaacacattaaaaacttaaaaaatacatagtccataagcactgtgttctagttgataaagttgtgtcccatgaggatatgggttaacaattctgatattgctataattatgtactggaattgaacaagtaacaaatggatggtggataatgggagccaggtttattattcttggagtgggaggttacagataatcgagggaggaagctagaatgattcatctgacagtgagttagagttggagacatcaggatgacttcatgcttaggtcaatatagacacggatagttgcttctgtaaatttttgtagatatgtgtgtatatacatatattagcatacatatctaaattcccttaccttgtcagcatagagggagtagaaaaaaccagcacacctggcacctagattttggtttctaatattattctccaataaaatgaaccaggctccttgaagaaatggttgattcttggaccaggataacaaatctatacaagatgagcctggggaatcttgtattgccagaaagttagaaagtttaaaaatgaggggaatctgtcaaaggagacaattgaaatagtttccgattcccaaatttggaacaatctgagcaacaaaacaaaataaagtggtagtggattataacccaaggtataaaatacatatccatgtgtctacactgatatgaatacatgattgaatcaatacataaatgaggaagaagagacaaatcttccatgaggaataattccaaatagtttatgtagatatttcttccactcaaggaggtagagcataacccctactccttagatacggtgtgaatggcacacagtgacttctttccaaagagtaaaatgtgaaaaaaggggaaaatagaataattttatagaggagaaatctgtccaacacttcctaagccaggcaatagtttaacatcaatagcgatgagtcattatagtacatatttttgctatgttatgagaatgtcactttacctcagtgattcccctcactcccaaacccataaccccaatctaatcatgagaaaaatatgagacaaattccgtttggccaggcgtggtggctcacgcctgtaatctcaacactttaggaggctgaggcaggcagatcacctgaggtcaggagttcaagatcagcttggccaacatggtgaaaccctgtctctactaaaaataaaaaaattagccaggtgtggtggtgtgtgcctgtggtgccagctactcgggaggctgaggcaggagaatcgcttgaacccgggaggcagaggctgcagcgagctgagattgcaccactgcactccagcctgggggacagagcaagactctctctcaaaaaaaaaaaaaaaaaaaaaaaaaaaggccaggtgtggtggctcacgcctgtaatcccagcactttgagaggctgaggtgggcggatcacgaggtcaggagattgagaccatcctggctaagacggtgaaaccccgtctctactaaaaatacaaaaaattagctgggcgaggtggcgcgtgcctgtagttccagctactcgggaggctgaggcaggagaatggcgtgaacccaggaggcggagcttgcagtgagccgagattgcaccactgcactccagcctgggcgacagagcgagactccgtctcaaaaaaaaaaaaaagaaagaaaaaaaaaagtccattctacaagatatctgaccctgtacccctcaaaactgtcaaagtcatcaaaacagggaaagtctgagaaactgtcacacgcaagaggaatctaaagagatatgactaaattctaagtttaatatggtacctagatattttgaaacagaaaagatggacattaggtaaaaactaaggaaactcaaataaagtgtgggctttagttaatagtaacatatcaaaattgattcattcactgtgacaaatataccacactaatatgttaataatagggaaactgggtctggaggatacaggaactctctgtactatctttgcagtacttttgtaaatctaaaaccgtttcatagtaaagagtttgtttaaaaaatttattgtttgaggccaggagcggtggcttacgcctgtaatcccagcactttgggagactgaggcaggcaggtcacctgaggtcaggagttcaggaccagcctggccaacatggcgaaaccatatctccactaaaaatacaaacattagccggacatggtggttcacacctgtaatccagctactcggaggctgagatgggaggatcacttgaacctgggaggtggagattgcagtgagctgagatcatgccactgcactccagcctgggtgacagagtgaaactgtatctctctctctgtacatacacacacacacacacacacacacacacacacatatatgtgtatatatatatatatagagagagagagagagagagataacatgagaagctcttttcctactgtctggaacacggtgtgtgctcgacaaaacaacactatttgaccatctagtgcctttctgggctattcctccttgggatatgctttgaaggagtcattatgttgtctttcctttaagatgagccagaatggtctagtttctgacagttaatatttgtctcttctgcatggagagacttggagcattctctcagtatttataactgagcatttttaccttaagtggctctgagttgcatccgttttatttccctgtttagtaactaagatatcccacacaacaacaggagttacacggtagttaccttggcgcaagtctgccagatgcttccaatgagtaattgtatcttaaccttctttgaagacgattgttggatatacgaggctccttctctgtcttaggaaggagagcacaggacaccatcaatttgtcgtttgtggaccaagggtctgcatggaaaaacagcatcacagaagggcaagtcttcattcattatttcgaagggtcgtaatgagttgcgcttataatgggtggaggggggaattttcttgtggcattggataaggagtacctttccacagaggtgggtaagatatctctggggatggggaatgtctagaagggaacttctgagagtgagacatgttactggattccatctattgctatgactgtggaaaagaaattatatatgcgggccgggcgaggtggctcatgtctgtaagcccagcactttgggaggccaaggcgggcagatcacctgaggtcaggagttcaagaccagcctggccaacatggagaagccccttctctactaaaaacacaaaaattagccgggcttggtggcacatgcctgtaatcccagctacttgggaggctgaggcaggagaatcacttgaacctgggaggcggaggtcacagtgagctgacaccactccactgcactccagtctgggcgacagagtgagactccatctcaaaaaaaaaattaatatatgtgtgtatatgcatacatatatacttgtgtgtatatgcatacatatatacttgtgtgtatatgcatacatatatacttgtgtgtatatgcatacatatatacttgtgtgtatatgcatacatatatacttgtatgtgtatgtacatatgcatacatatatacttgtatgtgtatgtacatatgcatacatacatatatacacacacgtacacacatgcatatttcttctctcaacttggcaagggcaggatttgcagattataacctagatctcattcatgctgcattttttcactcaccctattgttctagttttcttggattccaacctgggcttatctccaatctgcatttttttttgtttctcctccctagctgaatatatttgtggaaaactcacaaagcaactgggttgccaggtctggtctctatcttcctgtccagtgaaaagaaaatgacatttagaaaacctagtcacaaatgtctgtttaataaattttgtttgttgccctgaaactggattttaatatttctgaatattcagtgcctggaagctagcacaaaatggctatctaaaactgccagaaatttgctttatgtggttcttaatgtgaaactggaaatgcaccttctggatggtgtcacttcttttgagagggatcgctttggtggggtattatggttgtgtctacttatattaagtaactactcactgcccctgaggtgtctcaggacttgggataaataatctaaaagcaaatactttataatggaatatcatgtattctgtttaataatataaaagtgtgtcccaacatattcagtgaggaacatctctgtagaattattttttttctttaacgaagtgtttagtattttctctggcagacctggacacagggtttgagcctagtaggttgagtctgagactgacggatcaaacagatgagagaaaggacttatactggaggataataggctttgaaggttcaaatctttaattagacagtctagtgtttgggatgtatttccaggggtaggggggcctaccattgagacattagttagcttactaatgtccttgggcacgctctatgcacgagtcagccaaattgttgtttgaaatttctgctgtagctctgtagaaaactgaggggcaatgcattttccatctcgaggcaatacctgggtttgccccatggacagccttccctctggtcagtttcagcttcccagaggaaatccagacaacaattgccttagtcagaactctacattgcaagtggcaggagccaggagccacaaaaaacactctttagaaaggggcttctctctctcctcagctgctttcctgtgggtgtgattcttattctttaataatgaagaaagattttctccacatggtaggttcaaattcacttgacttcatggccttttcgttgtttgactccaatggttccaagtagaaaagttgatggaagatggaagaactctgattggcccagcatagatcacatgctctcctctggtccaatcatcattataagaaggaggtattgggattggtttgattcaggctccatgctcgcttccatggccaggggtctgaattactgtatagcacaatgagccctcgctagctgggcacatactcacctgcttttcaactgccagctcttacatccctgagcgagggtatctctggccactggagctagctttgcctgtgaacatgggaagttgccagtgctaacgaattaacatctcccggaagcagctctcaaccaatgactaataggagtttgtgtgtaaatactaaggggtcctttgcccttggggtgacataattttgaggcatgcattcaatacgatttaccagaattccagagtgggattaaactccagtcgaccacattgcatcttgcttggcattgcactttatttgcttcttcttgttctctaactcccccatccttttgctacaagtatttcctgagatcacctgccaaatatgcttgcatttaagtcctttggtatgtttctttatcctttatcgccacttgagttgtgtgatgagctgccaatcacggtaactgtcttagtttgtgtttccccggaagtcactaagataaggactttgcacaaaaacagtagctatccaccaaaaaatatatcatgaaacacacacacacacacacacacacacacacacagcagcagcagcagcagcagcagcatacaatgagaacttaacagtaagccatttcccacaggaccaatacttgggaacaaaacatggctggcctgacatgcccaggggaagcagacaggaaccctggtgggttggctttggagaggagaatgtcagaggatcttgggctccaaggtgtggtgaaagccataccttatcaacaccttttctactgttactttattaatcctgggactctcccatcgcagctgaatctcggccaaaaagctatcgtggtagaaggatacatgcgtctctccagacgttggccaaagactgggttacttggcacttatgtttggcgacattcccatttaacacttgggcttgtgtgatggcccatgcaggtaaagtgataaaaatactgtccctaacctcatgcctcagctagggtatctctgcctgtttccatttgggtttgttggtttctaaagccacacattttccgtatgcatcaggggttgagttatctaaaagcaaagcctgggaaaggggttcagatgcatgtgactttgagggagtgttcttcaggtaacaaataaacacacacctctaaggttatgagggaagcagtgtaggaaaggttagggagccacacaaaaatggggctccaagtaaagtccagattcaggggttgtcaaactatagcccttgggtcaaacttggtaccacctgtttttgtaaataaagttttattggaacacagccacacccatttatgtagttgtcccacggtatccatggggatttggtttcaggaccctccaaggataccaatatcaacagatgctgaagtcccttataaaaaaatggcatagtatttgcatataacctactcacatcctctcatatactttaagtcatctctagattacttataatactagtacaacacagatgttatgtaaatagttgttacactgtatttttacttgtattatttttaactattgtattgttatttttaatttttttctgggtattttcaattcacagttggctgaatccaagggtgtagaacctgtggatacaaagagtcaactgtcttctgtctagggctgcattcatgctacaaaggcagagttgaatagtcaaagcagagactgatggcctatgtagtctaaaatgcttactacctggccctttacagaaaaagtttcccgactcctactctaaacttgtcccagtccatgtgaactctgaagtatcatcatttcataaagttatccccatgttgaggcaaggggctggtctttggacttcagtgtcagcgggacattggttgctgaccacttgaggatgaggtgtgtgaagcatattgaccccagggcagtggctcctatcagccaagagcaattctctgggtattgaaggcagctgtgagctgttagcagccaacatttgcagcagctgggaaatgggttcacatactagataaaggggatctttcaaggcaccactggcaaccaccgcagtgcatacctggatggacacacatgcttcatgaagccagagggaacccatactttccacctcaaagtgagccatcattatctcccagtgatgggatggatagacaggaggcgagacccattcccatttgggtctcgcctcctgtctatccatcccattgctctcaggatgaagatggtgacacttaccagtgttcactgggtcctgccaccctctccaaccccacctcattccagtttccttacactgtattctctagctgtgcatggccagagctcagagggcaattccttccgttgctgagcatgttgggttccatccagctccacggcttttgctcatgctgcttcctctgcctgaaataccctccctcatatcttccaccttccaccacactgaactattataacaaccctccttcctgtagatctcagctcagaaaaaccttcctgaatctctctttccttgaatctcatttcccttcaagcagccaatatttagtttgtttgtctttacatttgtttgtgtcttgtgcaaacttgtagtatgcaaaaatatacacataggttatattacttaacaaaaaatgctatactatttgctttcctttaaagcttccttttttccctttaacaatataaaccataagaaactgttcaagttttccttcattttttctaacacctgaaagatattccatcatatgtgtacatactatgtacatcatatgtattataataattcatttaagaattcccatattgatatgagctcagattgtttctgtgtatgtgttttcatttttacaaataatggtgcaaaaacatctctgaacaaatatccttacattctgatgcttttatttctgtaggctcagttgctaaaagtggtattgttcagtcaacatatacatacgctttacatttcaatactcagtgcctgatttcttcctgcaaatataggaaattgcatgtccaccagcagctttaagaggcctccctgtgctcagcatctctgccagtactcatgtccttcaatccctttaacatctgccaatctgttggcaaaggaatggcttctcattgttcttctgacttccatttctttgactgttactgagattgggcatctttttatacaaatatcatttcattgacaaaaataacctctctactgaaaggaccttaacatgttagtttaacatgttttgagcacatcttttgagatgatgtcagaaaaacacccacctgtcctcatttgctctccagtgaagactatgaactcaattgtgtcccatgtatctgtgaaccctctgctgttttgcgacttgcgtccctaaagggtggggagagttttggtctccagtgatgtggtgatgggagggaaggtagatggttctgccctgtctgtgacaatctccttctgtgtcttcacttccagatgccacccagatgaacaacgcagtgcccacctctcctctgctccagcagatgggccatccacattcgtacccgaacctgggccagatctccaacccctatgaacagcagccaccaggaaaagagctcaacaagtacgcctccttaaaggcagtcggtaagtgccacctgatggatctttttctctttctcctcttcgctctcctttgctgcttcttgtagatctctttatctccagttttctttcctaattcctttttctagctctctttttttctctttctgcttttctctgcctctatctcatttttgttctctctctgtctataaatatgtatatctatatatctatctatgtctgtctatgcattcattcatccatccacctatacactctatccatccattcatccatccacctattcacttatccatctacctacctacatatgtattatctatctgtctgtccatccatccatccatcatccatccatctactattcacttatctgcctatctattatctattgaatctatctacctattatcctatcatctgtctgtctatcatctatcaatccatccacccatccacctattcacttatccatctatctacctacctatgtattatctatctatcatccatccatccatccttctatccatctacctatccacttatctattatctatctatatcatctgtctacctattatctatcatctaactacctattatctatctatctatctatctatctatctatctatttatctatcatctttctatctacctattatctgtctgtctgtctatctatctatctatctatctatctatctatctacccatcttctgggtctctctacctgggacccaggtttctaaggaccagagaccctcagctgctttctctgacctagaacaagttctacattgctgtgtgaggcagggtggctgggcgaggggcacatgtgcggtgagggctatttcctggggagaagaacctggatgctcatttggtcccactgacactttaacccctttaccatctccatctaccctagctgatcctcagggaatcttgacatagaatctaggtctctccatcccagaaatgccttatactttagtgggtaacacccttcacctacaaagtccatcccatttctaagaagttggtaaacaatgcacgttcctatcccaggcaacttctgctcttcaggatttaagtatttacgggagtgggcagcctggggctgctactaatggagttcttaccaagtgcaagacattgaattaaacccttgttttctcatagtgattccaaggtgaagacacaatgattatcccaattaccagattagaaaactgagactctaagaggctaatataacttgcccaagtcaagcagcagtgggtgacagagctgagaattgaaccctatttttatccctccagagccactgcttccaccactgtcctggttccttcagttcattcttcaatttaaacatgagggggtgtgatagttaccctgacagtgactgaggctcctgaacagtttgctcataaaagggttctattggatagaagcaacagtcacagaaagcaattcctgactcctgattggctgtggcaacctcagggttccctaaatcaatggttctcacatgtggatgccaattactagaatcacctggagagcaggtaaaatataaggatgccccaggtccaccctggagatttcaattgaactggttgaggataagattcagacatgggcatttttaaagcactctgtggctgtttctagtgtgaagccaggggtgacagccattcatgaaaactacttcatcagtcccacatccaggaaaaccaaatcctatttcaaatgcttgctctgaatttcctcttctaatgaccttaatacatgggggaaattccttttctttccttctcactgtgtcctgtgagctctaagtttttctccctgtctcagaggagagattttaaagccaggctttccacttaacctgattcttctgagtctattccttggggagctagaaagagccaaacagatgtgagttcaaatcctggctctactgcttaccatctgtgtagccttgggcaacatttggcccctttttaaggtctcagtcttctaatctgtaaaatgggcctaaggatgcctgtgatgactcatattatagactggtaaaggacattcattcaacatacatttgtcacctcccttctccagagctccctggtcttgtttctagtagccccatggatgaatccttttctcatttccatcttagagcatgctcagatatcataggaaggtcttcttcttcttttttcttttttgagacagagtctcactgtgtcactctggctggagcgcagtggcacgatatcggttcactgcaacatccgtctccggagttcaagtgattctcctgcctcagcctcccgagtagctgaggttacaggcatgcaccactatgcctggctaatttttttttttttttttaagtagagatgggtttctccatgttgctcagctggtctcgaactcctgacttcaaatgattttcccagcttggcctcccaaagtgctgagattacaggtgtgagctactgcacttggccaggaaggacttctttaaacattctccttttccaacatggagtcctcaccttcccagcagaattgactgtcagaagctccgaagcattagaacaattcactttgagtggaatcccatttattggtagaggtcttctactctttagttattcataaaatttatttatttatctattctcacatagttttggttcccgaaaaactctgggcaggcagaaaaccccacaaaccatatactttcttttattatcaactgttcatcctattttctccccccactgccaagcccctcattggagatgggatgagagatacttgctgatcgatttcagtatgaaatatgctaatcctgttataaactaacaccagaacccaaagcactgacacaaccatgtgtctaagatgcatgtggtaaccataatcaacacacatcagattcacaaaacaagcattttggtgcctagcatagggccaggcacttcctaggtgcttagccagtgcttataccagaagtctatgtttgggaattcatgttccctgatctcttaagatttccagatggaatcattcaaatagtgactgagccaaatttataataccaaggacacaggatgtgcaaactgacacaggcttttctaaatctgaagccttgtaagaccctacgtactggttacccatgtttcacattgaatttctatgcccagctcaaccctcgttatgtcccatgaccacagattccttctattccatattgcctgtttgcacagcatatgcatcctaactgcattcaaatatactcagtgttactaggaagggatgagggctgttacctaggagagcaagagtcacggcatctttgccagtgtaactgtggaagccttcatatgctatttggtggcccacttccctttctgagcctcgcagttagatgataaataacatatgccattttattttattcttctttaggcatttaaaaaatcaacaggccaggagttgaagaccggcttggccaatatggcaaaaccctgtctctactaaaaatacaaaaattagctgggcatggtggcaggcacctgtaatcccagctacttgggaggctgaggcatgagaatcacttgaacctgggacgcggaggttgcagtgagcggagatggtgccactgcactccagtatgacacccagtcgctccctgggaaaatagcagagggatattctaacagaaattccttgattttatccaagatttatgtggagctcctctacatggcaaatgtctgcaatgcatttgggattaaattttcagtgtgaaaatcatttcacactctttgagtaaccctctgttcataaatcaggaacttctgaaatgtttgttgaatgaatgaatgagcttgtctttgacaagaataaaaaaaaaaggaatagcttggttgtaaggaagcactctaatacctcctagaaaactctgaagcatcccacgtgggacaccttccccagtcctagatggggttgatgtaccccctcctgttcttcatcctttttttctgaccactgtgagagttctcagggctttctctgagacataggtggtcttgtgaatctggagggccaatgaggagcagactgagggattgcttgactcaatgggttagccaggaatccagcatctgcctgcacatataaaatgcaaatcccataataaatgttctttcaagggttctttgttaaagcataatgtgatcatggtgtgaatgatgaaatgcattttattaatgaaattattaccagccaggagagaagttgtttaaaaaatggtttgccattgaaagttctgcaacctccgataagcagattcattttctaaatatttcaatccagagaataaggagaggttagacaatctttagcattcactggtaagctcaaaaatacttctggaaaataaatttctctgggaagctttaacatccagagctctgggaagatgatcagaggctctgtctcactcagactctaactgtacttagctggatgactttgagcaggtcaatgaagctcttggacttcagcttcttcatatgaaaaatgagaaaactgaactataagatgtccaagttccattttaattttaaaattagaaaattaaataattctactcattctagttattagaatgccttaaacatgtgccattcatttcctgccaactcagggaaaaaacggtttgaataaagggtgttaatgttggttgttcctgaggcaaattctccccaaacctgccttcctttctattttattgtattttatttttgtttgcttgttgggatcaccctcactcatgtttaaagagacctcttttcctttctttttctttttttttctttttttttttttttgagacagagtttggctcctatcacccaggctggagtgccatggcgcaatctcggctcaccacaaccgccgcctcctgggttcaagcgattctcctattgagagaattggacatgcaccacctagtcatacatggcatgtaactgcagaatggtttctgttcccaagggtttcactgcccagctcttggtaaaatattagcacacactggggaattgttagtggctaaaccgtataggactttgtaccagaagggatgatgactttgaattattccttcagttgttcattcattctccaaacattaagtctggtttcccttgactgcaggtcccactgaggcatgaaccaaatctgtcccatttgtcaatgtatccccagcacctagtgtcatgtggggtgcttagtaaggactcccaacacctatttgtaaaactagtgaataataccatatgagaagcaccttatctagcctgagaggggccttagagaatcagcaggatagcagaatatagcacagcctctggaatttgtcagggctgagtttaagacccagcttggacatttatcaagtaattggagaaattatttaacttcctcaggtctcagtttctccttctgtaaaatggagataataatgataacacacagataatggcttagaaaatttgatgatatagtgtaggtaaagttcttagcctgacatatgtcagtcctcagcaaatactgcagcatattaaagacccagaccagagttatctgcggtcatcattttcccctgatctcggagatacgctggtacctggattaacatgcaattgcccacatttcattttgagggagaaagggttggttccatattctttactccagtctgatgggaaagacatacatgaaagttaactcatgtcagggatctgataaaacaagcaggcaagcaagcaaacaaatggcttttctaagctgtcctaaggaccctcaaagaatcagtctagacctcttcaagttccccatcttcagggtggacaataaaagttgatgcccaggcatatagatactgtaatgttagccatcagagaaatattctgtttcaatacaatccatcagggaactattctttttcactcaattgactctccttactaaagcaaaaatgtaatgtggatttaaacatttcccaccaatgttgaggttgagaagtgggtcttgttatagaccgagccaaaaatgtaacctgaaaatccagttaagcatacaagttccctggcctgaggtgcccatatggttacaatatgggagcctaccttgtgattcttcacaggccaaagtttggaagacagacgtctttatgaaaatatccctaggccgggtgcagtggctcacacctgtaattccagcactttgggaggccaaggcgatggatcacggggtcaggagatcgagaccatcctggttaacccagtgaaaccccgtctctactaaaaatacaaagaaattagctgggtgtggtggcacatgcctgtagtctcagctacttgggaggctgaggcaggagaatggcgtgaacccgggaggcggagctcgcagtgagccaagatcacaccactgcactccagtctgggcaacagagcgagactctgtctcaaaaaaaagaaaatgtccctaaagctcacttggtggttcagagagggatgattggtacttccagaactggaaaagatcaccctttcacccttttatgtaattcctgatgggctttgcaaacagaaagttgcctgcacattgacatttatctttcattagccccttgtccagtttttcctctaggtttctgattattgaactcctaagtgaccaaagattcatgatcatgtgcccttaagatggctcaatgcaaccttggccattgagtataagaaagagacaggatgtaccagcatcattgataaaatgctgcgtcacttcatttctaattcaaaattttaattttattaaaaaaaaattgtctgtgttgctatttgacagatgattgacattttgccagaatcacaaggcattttccaatagcactttttgaaacaacagcaacaatacacttcaatatggcaggaattccctctttactcttggaatcatgagtgaaaaccctaaaagccatacatgaggcacttggccatggattggcctctactagtttaatttcttttcaagttagggcagaaagggggctcacatcactgagctcataaacagcacacctctgagggaggcatcagtaccccccgttttgcagatggggaaacaagcttagcatagttatttccccataatccgtacttttagtaaatggcagagccaagtctcatattcaagagtgcttgacttggaatcctatgttcttcccatgaaactatgctgtcttctgcagagaaatttctagcatctaaagtatgtaaccaggcaaaagaaaagctggggaagcctatcccctgctcttctgggggaaggagagcttaccaaggtactcatcatttttctttgtttgaaagtaaaagtttggctgggcacagtggctcatgcctataatcccagcagtttgggaggccaaagcagacagatcacttgagatcaggagttcgagaccagcctggccaacgtggtgaaaccccatctctactaaaaatacaaaaattagccaggtgtggtgctgctcgcctataacctcacctacttgggaggctgaggcaggagaatcacttgaacccggggggcagtgggggtggaggttccagtgagtcgagattgtgccactgcactccagcctggacaacaaagcaagactctgtctcaagaaaagaaaaaaaaaagaaagtaaaaatttccctatgatgttgagtataattgaactctagtgtatttgaggtatgctatactggaggtatattttacatacagtgacatacacagttcataattttacaatagtgtgattgtttaaaaaaaaagcatacacttggttatccacatcccaataaaaatgagaaatattttcgtcacactgaaagttccctcatatctccttccttttaataccttaggtctacttcctcttcatgagcatttttcaccctcaaagtatttttctaatgtccatgagtgtgaccaagtacacagtggagccttaactaaatgttccgtagcctatacatcatcttattaaatgccctattgtcaatgaacttataaatgaaaattcattattgtaatagctaagccctatctgagctaatgggaacagaggtgacaaaataatggttcctgccttcaaggcaaacagcaatggatttaatttggggttcagatggcttccctggagtcagcgacttgttggcttggtcagcgtgtggccatccacacaggaagaatgggggtcgcaccactatttccagatgaccctggctatgggggagaagagaaccgagtcatcctgggtgggcccgactcagttttaacttcctcactcttctctcttctgttgctccaattgtccctcttgtgagtgatgaggggtgtacagttcagatccacgggggggatgtggcgatttgagcatcctttggcacgcctggggaggccagccagaaatgtttaaatggggccggatctgtgctctgtaatcattcagatgacagactgttccctgcgccttcactcagcctgatatatctctggaaatagtgccaaactgttgaggacttggtctttctaggtagatgcctaagaaaggaaagagctaggaccacacgctgattggccaggtctccagccaatgaggagaggtctcgtgggtagggttgccccactttaagcaaaacccaatcttacagagaactatcaaagaaaatgcgaggttggtgggggttgggttgggtatagccttggccaattctcagtatccttcattttatgaaaggagtcattatggaattctgttaataatgttagatctcccagggctcattcgggacatctgaaagggaattcaattcggataaactgatttataatgaaaactccaggcacacacctgttctgtaaagcaatgtattactcattatgggattctcagataacaagcttgatctcgttaccgtttagaatttccctaccttagaaagggtgactctgtggataaaattgaatgcattccttcattcagtcatattttccaaacacagaatgtgtgttaggtactgtggtaaggtagcccccaccccatggggcctgtcacccagcatttaaagtcgcagtcagtagagcctgtcccaaccttgaatctggggctaataatgtgccccttttcaggagggggattgcagtggaacacgatcaaagtctatctcttgtcatcagagtgtagtcttgagccaaggtgagctcatataactcaaactttcctttctttctaagcaggttgaaatttacagccagattttctacctaagaattatctttctgccttacgtaactgaaaatatctcggcctttttcaggaggcttcttttgatcttctgttgggtgttaacgtgaggctgcttcaaggccttgcagaaagaggtacacacatagctgcattttcacacgtggctcccttccctgttccctgggtcccctgaggcctgtccctgcttggaggctgcagcaggggcagccaacagcacctgggtgtgagggcatagtgaacatgggtgccctgcaaacagatcatcagcatttcttgattgttatttttttaggaagttctgatggtgactgggcagtatcgacacttaagtcaccaaaaggtactgtacagctttttctagctcttttgtccaggtgttgtcaaagttagcattaaataatgaagggatagagagtcctggtgtctgtgtgacctgtgcacatgtgtgtctgcatagggtggcatctgcaagtccgtctaagttccagtgtgtaggtgtttgtgtgtttgtgtgtgtgtgtgtgcatctagcaattgttggacaacgtggtagccctcacttcccaatatttgctgcctgatggaaaatatcactatgagaaatcatgccaggtaaggtgaaatatgttgatttttctcagaaagctgcaatggcaaatggcaaaacacaaggttaattaatgggggcggggcgggggaagaacacagcttctgagggagagaaaaacataatcaagttattggccaagggtcttgggaatgactagccttttagagaacagaatgctattttcaactttcctgggacagcgtggtgagcagagagggttaggaagttggtcgacttgagtctgtgagttaacccagctgggtgaccagaccaggtggcagctatcattaattagcgccctactatgtgccagaggactggccctttacatcattttatcatttaattctatgatgatcaggctgtgtaggcattgtcatctgcatttagaaatgaggacatgatgtctaagtatggataagtcttgctggtctagagtcatgtgactattcagtggtagatctgcagtttgaacctctatcagtctgacccttattctaagctattttccactagggtgtaatggaagcagctctttttagaatagaccagaaacacccttctccatatgctttgttggacttggtggagaagtaactgacctaaggaggtggaggtagaactatttatctatttatttatttatgagacagagtctcactctgtcactcaggctaaagtgccgtagtgcgatcttggctcactgcaacctcctccgcctcccaggttcaagggattctcctgcttcagccttctgagtagctgggattacaggcacatgccaccgtgcccagctaatttttgaatttttttttttagtagaaacggggtttcaccgtgttggccaggctggtcaaaatcctgacctcagatgacccacctgccttggcctcccaaagtgctgggattacaagcatgagccaccatgcctggccagtagaactctttaatgagctcgaactggggaaaattaggagacattgccaggatatcagcaagaaactggtgtattagtctgtttcaatgctgctgataaagacatacccaagactgggcaatttacaaaagcacaaggtttattggactcacagttccacgtggctggggaagtctcacaatcagggcagaagggaaggaggagcaagtcacatcttatgtggatagcaaagggagagcttgtgcggagaaactcccatttttaaaaccatccgatcttgtgagactcactcactctcacaagaacagcacaggaaagacccacctccataattcaatcatctcccaccgggttcctcccacaacacctgggaattgtgcgagttgcaattcaagatgagatttgggtgggggcacagccaaaccatatcaatagttgtggccattttttttttgccgtttcaaaagattattctggcttctaagtggagactggattaggggactgtggactagagttgcagacacccactggaaggctcttgcaggtgggtggtgacctgcactgaggtgggtagaggatggagagaagaaaatgggagtggaaggatcattgagagactacaaaaagtactgagtgaggagggggagggatcatgagaccaatggttctcacgttgtaaccagcttgagcacacatcagcatcacttggagggttgttacaaacccagattcctgggccttacccaggagcacctgattcactaagccttggctcagaaacatcctgagttgttgcagggaggagagtgcattctattccctcattgggaaagagagctttacatcagtgtatttaatgagaatcccctgactacctggctgttgccttcagagagacagatttttgggttttgcattagataataagtattcacatgtcaaagtccatttttagaaatgcaaacaatttggaacatgacagacctcctaatttgaggcattaacttcttttttccctccctgtgaaaaacaaagccgttatgatctctgtgacagcatttggaggcagcctgcatttctgtccttatatcatccttttgttgtcagatgcatttagaacatatttcagtttaggttaaaagcaaggagctgttttctacccaaaccaagctaacttcacctgtcctgctaaaggcacctttatcctgccttgtcgggggagaggaaaagtggtcccagtgagaaccaagttcctctggggtcattggtctgcctctagtgttctctactcaacctctagacccagactctagatgaggtatggtagcaaggttagggagtttgtgtgcccccaccttccacatcctgccactttcttaaaagggagagagacaggctgggtgcggtgtctcacacctgtaatcccagcactttgggaggctgaggtgggcagatcacctgaggtcaggagtttgagaccagcctgaccaacatggtgaaaccctgtctctactaaaaataccaaaattagccaggcgtggtggcacgtgcctgtagtcccagctactcaggaggctgaggcaagagaatcgcttgaatccgggagatggagtttgcagtgagccaagatcatgccactgcactccaccctgggcggcagagcgagactctgtcaaaaaaaaaaaaaaaaaaaaaagagagagacaatttggatatgatgggcttagactcaggcatatatgggttccaatacaggcaccatcatttgctagtcttgttgtcttcaacctctctgatcccctattttctgatctgcaaaatggagaccatcatatcacctacctcctaggtcgttgtgagataaggtgttgaaaacacgtgtcatagtacctggcatatggaaagtaataaatgcatgcagttcattactggtattagtagtactgttattatcagatgagcaaattaaaggctctgaaaagccttgtggtaataaaaactggtgaactctttttaacccaccatttcccaaacacttttgacatctgatctctttgctcttaaggaagaccgatgaacatcttaacattcagtggcatgaatgttgctgggaacctactttgggaacatagggcgtgggcagagaagtaggtagaggtgcagatgtcactggggagcagtgggggagatgggaaaaggaagaggtagctgtcaaggggaaaggacaaggtccttgaagatacaagtttcttactgccacctgcattgataatgactccctttggagtgtgtctgccaggacaggaaatgataaacatcatgctagttggtacgatttatttttcaccacctagggcttcccatgcaagttgccccctagtggtcactgctattgatccacccacgcccagccttggaaacaactgtcacaccattttaaaatccacccacctgtcacacctgtttaaagtccaccctgggctgggcgcggtggctcacgcctgtaatcccagcactttgggaggccgaggtgggcggataacgaggtcagaggatcgagaccatcctggctaacacggtgaaaccccatctctactaaaaatacaaaaaaaaaaaaaattgcagggagtggtggcgggcacctgtagtcccagctactcgggaggctgaggcaggagaatggcgcgaacccgggaggtggagcttgcagtgagcagagatcttgccactgcaccccagcctgggtgacagagtgagactccgtctcaaaataaataaataaattaattaattaattaaaataaaatccaccctggaagacaccatctcaagaccagcagactgtcttcaccaagatgaagccgtgtctttggaaatctgtttattttgcaaacagaaactttaaacttaagcccagtgctacagcaaggcaatcaaattaggagaaactgccagcatagactgcagtgtaatctctctgcttctgactagaatcagcctgcgtccccctttccaagctacatacatgctccacgctcccatttctaccattgctccaatagaggaaatcagagaatgtactctctgtaggttttgcacagggcttggcttggtatataataggtgctaaataagagtaaaagaggccagtactcacaaagtctccatttatctctgctttggagatagctcttagtcatcctgatggaatctttcagaaggaaatacacttcactaggccgggcgtggtggctcatgcctgtaatcccagcactttgggaggccgaggtgagcagaccacttgaggtaaggagttcgagaccatcctggctaacatggagaaacctcatctctactaaaaattgaaaaattagccaggtacagtggcatgtgcctgtagtcccagctacctgggaggctgaggcaagagaatggcttgaaacgtggaggcagaggctgcagtgagccaagaacatgccactgcactccaacctgagaaggaaggaaggaagggagggagggagggagggaaggaaggtaggaaggaaggaaggaaaaaaagaaggaaggaaagacatttcacctagcttttctgcttttatacatgaggaaactggggtttcctaaaaccgcaaaagaaaagtacgtcacaacaggaccagggtccagacctcaaagaggggcttgaggacttgacccagaatcactggagacgcttgttacaaatgtagatcctgggcccactcactcctaaggaattagaacatctgagtgtcgtgtcccagtattcatttttaaaatgcacctcctgggtgattcttatgtacattagagtttagacctagcttttcctaatcccccaccctagatgcaatcgcagtttgcgacacagcatccgtttacataccggcgttcttcccaatgtatttttgctgtttgctgaaataaaactgttttcttagtggtgatttgagctggggccacagctggacggtaacagcattgaaagtggatagtgttgggtttggtttcttgctctgccacttattggcagtgacagagtaatttgtcagccaaattatttaacatctctggaccttagttccttcatctgtcacgtggaaagaatgatattgcctgccatgtctctttaagagggtttaaatgagacaatgtacgtaaaatcgctaaaccagtgtctagcccatagtaggtactcagtacatgctagttctttccttcttctaagaaaattgacttagcccaatgagaaatgctcatgcaggaggcacaagacaatagacaatgtgcaatagggttacagttccattggagtgcatgcatcctatagaccatcccaggggagggaacacccatcgaaaggcagctttaaaacattacttcatgaaatttgggcttttgcaatttcctgattttggttattggtttggtcatgagccgccgggtgcaaagcaggtggaagacaggagggtgatgtgaggtgaagttttttaataaaaatcaaatcctactcgctcctgagttcagtcccctttgaaaagcacacagcaagtgctgggattttgatgagcttccttgggaacccatagggcatgaaatgaatgcgcaaagagggttctctggtttgtagaaaatgctcttgcatcaagattgcaataaacatttgactagtttggccgtgtgtccttccgaggctaacccagccagatcctgttcattccaaagccatcttgcgtgacactcacagcacacacagtaggcaatcaacatatattttgttaataaattattaaatgaaactgggcatagtgttcaaaggaaattttgtcttttctgaaaaggtactgggaaatgagaatcaaccagagggaagtctggaaacctgtattctagacccaatactggtttatccatgtgacagtctttgagcttggtatataacaggtgctaaaatttcctctcctgaaagatggaaagcttgagactattaatttttttgccccctgagcctctgtaagtaaatatcccaggttttgctctgattaccttaccttgtcatgtgcccacctctgaacaaatttgtaggaggagggcaaagaaatggagaatgcctggggcatggggaagtggagggatatgacatccaaaccacatggattaggaataggagagaggctttgggaggccgaggtgggcagatcacctgaggtcaggaattcaagaccaacctggccaacagagatggtgaaattgtctctacaaaaatacaaaaattagctgggcatgatagtgggtgcctgtaatctcagctactcaggaggctgaggcagaagaatcacttgaacccaggaggcggaggttgcagtgagccaagatcacgccactgcactccagcctgggtgacagagtgagactccatctcagaaaaagaaaaaaagaataggaaagagatgcatctcacctgaaaattgggggctcttcttggaagtatggtgagtgaatgattggcatttttatcagtcagctactgccacaataacactgcgtaacaaataacctcaaatctcattgcttaaaatgtatttagaccagcatttatttagatcaggagtctatattccagtgatttcagctgatgtgggaggttcttcttatctcaggtgatttcacccatctctctgggagttggctggatgttgggtgatctaggctggttttaactggaatgacttgggtgacttgactctgctccatgtgcctcatcctcaaataaggcagcccagatatggtctcatgagggtgggagaggtgcaagagagaaattcaaaccagcaagcacttctccaaatgcctgtatgtctcatgtctgctaacatctcttagtcacacggaacagagtgtagagatggagaaagtcaaagaattgattcatgcattaatctaacataggatcccaaatctcataattatctacattgacatggtcccaggaaactacagccaagaggaaggtgacaagtagggcttagaattctttcccttaatttgcttcatttagaaaaccaccagttgtatgaaatttcaccagctgggaggatgattggaagacagaccatgcaatgaatttctggaaaaaaaaaatctctatctatatagcagcaatgcacaggaaggcagtgagtggatgcagttccatccagaaccctgtgtgggaatcggtgggaggggatctgtgctcagccatggctggagaatgagcctgtccaccgttgtccagtagcctttcagaagatgttgactgcacagcaggactgcctaagtgaagagagaaagggcctgaggtttcagagggctcctggcagccacaacaaagggggcccatggtacaggctggacagctttgttgcaaagcccaagccaggggctgttttagaattctccctagcaaaggctccctcctcactctggattaatagtttgcctatatatgggattttagaaaaaaaaaaaatcacagtaccaccgcctgttgggagccttcagggttaagactaaaaaagggccaggctcctggacgcctttttccggttttctctcttagagcaatatggctttgggaaagatatggtgccccgtggggagggccagatgccccgtgcttctttaggacctggttcatgtgcagcctccgctacttgtgtctctgcagcaaggcccggaggcaggtgaagtgcaactaattcaccataaagacaaatcttccatctactccctggtcctctcctgcttaggaaactcaggctttttttttcctgcctttcttgtttctgtctgctgagacagcctctggaatctgcacaactttataccatgtagttcaaaagaagagagaaatacctggactttttttttttttttttttaacaacatgaactctttccctatcactttttaattcagcttgtgaagaagaagaaagcagagaccgagaaaacggtcctatataagttaaatactgttttacggtactaaaatgtcccacaaatacagtgcttaagagaaagaagtatttcttttttaaacaactttattgagatatgattcacctatcatacaattcacccatttaaagtgtaaaatccagtggttttcagaatgttcacagaattgtgcaaccatcattacagtcaatattagaacattttcctcatcccagaaagaaactctataaccattagtagacattttccatctcttactgtcttagcagtcctctcccagctaacccctggttcaagcaatgacttgcctattttgtgtctttatatatttgcctgttttggatatagctgtctcatgtgatagacctgtattagtttgttttcatgctgctgataaagacatacccgagactgggtagtttataaaggaaagaggttcaatggactcacagttccacatggctggggaggcctcacaatcatggtggaaggccaaggggaagcaaaacacgtcttacatggcagcaggcaagagagtgtgtgcaggggaactccccattataaaaccatcagatctcatgagacttattcattatcacaagaacagcacaggaaaaacccacccccatgattcagttacctcccaccaggtccctcccaccaggtccctcccaagacacttgggaatcattataattcaaggtgagatttgggtggggatacagccaaaccatatcatgacccaaggagagtaatccaggttggtgggcagctctactccgagtggtcactccaggacccaggttcctccaaccttgttgcactatgactcttaccatcttgtcctcatctgcattgttatagttggttgctgtcactgtgtaattctggcctgggggaagagggaagagaggagacctagaacaaggatttctttttttaaagcaagtcaggtaaagcagaaataggacacatcacttttgctattatttcactggtgcgatatcagtctcatggccaaatgtggcttccaggaaggctggtaaatctagttctgagttgagtgaccatgtgtccaagaaaaagaaggtagactaaatctgatctgggagataagaagcaggcagccacagcatcttctctgatgggaatgtacatttcaggagatgtaccatgcactatgcataatgttctgagttttcgcaagccttgtctcgtttacttctacactgcactccacaaggtgtgtgtgtatgtatatatatatatatatatacatacacacaccacaaggtgtatatccacaaggtatatataacattatcctaattttataatctttatattttctgatgacgacagaaatagcagttactaccctttggatacttgctatgaggcaatgacattggccttttttcaggatgcaacgtcctctacacgattctcttcaatactctccatccccaggccacataggcctggttattttagtttcaattttataggtgaagcttagagatttgaacccagatccatctgctgtcaaagtttatactctttcctccatatggtaaagaagattttgtagtcacaaaagtcagacatggctgggtgcggtggctcatgcctgtaatcccagtactttgggaggctgaggcaggaggattgcttgagctcaggagtttgagacaggcctggacaacatagtgagacacccttctctacaaaaataaaaacaaaaatagccaggcatggtgttgcatggctatagtcctagattctcgggaggctgaggtgggaggatcacttgaacccaggagggtcaagtcagtagtgagctctgatcatgccactgcacttcagcctgggtgacagagtgagatgtgcatatttccaaactttgttatctgtcatataaaactggtgcattgaatccttcaaactcccagccatattaactcctctttccttctcaacattcccagatctcatttcttgtttttcaagactgggggctctaccatagctttcaagagcctagtgtaggattcaaaaccaacacgttggttctttgtcatcatttgtatcagtctgttctcatgctgcgaataaagatgtacctgagactgggtaatttataaaggaaagaggtttgatggactgacagttccacttggctggggaggcctcaaaatcatggtggaaggccacggaagagcaaaagcatgccttacatggcagcaggcaagagagggcatgtgcagaggaattcccctttataaatattgtcaaagaagcaatattcattgtccattgcaggcaatgtagaatgcctacattgcaatattctatactgcaggcaaaagcttccataaatattgagtgtgatggccataacttgaggcagtggagccaggtgtcctgggttcaagtctcagctccatttgttggataaacagccaaagctctctgagcctcagtttccctacttataaaataaaaccaatggtaacacctacctcattaggatgttgagagtattgaaggggatagcaaatgtaaattcctagtgaaggcagtagcatagaacacacacttaagaaaggtgagcaattactcagtttgccattgacaagagtggggaaatagagaggaagtccctgtctctactcagacttctgatatacccaaacagtctctttaatcaatccctgccttcttcacctgactttattctacctcccttcccccgagctaggtctgctaaagagtatccaggtctctgcaaattctcagacaggaaaatggatcctagttcgcctgtctgcgacataaaagcacttaacctgagctccagcccttcaatccctgtaaagaacagatgactcagtcttcggtgatacagactgaatgaccaggagatgaaatatcctgcccatttctcatatttcagggactgtcattggaactggaatatcatcagtgctttccttctttcatcacgtgcatattattgcacgcctgctgtataccaggcactgggctgtacgttgaggatacagcagtgagcagaacagacacaacctctgccctaagtggagctttatattctggttaagggagacagagcatacacaagtaaccaaaaaagatacctttatatagtaatatgagctatgaacatattaaaatagggataggtcatcagagccattggtggaggtgtcttctttgggtattaggagggtttttcaggaggtagcctttggtcacaggtccagatgacaagtagtatttaggcagaggaaacagcagggatgatgtccaaaggtcctgagatggtgacaagcttggcgtgttcaggaacagaaaggaatctcatgtatagtggaatagtacccccctaaatccttgtccattcagaacctcaggctgggaatgcacatggaaatagagtctttgcagaggtcattgagttgaggatatattgaattaatgtgggccctaatcctgtggctgatatccttataagaagggagaaatttggacacataaacacacgcacacacacatacacacacatggaaaatggccacgtgaagtccaaggcagagattggaatgatgtagcttacaaggcaagagatgccaaggattgccagcaaccaccagaaattcgaagaggcaagaatggatcctctagcagagccttcagatggagcatggcccggccaacttctggcctttggaactgcaagagaatgtatttctgctgttttaagccatcaagtttgtggtactttgtgatggcagctttaacaaacgaacacacactgtgatgtgttcacaataggtatggagcagaggagggtgcataagtagctagagtccacgtcaaacagacctcagggaccactgcaaagaatttggattttgttcttaagtgtaatgagaagattaattgctgtcttttatcatacccttgagcgaaaggcagaaaccgatgaggaaatgtgaaagctttggttggggcattgcttaccaggtgaaatccatcacctgtgacccaggaatattaccaagaaagaatgagtggtaggaacccctccctaagatatctttgcctcaaggaaaggaggtaggtgggaggctgcctgctgagaccctcagatgtgcagcttgttttgggaactggttattaccttgacgttctccctttccacggaagccaggctccatcccgccccgcacctgtacaagtgtctgctgctaattaagagagagacagatggaggaaggtatagtttaattttacagccccagtttcttcaaggcaattaggctcattagaaggaaagcaccttttcctttcttcttcttcttttgtaaatgaagaaaagtcaaataggagagggccagtgttgttgaaaggctcacacatctgtttcctggtcagtttgtcggccatctgcccatgaggtaccggggctgattaggttaatgcatttattaatggggcttacaagactgttcaatgaatctgttattcttttgcaagtagctttttaatatactaagacagggactacactgcacaaagccaagagtggctagataagcatttctttcccctcacctggctccaaaccagaggggaacagaaacattatgaaaacaggttttcatgaaaactgcacttccaggtaatggaaatgattcatccatctaacctctaaccacctccttgttgttgaaatagtcttgaaaatatctctttggaggatagtttcatgcaccaggcaccagttcagtgcctacactgtgcttctctaagagaccacctgagtcctagggtgggagaatggttagttaaatgaataggcatgaatgatataatcttgcctataggacattagatggcctgaggatcccttgccttcttcatctataactcagatatcctttcaggttcttgaagctactcggctccttctcacctcaaagcttttgcaaatgctgtcatgtatcagttatcaactgctgcataacaaatgactccaaatcttagttgctgagcatagcaaccatttatcgagatcatgattctgggtcaacggagaagttcttgtttgggctggattggctcctctcagttggattttcttggtatctgggtctgctgttaggtggctgatggtctaagatggcctcactgaacatactgcagttagcagttggttagttgtgttgaacaggggtaactggtctatgggtttctcatcctccaggagtctaggggatcccttcttcacatggaggcagatttcaagagccttagagtagaagttgctagaatctactggtccaagctcaccataatgccagaacatattcaaggcatggggaaatagattccacttcttgatggtaagagctgcaaagtattttggtcattcttggaatatgccacatattccctcacgtgggttgctctttctgttactcttcaccttctgatctcagcttaaagagttctttctcaagaggcaggatgaatgcctgcctctctagtagaatgtttattccaggatggcaggaaccatgtctgcttctgtttccgattgtctttcatatttcaagtgtccagcatatggtgggtacctgtttgatgaatgactaaatgattgaacaaacagctcgaagactgcagcatggagaatggattacaggaggtgaaacaaggcaaggaggccagtttggttactgaagtagaacaatgttcaaagggggtaggagaaagggaataggttaaggaaatatttgttagatatagctggaaggacttgttggtttgacagttgtgctgcaagagaagaggagaatgaagtcaaccattgctcccaaatttctggcataagtggctaaggagtgagtggtcccacgtgagatgtaaggaaaaggctgaagaacagatctgagtaatgttgctgggttcagggatgacaaccttgggccagagatgctattgaatctgtccgggaggtaactggatatataaattttgaagtctaaaggggaatcttagattatttttctgttgaagtttcatggcactggaaatcttgaactttcctctaaaaggcaggaaaataggttcaaatcccagctgtaatgttagcttgtgctaccttaaacaataaagcttccctgaccaccaactccctcctgatcagatcaaggcccctttgtgtgccctttcatggagtaaactaggcactcaacaaacatggtgggtggaagaaggaaagaagggagacagaaaagaaggcagcttggtttggatgaatgcctgctttgtgcctagtaagttgcctaccatagagtaagtgttcaaacaatgtctgtcaaatttaatccagggcttctttcttaaggcagggaataggtaaaatataggtattgagcatttactacattccaggaattgtgctgtgtagcaggtgtatctcatgcaattcattgctcacattaaatccaagagtggttaatattatccccatttcacacctaaggaaacaggcataaatggttaagtggtgttcccaaggtctcataaactcagatctgtctcattccagagcctgcagactttctttttcactccactcttgccccaagtaccaaacactttctgtgctcagggagtacccaataccagattcaccaagcaaccagctcagagttaggttaggaggatggtgtggattctccatgtgggacccactgtttcctcttaatgggattttccccccatctgcacggatatggacagacttgaatgcctctgtatctacttttctttagaactttctgaggggacatcatgtattgaagctgctgggatgcttaactcataatttattttgtctgcttctcagaaacaggaaccattgaatgcatcccttgctcagagcagacctcagactggtctgatgtctggaaagaggaacatgggaaagaatgatgctggatcattataagacatttaatgagggcgagtgagatttttcagtgaaagattactgggaggaaagtgagaaagatagcttccacccctattcttgccctatattctctatgttctcactgtattttgctcatatattttttttaatttttaagttcaggagtacaagtgcaggtttgttacataggtaaacttgtgtcatgggggtttgtcgtacagattatttcatcccccaggtattaaacctagtacttattatttttcctgatcctctccctcttccctctctcatcattcatcaaatatttactgaggccaggtgtggtggctcacacctgtaatcctagcccttcgggaggccaaggtgggtggatcacttcaggtcaggactttgaggccagcctggccaacatggaaaaacgcttctctactgaaaataccaaaatcagccaggagtggtgtcacatacctggaatcctagctacttgggaggctgagacaggagaatcacttcagcccaggaggcaaaggctgtagtgagctaagactgtgccaccgcactccagcctgggtgacagagcgagacactgtctcaaaaaaaatttgactgagtccttaatatctgccaggaactaggctggacattgcttatataatgctggccaaaagtcatacctcatcttggaacgctagtgagtgagacggatgataatgaatgaactgcacaaacaagtataaaatgacagtcatgataaatgccacgggaggagcttattatggagagatctgactttatcggactttctagaagggagagggacctcaggggagaggcagctgggcataataggagtgaagtgatacttccctttagttctctaacaaaaaacacccctatgtgctggaactgtgaaaacggcagaggctatccctgtggttctcaaccctggctgcatattagaatcacctgagggacttagaaaatatatgtctgggccacaatctctgaaattctgatcaaatggttttgggaaggggtccaggtgtctgaacacttttaaagctcccccatgtgatttccatgtactgccaggactgagaaccactgagccacccagatggaaggatatttctgctctcaaagaactcgtggtctagtggggaaacagatgtgaacacagaaatttataaaacagcgtagtcagtgttatgatggagagagcaggggtggctgagaaagtctgagggaatgagggaggcaatatctcagctaagtcttgcaagatgagtaacagtaaacctggtgctaatgaaggggatagactctgcagctcagacacctggttcttagaccagataggggacctcattataagtactgctatgactggttagctccccttcatagcacttaccatagttatacatttatgtaatttgggggattatttgaccaccatctccctcctgatcagatcaaggcccctttgtgtgccctttcagggagcaaactaggccctcaacaaacacggttggtggaagaaggaaagagaggagacagaaaagaaggcaggttggtttggatgaatgcctgcctccctgctagaatgtccaccccagcagggcaggaaccatgtctgtttctgattcttcttcatatttcaagtgtccagtacatggtgggtacctgtttgatgaatgactaaatgaatgaacaaacagctcaaagactgcaacatggagaaaggattggaggaggtgaaacaaggcaaggaggccagtttggttactgaaggagaacaatgttcaaagggggtaggagaaagggaataggttaaataaatatttattaggtatggctggaaggacttgttggtttgacagttgtgctgcaagagaagaggataatggagtcaaccattgctcccaagtttctggcttaagtggctaaagggtgggtggtcccatgtgagagataaggaagaggctgaagaacagatctgagtaatgttgctgggttcaggcatggccacctttgttacgggaaaggagtcccgacctagaccccaagagaggtttcttggatctcatgcaagaaagaattcagggcgagtccatagagtaaagtgaaattaagtttaataagaagtagaggaataaaagaatggttactccatagacagagcagccctgagggctgctggttactcatttttatggttatttcttgatgatatgctaaagaaggggtggattatttatgcctcgcctttttcgaccatatagggtaacttcctgacattgccatggcatttgtaaactgtcatggcgctggtgggagtgtagcagtgaggatgaccagaggtcactctcatggccattttggttttggtgggttttggtcagcttctttactgcaacctgttttttcagcaaagcctttatgacttgtgccaggcttctgtctcatcctgtgactaagaatgccttaaccatctgggaatgcagcccagtaggtgtcaacctcattttacccagctgctattcaagatggggttgctctggttcacatgcctctgacagttgtcctgcaagagaagaggagcatgaagtcaaccattgctcccaagtttctggcttaagtggctaagggatgggtggttcccatgtgagagataagaaagaggctgaagaacagatctgagtaatgttgctgggttcaggcatggccaccttgggccagagatgctgttgaatccaggaggtaatgacatataaattttgatgtcgaagggggaaactttgagtattcttctattgaagtttcatggcactggaaatctagagctttcctccaaaaggcaggaagatgggttctagtcccagctctaatattaacttgtgctaccttaaacaattcatgacatttcaggaatgtgtgatcctcacagccttagcagattccaagattccttttggctttgacattccataccttcaggtagccctagaatttaaagaggaagtttctcttgaaaggctttatcagtcggagctatttgcattacaaggaatataaactcaacttaaactgtatcatacatagcaagttaatatgtggcttcctgggttgtttccttgggcagtagtccgagtggaggccacgctagccaggaaagagtgcggtgatcaatgaatgatgtctagcatagacacagcatcagaaacagggacatatttttgtttcagtcctgaaaccaagggtttccgtctgtggcctttcaaataatgttgattgaatgtaggttctactctggctcagccattagctctgggtaaccttagtttaatcattttatatgccagagcttgacagtttccttatttgtcaagcgggagaaatagtccccatcttttccaccttcattgttgaaaggatctaatgagaaaagaagcatagagccctgtaaggaggagaatcagatattgaagatatgaaggagaatcagaaacagacatggttcctgccctgctggggtggacattctagtagggaggcaggcattctttaacctttatgtaagttcacatgtgtgacactgtgagatcccaacgtgtggataaaagagcaaatacttctggtcccctgagagatgaaagttcaaaagtttattgctaatgaattaattttaaaagtgtagataatcttataataaaagaattcagaaattaaaataaaataaaaggagatttcataaaattgtcaaatgaaaaacaaataagaaaagaaagtgtcagcaaaccaccatggcacatgtatacctatgtaacctgcacgttctgcacatgtatcccagaacttaaagtataataaaaaaattaaaagaaaagaaaagaaagtgttgatgaaaaaggtcaaactctgtcaaatacttgaagagatttattctgagccaaataggagtgaccatggcccatgacacagccctcaggagtcctgagaacatgtgcccagggtggctggtctgcagcttggttttatacattttagggaggtatgagacatcaatcaaatacatttgagaaatacataggtttggtccagaaaaatgggacaattcgaaggggatggtgagtggggagcttcaaggctataggtaaatgtaaacatttcctggttgacaattggttgagtctaaagacctgggatcaatagaaagggaatgttcaggtgaagataaaagattgtggagaccaaggttcttttgaagtcttatagtggcagcccttagagacaatagaagacaaatgtttcctatttagacttttaaaaggtgctagactctcagttaatctctttacgattgggagggcctggaagaaaaaatctagctatgttaatagagcttatttacacatgtaggttttaccccacaaaaaaactttttttttgcagggccatttcaaagaacgacaaaaaaacatgttttggggtaaaatattttgactttcttctttgtcatgtaatgttgtgtcagagtcagataggaaagtaagtcacgatatatagcgttaaataaaacccatctgatgagaatttatggtttgtaggatatgactcccagaccccttagatagaaatctgggcaagataagaaaaaatcagagcttagtcctcaaaagaaagaacgagaaagagaagtaaaaatgaaggaagagagggagggaggaagagagagaggaagaaggaaggaaggaaggaaggaatccttcaatgctggagagagtgtagttaaattgagtggaaattggtaaaactcttttgtagaatagttggcaatatgtatcaagagccttaacaatgtttatactctttggccaaataattctactttttataatccaaatcaaaggtcagcaaactttttaaagaaggactgggtagtaaatatctcaggctcttcaggtctcacggtttctgtcagctgagtttcaaccagcactcaattctaccacagcagaacaaaagcagctatggataatatataaatgaatgggcatggttttgtgtccaataaaaccttgtttacaaaatcaggatgtggccagatttggccccgtgggctatagtttgccaatccctgatgtaaattaagaaaacaggcctggtgcggtagctcacacctgtaatcccaagcactttgggaggccaaggtgggaggattgcttgagccccggagttcaagaccagcctgggcaacatggtgaaacctcatttctacaaacaaaaaaatacaaaaattagcctagtgtggtgatgcttgcctgtggtcccagctactcaggagaatcatctgaacctaggaggtagaggctgcagtgagctatgattgtgccactgcactccagcctgggcagcagagtaagatcctgtctgaaaaaataataataaataaataaataagaaaacatttttagaattatgctaaattcaaaattctaaatataaagagaggtttaagtgaaaagttgctattacatacaactgtatttgtaatagcaaaatattggcacaattagaacactcattaataggggaattaattaattttgatagttccactcaatgaaatactaggtacacatgaaaatcctgtttattaataatttataacaacatgaagaaatgcttgatagaacattacttgagaaatagaaacaaacttatttataatgacgatgataatggtggtagataatatctaagcactttacacagatcatatcatttaactctccaaacagacctatgaagtatacttttttattgtaatggctttccttatggagaagctgatgctgacaaatgttaagtaatttagtcaaggttaagctgctggcaggtgtcacagttgaaatgtgaatacaggtctggtttaactgctaaaagcaaaaacaaaagcaaacaaaccagcggagaaaaatcccaaattaaactctgtttattaaaaataccagaagaaaatacacccaaaagttgttatcggctgtcttgattggtaggtcatagataggaagatcacttaacatgttcactcttttctctaatgaaaatgtatcattttaataaaaaagaaacaacacgcgaatttcataggcaaaccaacgatggcagaatggtaggtgggactgtggggggagaagtgtttatttcggaggtctagaggttcccttggggatgcctttaatcctcttggtcctgctctttgtttgtgaaaagggcatggtgctgcccttccctctgtcttgttctaggtggagtttctagtgtgtcttgtttggactgttggcccatttttatgctgttcttgggttgacatgccagtctctaactctctctctctctctctctctctctctcttctctttcttccccttcttcatccacccgttccgatgtgtagctgacaaggtcaatgacgacttctacaccaagcgacggcacctggctgagctggctgccaaggggaacttacctctgcaccccgtaagagtggaggacgagccccgggccttcagccctgagcacggtcctgccaagcagaatggacagaagtcccgcaccaacaagatgcccccacatcccctggcctacacctctaccaccaactttaagggctgggaccccaacgagcagtccctccggcggcaggcttacagcaacaagggcaagcttggcacggccgagacaggctccagcgaccccttgggaactcgcccccagcactacccacccccacagccatacttcatcaccaacagcaaaacagaagtgactgtctgagctttcaccacagggagcaccctggagaccacactcaactgagagaggcaaaaaacaaccccgcccacaccctccccatcctcccctaatacatgcgtccacacactcactctcaacaagaaccaactctaaacctactggggacacagagtcgcgcttttcctaggtcatgcctgtaacgtgtcggcgggcagctgagaaagaccgaagcgtggacattcagcaatacagcaaaggggaaaatgaggcacactctttccacttcaggcccaagatggccaactcacatgcccaaaccgtggggctgagttttcttttcctcctaacttgaaactgaaatccatggtgacaaaatataaaagtagcacaatttagagaaattgtccatttgagcacatacactacttgccacgtgctgtctgtttctaggttcgaaagccagggtggaaatgggggtagagaatgagggaggacacaagagaagagtgtattctggaagaggagttgttctgggaggaatttgcccacattagaagcatttttctaattccaagaagtggtgacgtggacgtaaaattttgacgagcatgaaacagtaactggaccccaaccattctatttatagtacttttcatatcatccatgttgaaagcaaaaaacaacacaccctcaaactcacagaaagtaaatagaccctgaacccaccgacaatgatgggaaggaaaaaacaaaaaacaaaaaacattttagagaactcccataaggaccatgaccgtggaaatgggagggatgggcttttacggagagggtccggagagtatcaaataactttttaaaaagaggattaaaatgtaagcccactacaaaacagataaaaacggcaaattaggtgttttttttttttttcaaaaatcttgaagacttgttgacattaacaacaacaaatccacagttggaaaagtccacaggagatcagatgaggatccagaagcctctgatttctgggttttgcctccaagacctgaaacagccacagaaacaagtcctctataaactgtatgtccctgacatccctttcccttcagcgcgttgccgccgccgctgccaaacttcaactgctttggactgaaaatgtcataagcgtgggtggtgccttcaatgtgttactgttgtttaatgacagtcttgtttcccaagtgcaacctgtgttcttttagccttccttcctcttctttttctgcagtagtagaagatgtttccatccttcctttgtaggtgagcccaccccataacaccctctgaggggctgctacaatgtcaggggtacccaagaacgaagacctccctactctctacactatcaaaattagtccttccattttctagccctctcaaacctgtcagatgtttcttggtcccgtaattcccatggtccctccaaattacctccccacatacttcatgtgttcatctcccatccagaatgtcctgaggttgtttttctggttggttctcataatccatagtccttggggtcccagcaaagtcagttttcctacaagttgtgtttgttttgtggaagcccaaagaagtggattgagagagaagagatttttatctaaggtggaaggtttttcaactagcccctaaaggtctttggtagttaattaacattcaacagacccacagcaactctggtgtcagaagctataaatggtctggccaaacaagactcagagtattttctgaaatcctgagctgcaaggttctgcctcacctgtctctccactctgacatcacgaaatcagcaaaaccagatatttattctcctcactcccagcagatacgaggacaccaacaatgcagttgatccctctgggcctgagtctcccatctgaaacatggggaattggggtaggtcaagctttttgaaactgcaaaacctctacctgtttttaaaaatgagatcttttgaccaggcacagtggctcacacctaaaatcccagcactttgggaggctgaagcaggtggatcatctgaggtcaggagtttgagatcagcctggtcaacatggtgaaaccccgtctctactaaaaatacaaacattagctgggcatggtggtgggtgcctgtaatcccaactactcgagaggctgaggcaggagaatcgcttaaacttgggaggttgcagtgagctgagaccacaccactgccctctagcctgggtgacggagtgagactatctcaaaaaaaaaaaaaaaaaagaaaaaaaaagagatctttcaaagaacgcataataggagatctccatgtataaaaaggtaccatgctgtacaaagctggggtcagagatttagtgcccaccttctcagcctccttgggaagaccccagagcttcccagagtcaagtaaataccactgggcatggtcagagtttccttgacgttaatgagctatgtacctgcaacacactttggcatctctgtatatcaccttcacaatatttgtatctaaattgattcattttaatgcattttgtttttaaaatgaaaacttcctgtcttcatcacaaatttaaaaaaaatcatcagttgccataaatagaaagcaaacataaaaataagtacaaaggaaacaagcagcgatgattaaattccagctggagtctgttgtctgtgagtctgaactaaagcctggggttctttctttctctctccatctctctgtttctgtttctctctctctcttaaaatgatatcatcaggtattaaataattgttaaaaataccagcacccaatgaagactttctctttgtactaataagatggaccaaaaagtaaatgaaaggggaatcatttcctatgcaagtcagtgttgaacaatgctgtagctatgtactgcctatgatcattgtgcatacactaggggtgcatagcccacacttcagaaaaccctgggttgacttatctgtgaggctctttccagctcaaagtttccataattcttatctcccttttacctcgtggttgctctttgcccccagtccacttcgtcccacccttatctcaactctgattaagagtctttcttggcctctaaatctgtagtattgtattccttctgcatgctccttctcctctgaataaacttcatcaattgaactgggctccttggggtctgcagttgtaattttggcagcaaaggtgcagactggtcattaagatgtagccacaatgatggcccaagaaggacacgtactttccaagtagtcctgtctaggatggaaagctcaggaagtgcttcatagtttattatcttccagttggttttgggagatgaactgaagagggaagtttggatagggaaggtctttttattcttttttttttaatgtatccatggagtatttattattattattattattattattattattattatactttaagttttagggtacatgtgcacaatgtgcaggttagttacatatgtatacacgtgtcatgctggtgtgctgcacccattaactcgtcatttagcattagctatatctcctaatgctatccctcccccctccccccaccccacaacagtccccagagtgtgatgttccccttcttgtgtccatgtgttctcattgttcaattcccatctatgagtgagaacatgcagtgtttggtttttttgtccttgcgatagtttactgagaatgatgatttccaatttcatccatgtccctacaaaggacatgaactcatcattttttatggctgcatagtattccatggtgtatatgtgccacattttcttaatccagtctatccttgttggacttttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccagcagtgtaaaagtgttcctatttctccacatcctctccagcacctgttgtttcctgactttttaatgattgccattctaactggcgtgagatggtatctcattgtggttttgatttgcatttctctgatggccagtgatgatgagcattttttcatgtgtcttttgactgcataaatgtcttttgagaagtgtctgttcatatccttcgcccactttttgatggggttgtttgtttttttcttgtaaatttgtttgagttcattgtagattctggatattagccctttgtcagatgagtaggttgcgaaaattttctcccattttgtaggttgcctgttcactctgatgatagtttcttttgctgtgcagaagctctttagtttaattagatcccatttgtcaattttggcttcctcttgggagggtagacagacctcacaatatggaaagacgggacaacctatggaactatctgtgacttccatgtaccaagacaaggacgctatagctagggtagtgagacctagaagagagaaaccagaacaaagcagacaggctgtcctcttcctaattccatgccctgacatcagcccctattttttgcctttagctgtcccccagtttccaacccaatgggaccagagtctgacttccctttgccctttcacagtgtctcagcctccatctgccttgggctccgcctggcctccccatctaactcttcccagttttttgtgtaaatggagcatattttatgtgcgaatattttagtaaccgtatgttctgcaagtaaacctgtgttaatacttgtcaacaactgcagagtttatgatacgaataattcttcctacaatgaagaaaaaaacacatttgtttgttttctaagaatgtttatttgtaaacatatgtattcactatattaatatgaatttcttacctggcaataaaactgattatatgtga

SEQ ID NO: 12412 - DNA, 1132 bp, Homo sapiens
atacttgtgtgtatatgcatacatatatacttgtgtgtatatgcatacatatatacttgtgtgtatatgcatacatatatacttgtatgtgtatgtacatatgcatacatatatacttgtatgtgtatgtacatatgcatacatacatatatacacacacgtacacacatgcatatttcttctctcaacttggcaagggcaggatttgcagattataacctagatctcattcatgctgcattttttcactcaccctattgttctagttttcttggattccaacctgggcttatctccaatctgcatttttttttgtttctcctccctagctgaatatatttgtggaaaactcacaaagcaactgggttgccaggtctggtctctatcttcctgtccagtgaaaagaaaatgacatttagaaaacctagtcacaaatgtctgtttaataaattttgtttgttgccctgaaactggattttaatatttctgaatattcagtgcctggaagctagcacaaaatggctatctaaaactgccagaaatttgctttatgtggttcttaatgtgaaactggaaatgcaccttctggatggtgtcacttcttttgagagggatcgctttggtggggtattatggttgtgtctacttatattaagtaactactcactgcccctgaggtgtctcaggacttgggataaataatctaaaagcaaatactttataatggaatatcatgtattctgtttaataatataaaagtgtgtcccaacatattcagtgaggaacatctctgtagaattattttttttctttaacgaagtgtttagtattttctctggcagacctggacacagggtttgagcctagtaggttgagtctgagactgacggatcaaacagatgagagaaaggacttatactggaggataataggctttgaaggttcaaatctttaattagacagtctagtgtttgggatgtatttccaggggtaggggggcctaccattgagacattagttagcttactaatgtccttgggcacgctctatgcacgagtcagccaaattgttgtttgaaatttctgctgtagctctgtagaaaactgaggggcaatgcattttccatctcgag

SEQ ID NO: 12413 - DNA, 229 bp, Homo sapiens
ttttttttttttttgagatggagtcttgctctgtcacccaggctggagtgcagtggtgcgatctcggctcactgcaacctctgcctactgggttcaagcaattctcctgcctcagcctcctgagtagctggaattacaggtgcatgccaccacacccggctaatttttgtatttttagtagagatgggatttcaccatgttggtcaggctggtctcgaactcctgacct

SEQ ID NO: 12414 - DNA, 234 bp, Homo sapiens
tctgattggcccagcatagatcacatgctctcctctggtccaatcatcattataagaaggaggtattgggattggtttgattcaggctccatgctcgcttccatggccaggggtctgaattactgtatagcacaatgagccctcgctagctgggcacatactcacctgcttttcaactgccagctcttacatccctgagcgagggtatctctggccactggagctagctttgcc

SEQ ID NO: 12415 - DNA, 5373 bp, Homo sapiens
tgtcaaacaaaattattttaataccataaaaaattttgcacttcaactttcttctgaggaatggatgattctagagttttcccagctgggcttcattggtaagaaaagtgtcacacttacctacttttcataaataactgtgactctcagaatctaaaaccaagtagctacttgtcctaaagatgtctttttttcctatggaaatgggttgttttagagaaaacttaagttaggtaaacctctttgtatgacatgatgaaagtcaacccagaatagaatttggagacttctaagattattgtatttactgtagcgttcttcacaatgccaaccgtggtgctggtgagcatgtttgattttttcttctctggcatttccagctcctttgttaacataagattgcagttcttttaaaaacaataccacaaagagttttctcatataaattcctagtattttcatgcaatgcatgaagtcctaattcagtgattaatttttattcgtttttctcttaactagttggggcactcatttctaaatggtttttggctgatgtttcaaaattagccagcttaagaatatgtttaaagttagccaggcgcagtggctgcacgcctgtaatcccagcactttgggaggccgaggcgggtggatcacctgagctcagaagttcaagaccagtctggccaacatggtgaaaccctgtctctactaaaaatacaaaaattagcctggcatggtggcagacgcctgtaatcctagctccccgggaggctgaggcaagataattgcttgaacgggggaggtggaggttgtagtgagctgagatcgcgcccctgcattccagccttggggacgagagtgagactcaatctaaaaaaaaaaaaagagtatgtttaaagttgaagaattgaaggaaatttacagggttcaaataatattgagaggttaacatttcatctcctatggtactttttaacactttaagcatttagaggctggacctttgacaatcttgatcatttaactcaaaacttaaaagtcaaaaaccatctttacttgcaaatgctttagtgaaaacaaaattaggagtccttattttttgcatttattgattcagataaaattttttacctaaacctctcaatgttaaatgggaagaatcttagtaagacacgaagggaaaatctctgacttgctttttgaatgctttgggccagtaggtatacgatagattattatagtaacatcgggaatttactatatctgtttacacccaggtgacagctcaagagaaagtttagccgaagcaactttgtttaattttgataatacaagtggggaaattgtttatgatgatttatagttgaaagcgcaagcctcagtgtatgtcgtgggcaagatttcatgaatgtaagccattttggtgcttggtttcttcattgcagctattgactgggaatatcttttcaggtaaaatgtttcaagcgccggatcttactctgattgtagaattcatattcatgttttacaaggagaaacccattgattggctcctggaccatattctctgggtgaaagtctgcaaccctgaaaaagatgcagtaagttaattcctcaccagagtggagggagtttcacttctgtatttcgtgaaagtgacttttagagattttgcaaataaatagttaaataggtaggtgatataaaacttctttcctgagctgataaaaagtttctatattagaagaacttttagatagcagtggaagatcctgtaaagcaggaagctgttacaagatgacgtacattctttaaattgctgataaatgtttctagtgtttgtaagccctggtggtttactaacattggatgtagatgttggtcatatctgttcttggcatgggataccatttcagtttgttttcttcatatttcctgttcactctctttttccttgtatactggggacgatattagaccctaacacatctgtaaatgaggaataaaatagaagtaatattttataccaaaacaatgagacgttaaagtacctttcagcgtgttacaaaaagccagtgttcataataatatgattacctttgggataatagttgcagtcaagtaagtgaataataatttttgctttgatcattcagatagcatgttattaccatagagatcttattgttaagagtaattaggccaggtacagtggttcacgcctgtaatcccagcaccttgggagcccaagactggaggatcacttgagcccagaagttcaggacaagcctgggcaacatatcaagacccatctctacaaaaaaacaatgatttttttttaaaaagagtaattaggtatgttttccttgtccaatttgaattgtgtctctgaaaaaaaactatagcttttaatttatttgatgtaagcataaacaatatgtaaaagtacaaattctttaaaatgtccattttgatgtgtaatgataagtattactgtaagaacatgtcattatagagttgacttaccattcattgtaacaaataagcattagtttgacttcatgaccttctactccctagaatagttggatcctcatacctgctaggttttaggatactaccttctggtgtctgtaggctatcattgcattctgtttaaaaaaaaccacaaaaattttaaaaaaccccaacacattcttagttagaggaaatcatggaatctagcaatggcagagtatctgttttccgacaattagttgaacatataaattgttttaaacaaatcattttttagagatctcagtccttatgcacattttcactgtgacttatagaaatttttattgtaggacacagaaaaagttaacgtcatctttaacctcctacaatacacttgcattccattcgtcctgtgcaattttatttaatatgtggttaggttctaaaatgagcctgtgaggtgaaaacatctatagtagaaattaaaaccacaaaaaccctctaaatcctccataaatttgggtacatgaacttttggacgatttcatccattccttcactcttctgtagtccatgtttttgtgtggcctctaattcttcagttgcttcccctagaatctcgagggtgctgtcgccacatccttgacagtggcctgggaaacccttcgaatcatttatacattgtcccaaagggttatcagcgtgcttgggcccttcggccagagtccttccattgccactggagtgacaggctgagttccagacactgcctcggtggttttgctctctcctcaaccttgcgctccccagtcttctctctctcttgccctttgcccttccctttgactcttcctccctttctttctccttccacttgagtatttgtgcaaagaaaatacactatttcacctttattgtagtgtcagtaataatgccagtgaagtgaaacctcttgagaagtaggcattttagcacccagtatattattagaagtcttctacagtgtaaatttcttttttttttttttttgagacagagttttgctcttgtcacccagactggagtgcaatggcgcagtctcagcccactgtagcctctgccccccaggttcaagcgattctcctgcctctcagcctcctgagtagctgggactacaggcacgggccaccacgcctggcaaatttttatatttttagtagagaccaggtttcaccgtgttggccagaatggtctcaatctcgtgacctcatgatcccccaacctcagcctcccaaagtgctaggattacagacgtgagccaccaagccggctgctaatttttgtatttttttttcttttttttcttttgtgagacggagctcgctccgtggcctaggctggagtgcagtggcgcgatctcggctcactgcaagctccgcctcccgtgttcacgccattctcctgcctcagcctcctgcatagctgggactacaggcaggcgccgccaccacgcccggctaatttttttttttttttttttttttgtatttttagtagagatggggtttcaccgtgttagccaggatggtctcgatttcctgacctcgtgatccgcccacctcggcctcccaaagtgctgggattacaggcgtgacgactgcgccaggccaatttttgtatttttagtagagacagggtttcacacgttggccaggctggtctgaaactgctgacctcaggtgacccatctacctttgcctcccaaagtgctggtactgcaggcgtgagccaccggccccagtgcaagcgtaaatttctaacaaagatgtgtctctcgattttttttggccccaaacttttgtaagttattgaaaatgaaaagtctaaataaatatttgtcaaggtggccctcggtgttgcacagccttcacacgccaggcccatgcatgaggacaggttgagatggaacgtctggaccgtggggcactacgagttgaaacataggtgtcccttcctgtgttgacagagattgtctgtggaatttttaatatcatttacttgcttctaggcaaatgattgcctcacattttcaagttgctttcatgcaacaaaatgcgccatttataatttgcaaattcattatattattaaataaaaaatattttgtatatttgaactaaccccctagtctatagtttattcattttaatattaaaagtcaaatctttgttgacatgtgttgaaggatggttgaaattaaatccttcactcttcccttaactatgcttattttaaatttctggatcatgactatttatcaaggaagtagcaaatctattagtgcctcaaagactagaaaaaaatatgatttgtaattatgacttgaagttgttttcttttcaattttgttgttgttgttttgtttgtttgtttgtttttgtgacagagttttactctgtcacccaggctggagtgcagtggtgcgatctcggctcactgcaacctctgcctcctgggttcaagcgattctcctgcttcagccttccgagtagctgggattataggcttgcacacctggctgatttttgtgtttttagtagagatggggtttcaccatgttggccagactggtctcaaactcctgacctcaggtgatccacctgccttggcctttcaacatgctgggattataggcatgacccaccgcgcccagcccttcttttcaatattttaataaaggacttctcattttccaggtgagggcaagatttcactttatgatgcaacactaacgtgattttttttaatatttagaaacattgtgatagacagaaagcaaatctgcgaattcgcttcagaccttcccttttccaacatgttggtctgcactca

SEQ ID NO: 12416 - DNA, 3086 bp, Homo sapiens
cttcaactttcttctgaggaatggatgattctagagttttcccagctgggcttcattggtaagaaaagtgtcacacttacctacttttcataaataactgtgactctcagaatctaaaaccaagtagctacttgtcctaaagatgtctttttttcctatggaaatgggttgttttagagaaaacttaagttaggtaaacctctttgtatgacatgatgaaagtcaacccagaatagaatttggagacttctaagattattgtatttactgtagcgttcttcacaatgccaaccgtggtgctggtgagcatgtttgattttttcttctctggcatttccagctcctttgttaacataagattgcagttcttttaaaaacaataccacaaagagttttctcatataaattcctagtattttcatgcaatgcatgaagtcctaattcagtgattaatttttattcgtttttctcttaactagttggggcactcatttctaaatggtttttggctgatgtttcaaaattagccagcttaagaatatgtttaaagttagccaggcgcagtggctcacgcctgtaatcccagcactttgggaggccgaggcgggtggatcacctgagctcagaagttcaagaccagtctggccaacatggtgaaaccctgtctctactaaaaatacaaaaattagcctggcatggtggcagacgcctgtaatcctagctccccgggaggctgaggcaagataattgcttgaacgggggaggtggaggttgtagtgagctgagatcgcgcccctgcattccagccttggggacgagagtgagactcaatctaaaaaaaaaaaaagagtatgtttaaagttgaagaattgaaggaaatttacagggttcaaataatattgagaggttaacatttcatctcctatggtactttttaacactttaagcatttagaggctggacctttgacaatcttgatcatttaactcaaaacttaaaagtcaaaaaccatctttacttgcaaatgctttagtgaaaacaaaattaggagtccttattttttgcatttattgattcagataaaattttttacctaaacctctcaatgttaaatgggaagaatcttagtaagacacgaagggaaaatctctgacttgctttttgaatgctttgggccagtaggtatacgatagattattatagtaacatcgggaatttactatatctgtttacacccaggtggcagctcaagagaaagtttagccgaagcaactttgtttaattttgataatacaagtggggaaattgtttatgatgatttatagttgaaagcgcaagcctcagtgtatgtcgtgggcaagatttcatgaatgtaagccattttggtgcttggtttcttcattgcagctattgactgggaatatcttttcaggtaaaatgtttcaagcgccggatcttactctgattgtagaattcatattcatgttttacaaggagaaacccattgattggctcctggaccatattctctgggtgaaagtctgcaaccctgaaaaagatgcagtaagttaattcctcaccagagtggagggagtttcacttctgtatttcgtgaaagtgacttttagagattttgcaaataaatagttaaataggtaggtgatataaaacttctttcctgagctgataaaaagtttctatattagaagaacttttagatagcagtggaagatcctgtaaagcaggaagctgttacaagatgacgtacattctttaaattgctgataaatgtttctagtgtttgtaagccctggtggtttactaacattggatgtagatgttggtcatatctgttcttggcatgggataccatttcagtttgttttcttcatatttcctgttcactctctttttccttgtatactggggacgatattagaccctaacacatctgtaaatgaggaataaaatagaagtaatattttataccaaaacaatgagacgttaaagtacctttcagcgtgttacaaaaagccagtgttcataataatatgattacctttgggataatagttgcagtcaagtaagtgaataataatttttgctttgatcattcagatagcatgttattaccatagagatcttattgttaagagtaattaggccaggtacagtggttcacgcctgtaatcccagcaccttgggagcccaagactggaggatcacttgagcccagaagttcaggacaagcctgggcaacatatcaagacccatctctacaaaaaaacaatgatttttttttaaaaagagtaattaggtatgttttccttgtccaatttgaattgtgtctctgaaaaaaaactatagcttttaatttatttgatgtaagcataaacaatatgtaaaagtacaaattctttaaaatgtccattttgatgtgtaatgataagtattactgtaagaacatgtcattatagagttgacttaccattcattgtaacaaataagcattagtttgacttcatgaccttctactccctagaatagttggatcctcatacctgctaggttttaggatactaccttctggtgtctgtaggctatcattgcattctgtttaaaaaaaaccacaaaaattttaaaaaaccccaacacattcttagttagaggaaatcatggaatctagcaatggcagagtatctgttttccgacaattagttgaacatataaattgttttaaacaaatcattttttagagatctcagtccttatgcacattttcactgtgacttatagaaatttttattgtaggacacagaaaaagttaacgtcatctttaacctcctacaatacacttgcattccattcgtcctgtgcaattttatttaatatgtggttaggttctaaaatgagcctgtgaggtgaaaacatctatagtagaaattaaaaccacaaaaaccctctaaatcctccataaatttgggtacatgaacttttggacgatttcatccattccttcactcttctgtagtccatgtttttgtgtggcctctaattcttcagttgcttcccctagaatctcgagg

SEQ ID NO: 12417 - DNA, 160 bp, Homo sapiens
tgagacggagtctcgctccgtggcctaggctggagtgcagtggcgcgatctcggctcactgcaagctccgcctcccgtgttcacgccattctcctgcctcagcctcctgcatagctgggactacaggcaggcgcccgccaccacgcccggctaatttttt

SEQ ID NO: 12418 - DNA, 1502 bp, Homo sapiens
gcagtcagggctctggccagccctcatggttcaattacataaaacagcaaatggcatttcctgttgtccaaattattacataccgtactaaaaacactaatttttacattatatcttttccactctttagaccccaaccaataattatctcaatcacattttaactaaagaggggaaaaggcacatggttactcatgcagttggtttatgtgttgtggttattaataatcaaagtcaccaaaggcaaagtggaaaaataacagctatgcaatcaagaacagagaaagaagcaagctcaatatagtttccaataaaccttaaaattgggctttgcaaatattaacaaaatatgagaactaaatgatgtgattgtttgtctcttttttatctaaagtggaccagagaaagttttgtgcagcgcagcaagacttctgcatcctgattgaatacagggtcacacaacccagaactcatttctgtgtatgatttctctttaagtgtcttgccctgtaaccctccctctcccagatattttagttgcaaattgagctcttttctaaaattgacaaaaataaaatattaataaactttcaactactggaactataaagaaaaagcatgacgtgtgatattggtggaaggtagagctcattcctcaggcatccatcatggtgccaggcttttcaacagcctgaatgcagaattcttagatcatttcaaacttacaatcttggcaatgacatgacagctggtgcacgtggcatattaattcagcaaacatcaatgccaactgtgtgccccatggatcaactcaccaccttttcttcaacaaagcagcagctgtctggtttttaaatgcttagttacaggggaaaggggtaatattagacatacttatggaagcataaaatcatgtatataagcacgaattgatgtgaccatcgtgatggaataaatttgcataatcaaatcattccgaacaattatttaactctttactagttaacttttagtccttacagtttgaaaatgtaattataaacaaaatctcctcctaacccagaaatgttcacaaaagtggaagaaacagaaagctatttttattgcataagcattaaattagaattcaatgcacatcacatgcattttgctaagagattacaaaagcagaaagaaatcttaccaagcagaaacaaatcattacatacatgctctcaagacaaactataactagtcctcatgtaagaggacatgatggcacagtttgtcacacagaattcattctaaattcatttggtaattgggtgaccatcttgttagctaattgactttatccaaaggaaaaataaatttctaatatctttatcacaggaggcagttttgccacttagagcaaggcatctaccaaagataagcttctcccctcccactgaaactggtagatagggatgctgtcttccttaatgattgcatttcaaagaaatagttcccaggtcctcgag

SEQ ID NO: 12419 - DNA, 51308 bp, Homo sapiens
  misc_feature (34955)..(34955): n equals a,t,g, or c
  misc_feature (34963)..(34963): n equals a,t,g, or c
  misc_feature (34965)..(34965): n equals a,t,g, or c
cggcatgggcaaatacgggcctgagtgtgactggtggtctctgggtgtctgcatgtatgagatgctctatggagaaacgccgttttatgcggagtcactcgtggagacctatgggaagatcatgaaccatgaagtaagacgttgcattttttttttttttttggtacctggctcaggcctaaagtacagagagcacaactagtgcaggaagatccgttaggaagcaacgcgagtagttgaggaagaggtgacggggtttggaccaaactggggacaggcagattggagtagacattggagagggcatccagaggcggggtcggcaccaggagatgtgggcgccagaggaaggggaaggaggttctgagggtgacccccacccccactctcaggggaaggacgctggcctgctccaagctggcttcctggagggaaggcaggtttctgtagacagacgcgtcgtctgcacaggcgcatggagtgaggcgcccgggggtagccagtggggaggtccaggtgggccctttgacctgtggctctagattcactggttaggtgccaactttgattctcaagtctgttccccagaaatcagtccctgtaaatgatcatgtgtctccagatggtggagcccttcatcctccccatcctgtttcctcttttcctccttccctttccgaactgttcactttctcacttccatgtcacctctctccacctcctttgttttcctttttatcattttctcttctgtctgatattttttatttctttttaaaaattttccttagtcatgtgtctttcttttttgagatggagtctcactctgtcgcccaggctggagtacagtggcgcagtctcggctcactgcaacctctgcctcccgagttcaagcgattctcctgcctgtctttttatctttttttttgagacggagtttcgctcttgtcgcccaggctggagtgcaatggtgcaatctcagctatgcctcccaggttcaagcgattctcctgcctcagtttcctgagtagctgggattataggtgcctgccacaacacctggctaatttttttgtattagtagtagagacagggtttcaccatgttagcaaagctggtctcaaactcctgacttcaggcaatccacccaccttggcctcccaaagtgctgggattacaggcgtgagccatcgcacccagtcagtcatgtgtcttcctaatgccgatttcaccctctctaccagcgtgctcatagcatttccctccccgctgtctcctgtgcacatgacagatcccagaatgatcctgattgagtgctggcctgtcctccagccagggcctcccacagttcgctctcacagggagcagattaacactgaagcgggaactggttttccatttaactccaaagcaaagcaaaagttacagttttaaaaaacgtttttcccaaagtagaagcatatttttatttgtaaattaatatataccccctataaaaacttcagacaatgcaaaaatgcatattgtagataatgaaaattgtctcatccacttcttagtgacaaattctgttaaagtaacaactgggacttcgttattactaagagcctgccagcagtcactgagtgccgaccacctgtgggctcttgggtcaggcactccgtgaagcaggtgacattgttcttcctttctgtagatgacagaggtggtggctcagctctcagcccactctaccatgagggtgtgtggcctcggcagacctcagctcgtgtgtgtgcgtgcgcatgtgtgtgtttagatacgtggcatcatgttacatatcaacagttttttgtcattgtatctgtggtgtctttctatagcagcacacagacatgttcctttttctttgtgccccatcttttttgttttgagctggaatctcgctcttgtcacccaggctggagtgcagtggcacgatcttggctcactgcaacttgcacctcccgagtttaagcgattctcgtgcctcagcctcccaggtagctgggattacaggccgccaccacgcccggtaatttttgtatttttagtagagacagggtttcaccttgttggtcaggctggtctggaactcctgacctcaggtgatctgcccacctcggcctcccaaagtgctgggattacaggcgtgagtcactgtgcccagccggtatcttttttaacgagtctcttttttgatgggcatgtaggtaatttgcagttttcttggtcaaaatacagtgcagtcctgagcatgttgtgtttcctcttagtaactgcttttttagtgtgagtttccagaagcggagctgccgtgacgcgtgcactgtgcattctgacggggctgcgcctgtccctcttcccgcgcacggcatgtttcccacattccttgccacttccataggtaaaatgtgtcatttacatgcagtgtggtcacaagtctacaatgagtaaaaccagaaggaccactggttttcttgtttgccttttgggaatggaaatttattagctttggattgcatttagttcccatgaagtgacctgctttgaagctaccatttctactttgtttcctatcatatctgtacaccttaaactctctgaatgcgtccacctgtccaccggtgtttttgccaccccttgcaggagcgattccagttcccatcccatgtcacggatgtatctgaagaagcgaaggacctcatccagagactgatctgcagtagagaacgccggctggggcagaatggaatagaggatttcaaaaagcatgcgttttttgaaggtctaaattgggaaaatatacgaaacctagaagcaccttatattcctgatgtgagcagtccctctgacacatccaacttcgacgtggatgacgacgtgctgagaaacacggtgagtgtgaaagcaccgttctcagggttgctggctgtgggtctgacatgcagtgctgtgttgagggcgttgcttatcaagtcagtacaccataaagctgtgaaatttggcacttaagacagtgtgctttttattccagccttcagctgggtccttaatattcctttaaaaaatgatggatgactcaatttgagtaaaattcagttaaacagctcatttgttttgcaactcaacagaaatacttttgcttttattttcacagtacttgatactttttttttttgagacagtcttgctctgtcgccaggctggagtgcagtggtgcaatctcagctcactgcaacctctgactccctgtttcaagccattctcctgcctcagcctcccgagtagctgagattacaggcatgcgccaccatgcccagctaatttttgtatttatagtagagacggggtttcaccatgttggccaggatagtctcgatctcctgaccacatgatccgcccacctctgcctcccaaagtgctgggattataggcgtgagccatcgcgcccagcctacttgatacttttcaaagcagtgtcacatacatcattgtattagagcttcactgtgaccctgtcaccacattttaggttttttaggttgaaagacaccaagacatgggcttagcctacagtcccataggcagtgtggcggcctctcagttactggtcttttccctacatgtgagagcacgttaaatctttctaacattacagcgctttgtgtctgcattggtgtttctttatacagcaagagttcagaataaagatgataatagcagattttgagtctccgcactgatgtttaagatcaggattttccgagttgggttccagctgtgggacttgtttggtgttccagtcggctctgacagggcctctttgacacactagccagtacctttggtcctggagaattttgctcatatctcgtaaaattcttttgttctcatcaaacccatacatgtgtgacttcgtttggggatagacaagctgaggtttaaccaaataaaaggaaaatcttcttcgttgcttattaatttagagagtttcttacaccgaagcatcatcattcactctgtatgtttcatccccaggacctctggaaatgaatgaccatgaacctggggaaactcctagtagtttagtgggaggagcagaggttcttagaaactatgaagtaccccttgtagggtcatggaaaaggtaaatctgggccgggtgcggcgagtcacccctgtagtcccagaactttgggaggctgaggtgggcggatcacctgaggtcaggatttcgagaccagcctagccaacatggtgaaaccccgtctctactaaaaatacaaaaattagccgggcatgatagcgggtgcctgtaatccagctacttgggaggctgaggcaggagaatcacttgaacccaagaggtggaagttgcagtgcctgagaatacgccactgcactccggcctgggtgacagagcgagagtccatctcaaaaaaaaaaaaaaacaagaaaagttaaatctatttgcaccgaatacttgctttgatggcttcacattcaaaataaaggctgaacttcagaccacatggagaaaatgctgagaaaagtattgtcattgttgaaaggattgttgtcctagactctgactccagactccaactccttccacactgaaatttcccagataaagaactttgcttatattttttattttttgagactgatctccttctgtcacccaggctggaatacagtgatacaacctcagctcactgcaacctcagcctcccatattcaatcaagtctcgtgcctcggcctcttgagtagctgggattacaggcacgtgctgccacatccagctaatttttgtatttttagtagagacggggtttcaccatgttggcctaggctgatcttgaactcctggtctcaagcaagccacccacctcagcctcccaaattgctgggactacaggcgtgagccactgtgcctggcccctggttatagtttttaataaagaaagatcctcagaatgaaaaatagagttataataaacttatctaaaataatctacctttgggttcctttttgccttggggcctcttgtcttaggtcaagaacctgagagtccccaggctctgtccggggtcctcagagggaccatacctgttcacactgttggactctgcacacagttgtgttaagcagtgaattctgtggctttaagaagtctttgaaaatcactaacctggtgacggcctgtgccactgtcatcatcgaaatcagagtgtgtctcctgtgagctttattgtacatacagcgtacagggccaggcttgagaaagacagatctgctatactcatctcccctgcagaggacaccatggaatccgcattctccaaggccacatgttctgcccagtgcctcctgtcaccatgactgtaaccatctttcctctttttacctgtttgtttgaatgtagatttcatttgtgttgtatatgttcttatgcaggaaatattacctcctggttctcacacaggcttttctggattacatttgccattcattggttttacattcacaacggaaaggtatgtctggatttatcattccccagggagacacttcccctgtggtagatgaacagtcagacaccacagtctgtccctgggggcgggctagtgggtggtgtgtgcgctgggaggccattacttaagggagatggagatgggtttttggtcttaaaatatgcacacctgatgactacaggtgataccatagcaaggttgcaggctttttctctacagatatccaggtcgtaaagaattcaggtttcatggcctttgttgtatgttcttctttttacaaccctttaaaaatgttaaaaccattcatgctcgtgatggtgcagaaacaggcctcgggcaggatttctcccagaggccaggggggtgagatttctcccagaggccgtagtttgccaacccctgaccaataggccgccagcattggcagggttagctctgatccagtcggtggccacagcaagcagagcagttgccatgcgcactcagctgagagctggcttccatcagagcactctgctggcttttgtaaggattgtgtgttgtgggcccctgtcccaaatgggcctctttgcaaagttgtgtcgcctgagatggtccacctcgattttaaaaggaaactggggccaagaggagaggggttaggaagaaagagaggtgaaatgagacaatggaagctcccactgtgccacagaatctgattcctggcgtcctctggcagctggaaccacagttgaaaatgtcttgggagggagatatccccatgcttcttttttttttttttttttttttggagacggagtctcgctctgtcgcccaggctggagtgcagaggcacgatctcagcttactgcaacttctgcctcccgggttcaagcgattcccctgccgcagcctcctgagtagctgggactacaggcgcccgccaccacgcccgactaattttttttattttagtagagagagggtttcaccatattggccagatggtctcgatctcctgacctcgtgatctccccgcctcggcctcccaaagtgtcaggattacaggcgtgagccaccgcgcccggctgatatccccatacttctgctcgagcttggaagaaatctcttttggtgtgagaggccagggttaaacagcccataagccaaagtggcagctgctgtcttccagcccacaggaggctttctgggtgggcatattgatttaccagcccccagtgcagaggttcttgatctttctaatacatgccagctcaccaaatgcttgtcacacttgcaggtcccaagcccatggctgtagtttggccagataggcctagagctctcctcttgacagatcccgcagggctggagcagcccagcaccctcagaccacctgtggagaaacactgaccaggtcttctctaaagggggctgggtgcctttatggaactctgcgtaggagctcaaaatttccctgacttcattgtcacataaagagctaagcagaactaagtaactcctaaagcagcccaagaattaagctattaaatgagagccatcctgggcttcagcctgtgcctcggctgtgtgcgtcatcgagtggtctggtccttggtaaggggcttagtgtgctggtcagtgctagaattggtggcttagcctgcaggggaagaagagttgaaagagctgtcctggattgcttggccagttggtggccaaaccaggaagctttcagtggtccatgcgtaccgctgacctgcagacgagctggggctgccccctaagccttgctttacgcaggatccatgccttctggttttgcatttatagttaagtgtgggggatgatttagaaatgccatttcccctcctttgcagaggcgctttctttgaccagcgatggggagggcccttgtcagtgtctccttgaccatctggtcacttgtctaactttggttccataaaccataaagtcttatctcaggtgtttttgtttgctgatttaaaaagactatctttcacctcaggaagattgaaaatgctaatgaaatcgctaaattttcagtagatcaaaaaaacctgttgcttggtttcccagctgtttttctgatcgaggctctctgaagagcataatgcagtccaacacattaaccaaagatgaggatgtgcagcgggacctggagcacagcctgcagatggaagcttacgagaggaggattcggaggctggaacaggagaagctggagctgagcaggaagctgcaaggtgagggcagcgccggctccggggccaggcgggggcgctgcggccaggctgcacctcacgctgtctctccatccctcagagtccacccagaccgtgcagtccctccacggctcatctcgggccctcagcaattcaaaccgagataaagaaatcaaaaagctaaatgaagaaatcgaacgcttgaagaataaaatagcaggtatgtgtttaaaagtgtgacttcttagtctctatttttggtcattactgtcttaaaagggaatttcagagtccttttcataaagtgggaaagcagaaaaaaagcttaggctttagcaagcttatttagagttctcaaattttggtcagttgtttttttttagacggagtttcacttttgtcacccaggctggagtgcagtggtgcgatctcagctcactgaaacctccacctcctgggttcaagcgattctcttgcctcagcctcccaagtagctgggattacaggcatgtgccaccacacccggctaattttgtatttttagtagagacagggtttcaccatgttggccaggctggtctcgaactcctgacctcaggtgatctgcctgccttggcttcccaaagtgctggaattacaagcatgagccactgcgcccagccccaattggcttagttctaatgatattattttatagtcaccagctagaatcagttcctgatattttatctgtacgttctctggctattttctgcttctctgttacagttttcctttttgtggctttcagacagttcctagagctgctttcctcctaaagcttaatcagtgactctgcctgctccttggtgttgtaggtgctagacctgctgtcaccactttcttttggcggttcctaggttatcaaagttccctaaaagctccaatcagtttttgtttttttgtttttttgttttttgagacggagtctcactctgtcacccaggctggagtgcagtggcatgatctcggctcactgcaagctccgcctcctgggttcacgccattctcctgtctcagcctcccaagtagccccccaccacgcctggctaattttttgtatttttacaaaatagagacaggatttcactgtgttagccaggatggtctcgatctcctgacctcgtgatccgcctgccttggcctcccgaagtgctgggattacaggcgtgagccgctgcgcctggcctggctccaatcacttttaagccttaacctcacacaggttggctctgcagttgaccttcacctccaaagcacactttgaatctcaccttctctgcatttcctatcaggaaccccactgtcctgatccaaaaacagacttctttgattgagtcacttactaactaaaacttttcttgcacgctgagaaaggacaagggccaggcactgtgctgggtgacacaggttagagggactgagcagacgagtgtgtgcgccacccaagggctcccagtgctcaggggagatcgctgtcagatcagagtaaagtctagggagcctgttcagcacaggcatgcaggtagctgtgcctatgacactgtgtgtgtgtgtgtgtgtgtgtgtgtgtgtgtgtgtgtaagtaaaaaaacctctgaatgaaaaagtgttgtgaattattaaataatttcctgtcagtaagtcagctaacataaagtttacatatagtcattgcacataaaggaacagagtttatttcctcttttgtccagattcaaacaggctcgagcgacagcttgaggacacagtggcgcttcgccaagagcgtgaggactccacgcagcggctgcgggggctggagaagcagcaccgcgtggtccggcaggagaaggaggagctgcacaaggtaggtggctcagtttggggtgagaaaggcttacgggactttgcagaattctgtaaggtcacgttcatgccgatgatggaagacctcttgggactcctgcccatgggctgtccctgctgcatgcaggacgccagggccaagcctggccccggggcccctgccacgcctgcctgctgcacagcccccgcgtcggctggcagagcttggctcccagtggcaggtgccttccacccccttgcccccagcggttatccacctcgcaatcagcctctccagtctccacttcagacccacagagaaagcagcaccccactgcattctaaagcgaggaaagatgtcgatagggcatggtggccgtgcacagggcatggtggccgtccacagggcatggtggctgtgcatagggcatggtggctgtggcaacacacgctgcgtcccgagccaggccctccccttctctccaccaggcctctgctcttagaaggggacccttagtaatgacagggaactgcagcagagaccctgtgttaaaatctgggtgatttccccccataattcgtttataaatttcatttttagtaatatatgggaaacttttatgctcaggtgtcagcatgttactaacacaattatatgcgtgttttctaaaatacattcattgatacatgttattcttgaacctgtagtttgtgatctgttctctaaaatgtgccaggtatcaaacccagattgtttcttaagataatctgtgggtcatccacgtgagtgatttgtctagaagtgcagtgtggggcacatggcatctcattgcttgacagggtcatagtacctcccagcgggcccagagaggcctggggaggcctccccttcacgtgtgggagctgccctgccagcttgctcagggtcttgtcacttccatctcagaccagcaggtgtgacagtgactgaactgccagatagttgaccagattggctgcagggaggtcagggtcatcagcgtggtgagtgcagagtgacagccagtatccgcacatcagtctgcattgaagggcaggctgtccagcgattgtttttatacagttcttcactgtgacttcaccttcagcactttgtgtcatatgtgttctttttgattttgcttatgtttaagtaactagattgagtgcccaaatgcttcattcagctttgcggctgtgcaggtgacactgggcagaggctgacattacggagcgtcctcctgtaagcacgctgcccccatgtggttgtggggcttttttttttttttttttttttttttttttttttttttttttttttttttttttttgaggcagagtcttgctctgtcgcccagcctggagtgcagtggcacaatctcggctcactgcaacctctgcctcccaggttcacaccgttctcctgcctcagcttcccaagtagctgggactacaggcacccaccaccacgcccagctaatttttttgtatttttaatagagacggggtttcactgtgttagccaggatggtctcgatctcctgacctcaggtgacccgcccaccttggcctccaaaagtgctggggttacaggtgtgagccactgtgcccggcctgtggggcctttcttggtgtgcagttggtctcagcacctgagcccaggcggccttcccattgcctgtgtggctggcacgagacagagcacaggtctttttccaagcagctcagatctgtggctctaatctgtaaccagcattggctgtcgcttttaactcctcaatatcatggaagaccgaacctccagccttccaagcctttgttaggcaaacgtaaaacatctataattgtttttgttcagcaactggttgaagcctcagagcggttgaaatcccaggccaaggaactcaaagatgcccatcagcagcgaaagctggccctgcaggagttctcggagctgaacgagcgcatggcagagctccgtgcccagaagcagaaggtgtcccggcagctgcgagacaaggaggaggagatggaggtggccacgcagaaggtggacgccatgcggcaggaaatgcggagagctgagaagctcaggaaagaggtagctgtggagatggttcagggatggtatcgactggacatttgtgtgacttttataaaacgtctttgaaatcttgggctgcattactgtaaaaggggtcagaaattttctgtggagccaagtaagttgatcggccgagcatttattttgttgttctcattcctcaatattggtgaaattacaataaggttcttgtggtgctgattttctttaattcccttttaagtaaatagagggtgtttatgctgtgctgtgatgcagcctggcttatgtgaataagacacctgcagtccacacagggcaggtggcagtagaaaggcaaatcacgggccgggcacggggctcacgcctggaatcccaacactgtgggaggcgccaagatagatggatcgttgagtttaggagtttgagaccagcctgagcaacatggcaaaacccttcagcacacttcaggccgccgcttaggtgagtgcttctgaagtgtcttggctcagcaccattcgacactgttggaatgattacaaccccaaagagctttcttatgtaggctacagctctcaacatgcaccatggcagaaattaaaacaaaatcttgttaatacaatgaaaacccatttcatgttaacataagtaacatgtttaatgaaaagtaactatttctttaaaaatttggcaggaagaatggcattttttacattttgttagctgttctttaatatctggctgaatggaaaacagttgagttctcatggctgtttcttcaatccgttttgctacaccgttctggataaagtacatgaagaaatcctggcccccacagatagctaattaggaaaggaagggccttgcacacccctgatgtctcaggaccccagggtttgcagccctgtgccgccctgggtgttctgagtgttctgctgtgaatggttgacatattgtaagcgatgcttagtttagaactctattaaaatttccttgataaatcccataaatgagaaggcctggaagcacatgctcctgttcctttcaagttcagggctctttgttctttagccccagaggacctgtttgttttcttcttagtctattttgcaacccaaatatatttgtagttacaggcagttaaaactgaagttagtgatacccctaatgaggaattagcattccacatatgggggaagtgataacagtgcctgggattgccctcgagtggtttgggcacaggcagagatgaagcgggcttggctcgggagctcactgttgaagctgggtgccggcacgtgtgttcgctattctgctcgttcttcgtgtgcgtgtttgaaatggcccatttaataaatgaattcaagttctacagatatcaaaagtactggttttcacgaatcagtgaaatttaaatttcaagaaatgtatcctttcttgaaatttaagtgtcaatttaagctagaattgaaccttgttttattagtaaccaaccatcccagttgaacccagaagtgtatttctcaaactttaatttgtgataagatttgatgaagggtgaacacgcgcagagctccttcgaggtcttgttcttgtggaggtcccgtgggtgctgctgtaactggtgaagcagggctcgctttttgttaatagaaactggatcttccttttgtagctggaagctcagcttgatgatgctgttgctgaggcctccaaggagcgcaagcttcgtgagcacagcgagaacttctgcaagcaaatggaaagcgagctggaggccctcaaggtagtgctgggcgggggtctctgcccttaactgagagggatgcttatctttgctgacgccaccacatggaagtcaccttgtgtaatgtgtggtccgggccgagtgtcacccgaggctgttcagacaagacccacatgtggagaggtggggggtgtgacccctgccttcgtgactgctttcatttttaaaggccaagttcatgtttttcctttgttatataaaagtttcaggcaattcacagtaagtcctaggaaacgaatatctaattggctcatttcctactccagccccatcaattcatagccttcttcacatcgtggtattctaaattcggtgcagttgagttttggaaaagctccttaaagcccgtagcctgctgctgactggggaagagacaggctggccatcagtcggggcccactggtggggctggagggtagcagggaggccgcggagggcgggagtggggaaggccacagtggccaagtgggcaaggggccggaggcggatctccttggcagtatggcgtggcctggatctcctcatgtgtgagccgcgtgcgatgggtctgccctctcccttcgcctcagtgatctggcaactcttcctctgggacgtgggcctgagatgctgttcctccctggcagcgggcttggctggacctcggcatgtggtgcccgaggctcctgcccctttctcagcccttgagtctcctctctgcacagcaggcagagtgagcttggcagaccaaagccggatcacattcctgtgcggcagggcctccgtggctccgcagctgtccagcagctaccctcctgcctgctccagcccagcagtgcctctcctgcccctccttgccccgccacaccagacacactggcctctctgcatgctgcaaacactgccaacacgtcccacctcactccagcctgtgcccttgttctttgcccctagcctgacacctcacttaataggccagcaccttacagaagccgccccagccatcctggcacgccctccactccctacaacctggctggggtgcacggcccctctgcccctttactggtttgctgtcagttcccgccagccccaagagagcagagacctcagtgtcaccccagtcacaaggagggggcccagcacagagtcagccctcagaagaatgctgcaagcatgaatgaacagggtgtggggcagagcttcgggggtcccaggcagacctgggcacatccccctgcaaggccgtctcctgctgtgaccccctagaacctggatcacgttagccaggtcagctacgtcatctggtgtagaccaggcacacacagtccttgggaaggtgtctgcacttgcttgggatgaaaggggttgaaaggacagtgtgacccttgaggacacagaggtttgtcaatttatgttaacctttgtcttcaggtgaagcaaggaggccggggagcgggtgccaccttagagcaccagcaagagatttccaaaatcaaatccgagctggagaagaaagtcttattttatgaagaggaattggtcagacgtgaggcctcccatgtgctagaagtgaaaaatgtgaagaaggaggtgcatgattcagaaagccaccagctggccctgcagaaagaaatcttgatgttaaaagataagttagaaaagtcaaagcgagaacggtaggttttcatgagcttctcagttcagaagatgcaagctgatacccacgccatagatacgaatatcagtgaagttacgagcttttaaaactgtttctcgctcaccttggcaggcataacgagatggaggaggcagtaggtacaataaaagataaatacgaacgagaaagagcgatgctgtttgatgaaaacaagaagctaactgctgaaaatgaaaaggtaattaattcaaagtacctgagttagcactttgtgtggaagttgtaatttaaaaaaaaattatttttaatttgtgtgggtacatagtaggtatatatatttatgggggagtagaatgtcgtcattcttgagtcttggaagtttggttttttttttttgagatggagtctcgctctgtcgctcaggctggagtgcagtgacgcgatcttggctcactgcaacctctgcctcccaggttcatgccattctcccacctcagcctcccaagtggctgggactacaggcgtctgccaccacgcctggctaagtttttgtatttttagtagagacgggttttcaccgtgttagccaggatggtctcaatctcctgacctcatgatccacccacctcagcctcccaaagtgctgggattacaggcatgagccactgcgccggccgaagtttggtgtctttttacagtgcagtaatgtgccatataacgatgcttccatcaatgatagactgtgtgtacaacaggcgtcccgtacgatcataatactgtactttactctacctcttctgtgttgagatacacagatacttagcattgtgctacagccgccggcagcgtcccgcacagcaacatggtatgcaggcttggggcctggaattgacaggctgtaccacagggcctggtgtgcggcagccgcaccgtctaggcttgcgtgagtgcattcacgctgtgtgtgcaaggacacgtttctcagaccgtgttcttgctgtttcactacacgtgactgttttaatttttgaatggagtcatgtgtttggtcttttaaataggatgtttgtattcagcgaaaagatgccaattgcctgaagtcactagctccagctccatcagtttaggtttagatttgaattgaaatgtgacttaagctagatacagtgaaaaaaatccatatcatgaacttagtttggaaaaatctcatgacgattaaagaaaactttcagagtcttcaaaagaacttccagtgttaaatccagcatacttaaaggatgcccgattaacaagttctgtggtgaaattgtttcatttcagctctgttcctttgtggataaactcacagctcaaaatagacagctggaggatgagctgcaggatctggcagccaagaaggagtcagtggcccactgggaagctcagattgcggaaatcattcagtggtacgtgcgcggccccattagcggccgtgaatccgctccctgctcagtccatggggtctgccccgcctcttctgcctgatcctgtgctccacgccaggccgtgcctctcaggctggggtgcaggtctcactgctgttccccagaacttctcatgtctggggcagtggttctgttggaatagaggtggagatacgcccccaccaacccactgaaggacttggggcaaaccgttcacaccccttgcgttctcagagacaggggaggcagagccctcccaaagcggctgcagaagcagcagggagacttggagcgagctgggacctggccctccgctcctaaggtgtgaagttgtaattaaaaaaagagtttttatttttaatttttgtgggtgcgtagtaggtatatatatttatggagtaatagaattttttcattcttgagtcttggaagtttggtgtctttttaaactgcagtcatgtgcaatgtaacgacgcatccatcaatgagatcccgtgtatacaacgggtacactgcgggcactctagctgacgtgacactgtgtcactgtgtgccgaggaaggcgggaacgtccccttcttgtttggcttctccctgatagccatgcttcgtgagatagaacatctgttccctcctccagggtcagtgacgagaaagatgcccggggttaccttcaagctcttgcttccaagatgaccgaagagctcgaggctttgaggagttctagtctggggtcaagaacactggtaggttttgtgtaatgcctgcatttctattactgaataattcgctaatggttttaagtataaatgtgacatataagtactatttagggaattacagtgatgcaagagacttctgtgtaaccagttccccaatttaaggaacgccaacatttgccagctctcagatcatcatggcttctctcgacagcattcattcgtttagcaaataattactgagcactgagctccgtggtgtcaagttaagactggattctgccctcagagagcttgcttttattaatttcattggttcatttagtgatgtgtgtattttatttttttcctcccgcgacagtctcactctgttgcccaggctagagtgcagtggcgtgatctcggcttactgcaacctccgcctcccggcttcaagtgattctcctgcctcagcccccccgagtagctgggattacaggcgtgtgccgctacacctggctcatttttgtattttagtagagacgggtttccaccatgttggccaggctggtctcaaacccctgacctcaggtgatctgcccgcttcggcctcccaaagtgctgggattacaggcatgagcccccacacctggccttcctctgtccattttcttctctttactgttatagatggaaaatgaagcattctcaattgtgttcaatgaaaggttttcagtttgttttaaaaaagaaaaaacagcaagatggcatctctggacttctttgatacctctcgaaagttgatgtcatacattgggcaactcagtaagaaaacaggaggatgatgttagtgaactggcttattccactgttgcttcatcctaggtcactctgtcattcttcccttattattttagtcttttttttttttttttttttttaatcacaggtaggaatgagtaatgacataattcccaggatggtgaaatagcaaaacgtttcaagttatgagaaaaagataaccgaaccctataatgtaccttaggtttgtaaaagggtccagggtccagtggacccatatagaaattgcattacagaggccaggcgcagcggctcatgcctgtaatcccagcactttgggaggccaaggggggtggatcacgagagcaggagttggagactagcctggccaacgtggtgaaaccctgtctctactaaaaatacaaaaattagccaggcatggtggtgcggcacctgtaatcccagctactggctactggagaggctgagacaggaaaatcgcttgaacccaagaggcggaggtcgcggtaagctgagatcacgccattgcactccagcctaggcaacaagagcgaaactacatctcaaacaaaaaaaaaaagaaaagaaaagaaaagaaattgcactacagaatcacttttattcttctaaaagataaagtaaattatttagttattttttagaagatttctgaggaagagtaaaaaaagtcataaaatatcaaaactaaaactcctgaggcacctccataatttagagttaatatctaaatgagaccgtaatggcttaaggttagacaaagataacttatttgttaacattagtttaacaagcggataactgaaaatgcatttttaacgccatgaccgtgtctcaaggacccgctgtggaaggtgcgccgcagccagaagctggacatgtccgcgcggctggagctgcagtcggccctggaggcggagatccgggccaagcagcttgtccaggaggagctcaggaaggtcaaggacgccaacctcaccttggaaaggtacttggtgccagggtctgactccaggtaggagcagtggctgtgtggcctcgagcccgccctgagcctcacgggctccgatgctcctcgcctggaaaatcggggccacggcgtttgctggagccttaggaggcagcacgtcgggttcacctgcaggagccccgaatagcaggccgttctggcactgaggtggccgcgagggtgcagggccttgcctgccgcgggggggtgtggtgcggtgcgagccgtgttttgacggcagcgggtgcttgtgcccccacgctgggtagcgagactcacaccgctgtctgacaggagcccctctcactgcttagtcacctccgtgccgctccattcactaattcaagattgttcctttcaagctaacgtgaatattttaaaacagaggttgaagatggcattctcacttgaaatttttccctaactccaagcagtaacgagaacgccattttcacacagcagtgattcagtcagtatttgctgagagtctcctctttgcagatctggttttacgaggatacgataatgaacgtcagtttcataaaaaccaggccagctctgctgtgccatgaggcaggcgaggacctggaagggacagtgtctctaacagaattaccaagtcccaaatcctgttagtttggggctaaaaaattaatggtaataggtttcagttaaattgactttctttatactgggaattgctgtaagactgttctgttgttaaatcctgtgaccctcccacagcccaacagggtaggcagtcttgttactcccacttacacacactccgcaggtgatttgcccactgtcaccccactgatgagtggaccagcccccacaaactgcatccctcccggccaggtgttccccgtggcagcctgacttcctctgtcccctgcacgaagttgctggaattgcaaggctacccgtgcgggtggtgctggtgcttcttggtgcagccaccatcttgccagttatgggaaagatattgatggggctgacggctgagcggcctgggccctgtgtccctgaagaacagaggactcgcctgggaacaagattaggaaggtcaagagctccattaggccttcatgagacacgccttcctaagccatgactttttaaattcctgtttgaatgtttatatttgaaatattcgtactgttcatggtgtttgcagtagaaaggcccagcatgagctaccgtgttctggacagtcctgagtgctggggagaaatcccggctctctcatcctgacctgccccataccagctcacagacaacctcttctcagtgcacttaaagccatttattttttattttagcaaactaaaggattccgaagccaaaaacagagaattattagaagaaatggaaattttgaagaaaaagatggaagaaaaattcagagcagatactggtaaattaatgttgtgcgattctgcattatttgaatataagtatttttcaaatgaatgtttttattttcttttcgacttaatagttactttagaagcacctacagaattccaaattcagtattttccaaaatcagcattttcaaacaacatcttcaaatatattttccccaaaggtagccattgtttttggtttatccttcctttttttttgagacagtctcgctgtgtcacccaggctggagtgcaatggcacaatctcggctcactgcaacctctgcatcctgggttcaaggattctcccgcctcagcctcgcaagtagctgggattgcaggtgcacaccaccaccacccctggctaatttttgtatttttagtagagatggggttttgccacgttggccaggctggtctgcaactcctgacctcaggcaatccacccacctcagcctcccaaagtgctggaattacaggtgtgagccaccgtgcccagcctatccttcctttcatcttgaaagcatatggcaaatccacacaaatctaggcacacatttgtatcccctgataacacaaaaggcatcattttgtgctggaggggccaccccggcctcctctgcagctgcactgtgcgctgccgtgggctggccagccactgggatggtttattccctggcatttgctgtcacagaaagtgctgccaggagtggctgtatggatagaacatttcctgtttttgtcggtgtatttcgggatagagttctagaagtgggattgccagggcaaagggcaaacatgcctgtacactcttgctgcatgctgacggacaggcctccagaggctgtgcagtgacgttcctcccactttgcatgaggggtttctgccccacagcctacccacaaagtaggatttcagacttttggatttttgccgctctgaataggtgagaaatagcatctccgtagaggtttaacttgcatatttctcataagtaagattgagcatctttttatatgtttgagggacttttgtattttgtgcattatatgtttttattgtttgcccgcttttaaaaattcaggttgttagtcttgcggatttctaaaagccttttgcattttggggattagtgccttttgtttgtgatgtaagttgcaagtatttttcctagtttgtctttgcttatcatttatttatttttttgccaaataaaagtggttttgcagccggtgcggtgctcacgcctgtaatcccaacacttcgggaggctgaggtgggcggatcacctgaggtctggagttcgagaccagcctgaccaacatggagaaaccccatctcttgtaaaaatacaaaattagctgggcgtggtggtgcatgcctgtaatcccagctactcaggaggctgaggcaggagtattgtttgaacttgaacctcaacccgggaggcagaggttgcggtgagccgagattgcaccattgcactccagcttgggcaacaagagcaaaacgctgtcttaaaaaaaagtggggggggttttgccatctctactaaaaatacaaaaattagctgggcgtggtggggcatgcctatagtcccagctactcaggaggctgaggcaggagaatcgcttgaacctgggaggcagaggttgcagtgagctgagatctcgccactgcactccagcctgggtgacagagccagattccgtctgtcaagaaaaaaaaaaaaaggtggttttcaaaattttttgtgtgtcaagttttcagtcttcttccttttttgagtcataaataggaaaatacacctaactcccagttgttggagggattccctcatgcttctcatacttgtgtggcttcatgattgattgattgattgattgattgattgattgattgattcagggtcttgctctgttgcccaggctggagtgcagtagcacgatcagggttcactgcagcctcaactttctgggctcaagtgatcctcccacctcagccccctgagtagctgggactacaggcacgtgccaccacacctggctatttatttatttatttatttatttttagagatggggttgtgccgtatttcccaggctggtcttgaactcctggactcaagcaatctgactgccgtgtctcccaaagtgctaggattacaggcgtgagccaccgtgcccagcctcattttttaaattagaatactgatccatttgaaatttgctctgacatacggttcgaggagtgtatccagttttatcttttgctaatggctagctggttgtccaataccagttattaagctatttttcctgctggttttatgtatgactgttgtcatgtacaggatcaccatgggcttgggtctgtttctggatcttctcccctgttccattgttcatggggaagaaccacttgattcttgttttttgatatgtgtttttttgtgtgtgtgacagggtctcactctgtcacccaggcaggaatgcagtggcacgtgcagcctcaatctccccagctcaagtgatcctcctgtctctgtctcccaagtagctaggaccacaggcacatgccaccatgcacagctaattttatttatttaatttttatggagatggggtctctctgtgttgcccaggctggtctcaaactcatggcctcaagcagtcctccgaccttggcctcccaaagtgctgggatgacaggtgtgaaccactgtgcctggccatgattcttattgtagaggccttagtgaatctgctttaatatctggtagatctgctcctcctccacctacgcccagcccagctgcccctgtggttttgaggggttttgttttttgtttttgtttttttttgagatagagtcttgctctgtcgcccaggctggagtacagtggcatgatcttggcttaccacaacctctgcctcctgggctcgagattctcctgcctcagcctcccgagtagctgggatttcaggcacataccaccatgcacagctaatttttgtatttttagcagagatgggatttcaccatgttggccaggctggtctttaactcctgacctcaggtgatccgcccacctcggcctcccaaagtgttgggattacaggcgtgagccaccgcacccagtcccttggttactttttcaagtgaactttttgattcttgttactctctggggaaaagcctgaccccttttttttttttttttttttttaattgtgatcatgtcagatgtatcagttactcaaggagaattgacatcttgaagacactgagtctgtctgaaaataatatgtagactttagtttttttgccttgactattctttgtttctttttgcagggctcaaacttccagattttcaggattccatttttgagtatttcaacactgctcctcttgcacatgacctgacatttagagtaagtcattgttttttttttaagtgacagatgagtttatgataagttagaaatagtgtcatatatgattttaccactcatggggccacaaacacaccagtaaatatacattcagtgtttatctcagcgttgtgctaactgtgtaattgacccacatgtaatcaacccacattaaacgcatcaggtgacagacatttagggtatttgaggtgctcccagagaagctttctcaactcagattaagtagagatgagattaagaaagtgctcagcctcttcagggagaaatctgcactggcctcagctgtgtagtgagtatttttttttttttttttgagacggagtcttgctctgtcacccaggctggagtgcagtggcatgatcttggctcactgcaacttctgcctcccgggttcaagtgattctcctgcctcagcctcccaagtagctgggactacaggcacccaccaccacgcccggctaatttttgtatttttagtagagacagggtttcaccatattggcgaggctggtctcgaactcctgacctcaggtgatccacccaccttggcctcccagagtgctgggattacaggcgtgagccaccacgcccagcctgtagcgattatttcaagaaaataatacaaattctcacactgggatgggtgcagtggctcacgcctgtaatcccagcactttgggaggctgaagtgggaggatcacttgagcccaggagttcaagacgagcctgggcaatatagcgagaccctatctcttaaaaaaaaaaatcccacactagagcgaataaaaatactttagttgtgtttccatctgtgtagctgtagagttcggcattggggatcgatgggaaaggtggttgatgggaacagtctggcaccaggtgccttgccgagaccctcacaaggaggccaaccccctcaggcagtcggagccgctggtcatctacttgggaattagctgtcgagtgaggagcagaccccactgcctccctccatgggccgcaggttcttggtggcattccgtggaggcaggacagcctttcctcctctttgaaacctgtagggatgcacccttgatagcagcacgcaaagcatattggagcagggagagtggagctcactaatggaactcctgatggggtgcagggtggggaaggtggttccagcctttgatttagaaaactccagccctgcaggcgagtgggaagaatagggtgcatgtgtacatgtccctcacctggggttttgctacatctgctttctctctctcaacataagagactttcttcctctgaagtatttgaaagcgacttgaaggtatcagcgaccccaacatacttcagcagttatttcctacgattggggcattctctcacataaccacagtgtcactgtcatcaggcattctgtgctgatgccgtgggacagcccatatccatgtgtcccttgtcgtcccaggaatgccctttcctgctggcttttcctcctagttctggatccatctggaggtcatgaatcgcatttagtcttttgtttcctttaatctggaacagttccccatctgttcccttttatgacaatgatattttggtgttacccaggccagttgtcctgcagaatgtccactctgggtttgtctgatgtttcatcttcatcagttgtgggttgaacctttggcacaaactctcctcaggaggagctgtgccctttccacgcacagaggccggcctgcccagggtgggtgatgccaagtctgatcgttgggttgaggtggggttggctagggttgctgcctgtgtgagtagggggcagtcagcaggtgcccatgtgggcatctgcccgtagcagcctcccttggggtggactcttagcatcctggcctgtgtctgtcattacaacacccaagcaggcttgcattgctcacagccactctggacgcacacctgttcaccttcacctgtcaaaatgtttgtttgttttatcaaactggcaatgcttgtcttttccctgaaatccacagttttgaagaagcaaatctatttaaccggtaagtgcccgccagatctttgataagcctgtttctgcacaagtcattgcctctctcgttgctgcggagccgggcactgctgtggggaggaataagtggattccagagaaccagagatggtgcttgatcactgaatggaggcggccaggaaagcggtagctttctgtaacattaacagagtagagggcccggtagcaagtgagtttacagccagtactgtccatgagtgtgtgagtcacagctgtggagagtgggcagcagagatggagacagaggcggcatcttcatgcctcattctctacagccagcacgcctgcccttgctaatccctcatccctccctttttttttttttttttttttttttgagacagtcttactctgtcacccaggctggagtgcagtggtgcagtttcggctcaccacaacctccacctcccaggttcaagcaattcttgtgcctcagcatcccaagtagctgggactacaggcacgcgccactatgcccggctaatttttttttttttttttttttttttttgtatttttagtagagatggggtttcaccatgtcgcccaggatggtcttgaacttctgacctcaggtgatccacccacctcagcctcccaaagtgctgggattacaggtgtgagccaccatgcctggcccataattgatttataaattgtgatataagcacacataacataaaacttaccatcttaaccattttttagagtcagggcttccttctgctgcccaggctggagtgccgtgccaccatcatagctcactgcaacctcaaactcctgggctcaagcgattctcctgcctcagcctcctgagtagctggcactacaggtgctcgccaccgcacccagctaatttttaaatttttgtagagatggattcttgctatattgcccagaccggtctcaaactcctaacctcaggtgatctgcccgccttggcctcccaaagtgctgggattataggcatgagccaccgtgcctggccgctaatccctctgtgatttaaatgggaaggcatttattgttgaacagaaaaaaccctccatcaggggctgggtctgttagagcttccagactcttttgaaaattgtctttgagaaacttcttatcccacgctgcctgcatgaaacatgttggtttttactagaaacagtttgtcaccaagattaagtcaatatatcttcatgccagtgttgactgggtgggaaatgatgtttgttcctcctgtctgttacctccaaggactctctctcctcctcgtctgcatcttccctgctagccttttgggaagaagtaagtggctgccagcgctggcttcccgcagctttcactcctgttagtgcacagcctcctcaatgttcctgttcctgaatctgcatccctttgattaattaaccaactaaatgaaacgagtggggcttttacatgcctaaaattaatattctttttctcatttatctaaagatggaaccgtaacacttaacataccttgtttatggggcagatttgcttacatttttgagctttggtaattagccagtcgagctagcctttcccttgtgaatttgcagtacacagttgtgtgtgtgttttatgtgtgtatgctgccatcccatctgaatttggctccttcctcagtggcctaattaattgcaactgttggaaagtgtttatctgatttggttcattgggattctgatgtggaacacaaaatacagctgtcaatgctttaggcgcctacccagccatgtctgtgtcccatcacactgcttgctggtgctaacacttgctactcagcatacctacatgtgcgtctgtaaacagcagtggcctgtgatgataaactattagtttcaggaatacttgttgaaatagagttgtttttaagtggtttcagagtgtagctttagcttcaaataaatcactgtgaaattagaactcttaatttgttaaaacaaaacattgcttccctgtgtcataaaattttcaaggaaattcttaaatctactcatgggcccaccgacctctgttgatgttcgaatttcttcttgatccttgaaatgaggttaagaagcatttggctatttgatcttttcttctttctctttttcttttgagacagtcttgatttgttgcccaggctggagtgcaatgacttgatctcggctcactgcaaccttctcctgggttcaagcgattgtcgtgcctcagcctccagagtagctgggattatgggtgtgtgctagcacacccggctaatttttgtatttttagtagagacggggtttcgccatgttggccaggctggtctcaaaatcctgacttcaggtggtctgcccccctcagcctcccaaattgctgggattacaggcgtgagccaccgtgcctggcctggctaattgatcttaaggctgctaggcttagataacattacttatgaataaaggtcaggaaggatcagcatttccaggtcttgccctttcagtgaccggggcaaggaggctgcaggagggggcgggtatgctcagggctgtgcattagaggtgtctccaggcaaattctcacctcagcggggtgactgtgacttgtcagactccacctgcccacgcaatcaccactcagctgaggaagccaagtgcaggggtcctcagggcaggccggccagctgggagtggagcaggggtctgtgaggagacccaaggggtgataggatccaggagtaagaaccgctgggacttctgggctagacagaatctgcttttattagtaaagaacttgtaagtagagtctggatcatgtagaatatgtcctttcaccccactctttctttcttggttctcacagaccagctcagctagtgagcaagaaacacaagctccgaagccagaagcgtccccgtcgatgtctgtggctgcatcagagcagcaggaggtgagacagcgttgccctggtgatgctcccacctggggtctgccctcgtgtccaggtgaccagatgctgctcacctggcccctgcataacagtttgcagcgagggcctctgcccaggtgctcaagcccacctttcattttgagaattaactgtcagtccctcccctagatgagggaggcttccgcagatgtctcaacattgtagcaaattaaaaatgcagaactgttcactgttaacacattcttgagagaagtgcaccccgtagggccaggtgtctcagccatgctgagctgggccgacactcacctgtcctgcttgtctcccaggacatggctcggcccccgcagaggccatccgctgtgccgttgcccaccacgcaggccctggctctggctggaccgaaggtaggggccttgctttcacccggggcgccttcttagttatttagttgtttatttattctcagttatttagaaaataagttttgtataaataaaacatacttagtcatttttgcatacacacagtagcgaccctcatgttctgtaggaaagttgttgagaatggtgtgtaattcaggaagctgtcaggaccctgtgttttcttaatgataccagtgctacacaaatatattttaattggaaaagttcagcattcagtctccccactctccttctctcattccccaagccatattcccctctccacaggtaggcagcttacttctccacattgattttcatttgtctgcctgcacttagagaaccttacagaaccatgtggctggtgggtgagaatgactcccagcataaacggccctgcagtgcatgtgcggttctgagcctcatcctttccacaagtgcatcctggagagccagcacagcggccccactgggcccctgctcccctgtcctggcctcggcttcttctgtaacatccccttttctttcatataaacatcaacgcagatcagaaagtctccagggtgacgggcccctgagttccaagcattgcgagtacgtagccctgtggcctaaggtggtttttgttgttgttaatgtagacacggcctctgcctgtgcttcctgccacaggcagctatgccggctggacgtaagaagccaaacttctatgaggctacctaagggtttggcttttggactaagactcttgcagagtcagggaccaagtcgcgaggtcgtttatttggttaccatatttgatagcaactctgcagagtgctggtgtgtcactcctagtcctgatggcccggccaccgccccacggcctccctgcccacctcagccagcctcttcccccacagctctctggagtttgtgtcggtcactcccctacttcttgcaagtggtctcacccacatctgtttcctgctgaggatcgtattggtctctgctgcgcctgagcttggtaaacaggcggtcccgcatggcctgcaccacgaccctctgttcagccttggggctgctgcagttgccgctgggttcacaatgtgtccactcctgatgagggaccgtgagcctttccaggcgtttgctgttatgaactgtcctcctgtcggtgattcttgggtgtctcttggacacatgcaaggcctgtgtgcagcccaacctaaatgtggccccaggtcggcccccaagagccagttggtgctggtctccaggaggccaggagcatgagccagaaagagcactggccatgccacctcggccctctggcccagctgacctcgctttttggtagcagtgctctcccactgaaggaagtatttgttggcctctctctggctcaggctcgtaggtggttttcaccactatttgatgagccctgttagggaacacgtagaccaagaccagaacttgcacatttccaccttttcaggataatgcccaagctgtgtataaactggatcacaggcagatggatctgactctcaagagtccatggttcacctcagtgttcttgattttctccttccagccaaaagctcaccagttcagcatcaagtccttctccagccctactcagtgcagccactgcacctccctgatggttgggctgatccggcagggctacgcctgcgagggtgagtgtcgttgcagctcctggggtcagcgtgcacagccccacacccctgcagctaagggcaccagccggctccagggcagccctgatgcaagcaaaccaaactaaagtgaaatgtcattggcatgatttgaggacagggttttttttagggggagtggggagatagggtctcactctgtcactcagacttcagtgcagtggtgcaatcacagttcagctcaagcgattcccttgtctcagcctctcaagtagttgagacctcagacacacacaccaccagcatgcctggctatttttaaattttttttgtagagagttgagggatctcactttgtttcccagaccggtctcaaactctgggactcaagtgatctcccgccttagcctcccgaagtgctggaattacaggcatgagccactgcacccagcctggcaggtttatttttacaaatcctcagtaaaggtctgtggaaccgtggatccctgctgtgctgggggctccattgtgctgtgcgcctctgtggtgactcaactcatctactgagaattactacgaagtagatcatctgcagctgttctagaaaatcagagaggaaaagtaattgtgtaaaaccttccactgtcaaattatctaaagataaccacaattatttgtctctgcttctggtcgtcattcgtattttttttctttttttctatttctttttcgagacaagagtttgactctgttgcccaggctagagtgcagtggctcaatttcagcttactgcaaccgctgcctcccagattcaagtgattctcctgcctcatccgcccaagtagctggggacaggcccacgccaccatgcctggctaatttttgtgttcttagtagagatggggtttcgccatgttgcccaggctggtctcgaactcctgacctcaagtgatccacctgcctcggcctcccaaagtgctgggattacaggtgtgagccactgcgcccagcccatcatatttttaaggctatatcttgtgctcttgccctgtgctgggattcgacatgctcttaccccctcagtgattgccccatttcacagatgagcaaccaccccaagccacccagtgctgtgggagggtcctggagcccagactcgcactggctctgagcactcacgccttcctgaccatgggtctgtgaacagagatgcccttcattctacattatagcagaagcattgttttttgttatttcaactcatgcacattttgattggctgccaagaccccacgtccccatgaccgctggcctgaattgccgtgtagaaactcccacgtgtgggaggcggcccgggctggcagggacagcatggaagcaggcttctgccatgggccctttccctgtgcgcatgctgaagacgcattcatgccagaaaccctgagcttttgtgtggattctgccttgcaactgttcttacctttttgggtgtctggacttgatgtgagacttgatcattattttttgtttgttttgttttattttgtttttttgagatggagtctcgctctgtggcccaggctggagtgcaatagtgtggtctcagctcactgcaacctccgcctcccgggctcaagcgattcttctgcctcagcctcccgagtagctgggattacaggtgcgcttcaccacccctggctaatttttgtatttttaataaaggcgggatttcaccatgttggccaggctggtctcaaactgctgacctcaagtggtctgcccacctcggcctccgaaagtgctgggattccaggcgagacctggtgattattaaattgcctcctcagggcataggttctgcagtgacttctctgtaggcagcaagctttgaaggcagtgttcttgctctcttccagtgtgttcctttgcttgccacgtgtcctgcaaagacggtgccccccaggtgtgcccaatacctcccgagcagtccaagaggcctctgggcgtggacgtgcagcgaggcatcggaacagcctacaaaggccatgtcaaggtaggcggcttcatctccgccctcagccctcggtgcctgtgaggtgcagtgaccaatagccatgcccagccactcttgaaagcagccccttgctgcggcaggtggccctggtgccagtcctagggggcttaccctcctgggcactgaggccatcaggtcggcgcagccgctgttctgaatggcctgggcatcctgaggcctccacgcagacgctcactcagagtccatcctgggctgagtgtccagccagtgggcagaagctcagtctgaaagccactgtgccaggcccacctctacgagactgtcgggctgcgtgtaccacagcaccctgcatggggtggacacagcgttggctgagctgccagctttccctggcaccgtctgctgccacgcatggacccctccccagcaacgccttgagccttcttgggcaaacatccctctgtccaaacagctctgccgccagcctggcagctggaaggagattgtgaacgagtgtaatggggcctggcggcctgcctggcctggtggaacgtggccactgtttgtttttattcataggtcccaaagcccacgggggtgaagaagggatggcagcgcgcatatgcagtcgtctgtgactgcaagctcttcctgtatgatctgcctgaaggaaaatccacccagcctggtgtcattgcgagccaagtcttggatctcaggtctgcgtttgggcagcactgtccttgctctgtgaatcttcctcagctatctttagccaaaaggacggtgtgttccttagtagtctttcacctcattagtacttcacctgcttcattattgtatggttgcaaaaatgggtacagcttagtcatgacttcaggcgctcacatgcgtatgaacagacatgcatacgggcctgcgtgcgcaggaacgggagcgctgtagacgcttcctgcctcgcatgtgtttgcgttgagaagtttgccacaggggaattaatttaacataagaaaaccacatgcccaagaacaagcagaagatatcccagagaaaagccacgcggcccacagccgtctgtgcgttttagagaccgcagcaggtgctggtgtgtggaagaagtctggagccgtgggccatgtgggtgtgcgtggccgtagcgtttgctatgtgaccctgtctcagtgccacccagtgtcagctgcaggagcaggcggggcctccttcccacttcctcttagagttgacatctgtggctcatctgttagtgagaagaggacagtggtcatgttactggcatgtggaatgttgttgtgaaggtaaacgcatcactaagaggcctagctcagcccggggcctgcacacggagccatgctactgcctttgtgtcatctctgtgctgtgcccgtgcaccgtctgttgtgtggtgcacacgggactgctctgggctcaggccggggctgggtactccatctgtagcattggttcttgggggcagggctgctgggtgggtaccctgaggacagcgagggtgagtcggcatcacctggcagcatactccactttccatgtcccttcccccggggcacccgccagtccctggctgtgcacaggtgtgcccctggcctggtggtgaagggccactggtagacgaaaagttggcatgagcccaagtcaggggccccatcggagggctcagcactctttagggaacctcttcagaacagcatttccacacggatccaacaccccgntccccctntnacctcaacacccaccccctgctcccccctcacctccacacccacccccactccctcacccccccacctccaaacccacccccgactccgcgtctccacagccacccccccacctctgcacccaccccacctccgcacccaccccaccccctcatctccacacctagcccccactccccctcatctctacacccaccccactccctctcacctccacacccaccactccccctcacttccaagcccaccccccactccccctcacctccctccaaacccaccccccaccctctcttcacctccacacccaccccaccctccccgtcacctctccacccaccccaccctcccccctcacctccacacctaccccccacccccctcacctccaaacccaccccacccccctactccccgtctcacctccacacccacccccctacttccccctcacctccacccccaccccacccccgactcccctccacctccacacccaccccccactcccctgtcacctccacgcccaccccccaccaccccccactccctcccactcccccctcacttccacacccctcaccccacttgtcctctgcacttggctgttggagggactgcctggctgtgccaagtgcaaaccgagtcttctgtaactggcatagtctggaggcaccagcacagtggggatgaggctccggggtttcccttgcggcatccctaagccctgaaacacctgccagagtcttgagtttgttggccctgcccgtgtttcttacatctggggaggcgagggacccgccctccactgcagaacacggtggtggaaggacatggcagggcagggcagggcagggcgtgggagggccttgggtcctgtgcgcgtgtctcccagcggggtcaatgtttcttccttaccagagatgacgagttttccgtgagctcagtcctggcctcagatgtcattcatgctacacgccgagatattccatgtatattcagggtatgaatttttcattaatctttttaacaaagcacatggttaaaactgattgttctaggcatgtcattgtgctgcggcagccatcagcgcacctccagtgtggccctagggtctcaacctccagcctggctccaggtccttgtgcgtcccgtcctggccaagtagcagcctgtgcccgtctcggggagcctcctggctggcttcttcccagacacccctcttcactgaccctcccttctcctacatctgaaactcctcttccactcagtccacgtcccggccactgtcctcacagcgtgtgcactgccaggcgggcgctgtggcaggttaggcatgaaggtgcctctccagtgccccccagccaattggagccagcgtttttgttgactgagtgagtgctccctcactgagttagtgttagacattgtagcattaggacgttcctagaagactgaattggggaaagaaaccctccagccccctccactgggaattttcttataaacagcaaaattttgataacaaaactaagtctataaattagcttttactaaatcacagctctattcagaaacaaccctgtcatacacagtacaggaaattaccatcattgttactggaacgatggtcatttggtagcatgcgtgctcagaggctgctcacagggaggcatgatttgggccagtgtttttgagatctgcttttcctggacacattttcagaatctacttttataatgattattcaagaaagcagatttaaagtaggcagctactcgtagttttgacaaaagcagaattaacgaaaatgggaccaggaagcgatctcacggggctgtttagaaccccgccccttccgtgtcctgccgcgggagcctctgcaaggcgcccagcgaggtggagtcaggggtccctgcctgggaagcacatcagcccccgttgctcctggggtgcgtggctccagcagggccgtggtagctgcgtgcggctttggcgtttgatgacttctctcttctcttctgtttcctgtcatgaaggtgacggcctctctcttaggtgcaccttctaagaccagctcgctgctcattctgacagaaaatgagaatgaaaagaggaagtgggttgggattctagaaggactccagtccatccttcataaaaaccggctgaggaatcaggtcgtgcatgttcccttggaagcctacgacagctcgctgcctctcatcaaggccatcctgacagctgccatcgtgggtacgtcccaaaggttgtgtccttcaggtgtctgaagcaacagcacttccggcggcgctgcagtgcccatctgaaaatcagatgaaggtcacaggtccatttgggtttgtagacagtttctccatgcatgttaagaagcagacgaggccgggtgcggtggctcacgcctgtaatcccagcactctgggaggccaaggcgggcggatcacaaggtcaggaggttgagaccatcctggctaacacggtgaaaccctgtctctgctaaaaaaaaaaataaaaataaaaataaaatatagctgggcgtggtggcgggcacctgtagtcccagctacttgggagactgaggcgggagaacagcatgaacccaggaggcagagcttacagtgagccgagatcacaccactgcactccagcctgggcgacagaccgagactccgtctcaaaaaaaaagcagatgacctgtgcggacagtacagttggccccggctaagcctgagggtcagctccaggagccccacacacacccaaatccttgcagactcaatcccacagtcagccggccctgtggagttcgtgtagagagaaagtcacccccgatactgaagtgtcacatccctggaatgctgtattctcatccacatatggttgaaaagtatctgtgaatgagcccacccacgcattcaaacccatattgttcacggtcggctgtactgactttgtgtatgttacttacccctccacagatgcagacaggattgcagtcggcctagaagaagggctctatgtcatagaggtcacccgagatggtgagtgagcagggcgtttccagcctgggatgtcacaggcccagcctggcctctgcagacagcacagggtcagtagctcctaagggttaagacaaatgcgcttgatgaaggcgccggaggggccagcgtgccgtgaagaccggcatcgagtgcatggcgacgcggtgctaagttgcgtatcacatccatcgagttcttcaaggggagcactgagcgggagtgggtggggggtcaaggaaagccccctgggaggaggaacagctgcagctttcccacatgtgctgaggcttcacttgagaagctttagtttctttgcttccaattttgacacttcagtcttcccagcgaggaagggcaaaggtatcctggcatgcacccgctccacagccctgggtctaggagcagaaacgtcaggagactggaactggccatgggcagggggcaggggcccaggggagcatccctcaaggaatccagcgacatttcatgtgagccatagtcctttcccgacagacccagcatctctgcatgtgatggccgtggagcgagaagggcggggcagccgctgggcgaggccgtaccctggcagctctgtggggagatctgagcaagcgaggggcttgggttagcctgggggccgtgtgagggcggcgtcttcactgggggccgtgtgagtgtgagggcagtgtcttcactgggggccctgtgagggcagcgtcttcagaggatttgtctcagggtcccagtgggttggggacagctctttgtccctcatgtgcagcgtgagggccctctggttcggggatgagctggaaggaggcccagatcaccccagggccttgctgcgcgaggacccaggtggaagcgctgcccagctggagccctggtgcactgaggggtgtgcacagcagcagaggcagaggagcctttggaccagcccccgaggctgccccaggagcgcgctgtggatgtggggcagcttctccggggggcgttcaagccactggctctgtgggcagagacgggctcagggccgggctcaggctgtgcacacaggaagggagcccaggggagggccccagagtgttccaggcaagtctttagccaaggccgtcagcccctgggagctgctggctgtcccgtcggcctcacgctcttgtcctccttgccacagtgatcgtccgtgccgctgactgtaagaaggtacaccagatcgagcttgctcccagggagaagatcgtaatcctcctctgtggccggaaccaccatgtgcacctctatccgtggtcgtcccttgatggagcggaaggcagctttgacatcaagcttccggaaaccaaaggctgccagctcatggccacggccacactcaagaggaactctggcacctgcctgtttgtggccgtgaaacggctgatcctttgctatgagatccagagaacgaagccattccacagaaagttcaatgagattgtggctcccggcagcgtgcagtgcctggcggtgctcagggacaggctctgtgtgggctacccttctgggttctgcctgctgagcatccagggggacgggcagcctctaaacctggtaaatcccaatgacccctcgcttgcgttcctctcacaacagtcttttgatgccctttgtgctgtggagctcgaaagcgaggagtacctgctttgcttcagccacatgggactgtacgtggacccgcaaggccggagggcacgcgcgcaggagctcatgtggcctgcggctcctgtcgcctgtagtatgtatatgttttctgttgcatatccctgttgctgcttttcccaccgacagtcagcatgtgttcgattttgctttggtttgtcttccagtcccttagttgagtagtcacagagcatcgggagaggtgggccccatgccagcccgcagcagagagcatggttcagatctcacgtctcagaccagcagtaggcgggctcagcaacctctctccctgagcacatggggccggttcttccagaggcctcagcagaggaccccgtcggcgggcataggcccctgggcagaagggctcggcgaaccgagaacggggcgtggcattcatctctcatttaaaaggccttcctcgtgataatacagaaacttacacagtagtaaagacaagcttgaggggttttggtggccagaaaataattcacctctggtgtcttaagttacagtccctctaaggacaagtattttctgaaagtggtaggggctgtttttcaaacagttgggtcactgaattcgcctagttggcatgactttctctatgaatggtggcactggggaacaggtaggaccagtggacacttcccgactggcccgctgtccgattgcttttaaaaccttaaaccgggtggagagcggtggctcacacctgtaatcccagcactgtgcgagactgaggcaggaggctcacttgagctcagaagttcaataccagcctcatctctactaaataacaaaatatggctcacacctgtaatcccagcactttgggagcccaaggcagggcggatcacgaggttaggagatcgagaccatcctggctaatagggtgaaaccccatctctactaaaaatacaaaaaaaaattagccgggcgtggtggcgggcgcctgtagtcccagctactcaggaggctgaggcaggagaatcgcttgaacccaggacacagaggttgcagtgagctgagatcgcaccactgcactctagcctggacaacagagcgagactccgtcttaaacaaacaaacaaactagccaggcacggtgccacatgcctgtagtcccagctactcaggaggctgagacaggaggattgcttgaacccgggacgcagaggttgtagtgatccaagatcgcgccactgcactctagcctgggcaacagagcaggactccgtctcaaacaaacaaactagccaggcacggtgccacatgcctgtagtcccagctacttgggaggctgagacaggaggattgcttgagcccagaagatggaggctgcagtgagccatgatcacaccactacactctagcctgggagacagagtgagaccctgtcttttaaaacagaaaggaaaccttaaacctcagaatccctctgatctatcagagtggcctgcaccatcaaatccacagatcaagaggaggccgggaggaagacgagccgcgcatatgggggtaacaggccaagagttggggaatgacattctccctcagttacctgaagctaaacccctttgtctgccccattgtcagccttgctgagacggcatcatacccagggcgtcgtggctagacaccaggcctgtgaggtgcacggccagctccacccacgggcttactgcagtgtgtcccggctccatcccgatggccacaccacagcagacatgtgtgggcagtggggctgggccgtgggcctgcggtgaggtgcaggaaggggccagtcccgctgcctcagcaccccttgtcctggactcttaccccccaacaccctgtcctcttcataggcagccagcacagggtttaaaaccacacaggatttacatttttgcaaagcgtaacgttgaagagggcccaggtcacttagtgcaatgtatttataatcttggccacacgtgtctggcgtagacacctgaagttcctcggttctccgccttggtgggtcttctctcctgcgggcacagtgcagatgcagatgagtttcagagctggtcaaaagtaattccatcacctgtaggatgcagaactgctcattctgcaccctttgctagtgccctgtgtgggtggcctcccctgcccctccccatcccttagggcaggtgttatcagccctgttggagaggaggcagctgaaggccacaggggccgcgtgctctgtatcagtcacatgtcacatctgtcaggctccagagcccatgttcttttcactagaatctgtttcactagaatcttttcactgggcatctgtttatcactgagtcagcaaactagacttcttcctgcttccttgcaagcgaatccccacatactcggcaggcaagggccttcccagaagcccgtgtggagagtggttccctgaagggcagtgtctggggctgcttttgacttggttctcagaggcctcacaggtgcatctgaaatgctccttctgagacagtttggtgaccaggccagtatcttttgtctttcttgcaaaccctgtttgatttccctttttgtattcagaagaaaagtcctgatcttgtagcctgtttggagtctgtgatagaaacagagcagaaggcttttaaaatgcatcttcagacagtgaggtgtgtcctgatgcaggattaaccttgaactccggaggcagaagagccaggaaggagcactgagctggagctctcttgcatttggggcttgccgcctcccagctctgcgtttctgcaagctgatggccaggagccaagctacgctgaggggctgtgggggcagtgagcgtgccacccacacagagggactgagcggaagacgcacaccgctcccttgtcgtgtggcacagctgtgtcactgctcttctaaacgtggagaaagccccttaaactccaaatggccaaaggctttgcagtccttggtttcacatccgtggcaccttgggtggagttgcttctgtaagccaacagatgagcaggtgaggagcacagcgcggaccccagagctccctgcaggacgcccttagcctcgcttgcatatgccctcagaccgggctgcagaggggcttcccacgcccccatagcacgggttcctaggggtctagggtcattagtgtggagggcagacaggcagggttgttgcccagaggtcagcagtggtttctgtgtggtttttaatacctacctggaaaccggacttgccatctcctacggaagaattagcctcaccatactgaacagtcggcccctacctgaatttccaaagtgttgagcctgaattagtagctttcaggataatcacatctcatgagagctaaatgaaaaaccagactttttaaaagtcaccttcaacatctgtactgtagtattcaaaatattagttacggaagtgattgtggagcatttaaacattggattgtgtttgtttaaactttgaaatgaagatgaattccagagtgggaacatgaagtctttggtgacgtgaaccagctgagggcagtgctgccgcctctgcacttgttcaagtgccaaggcttggcctccggcccgagggcaggtgagttcctgagccactgtggctcaccccgccctgctccgtctgcgctaggttgcagccccacccacgtcacggtgtacagcgagtatggcgtggacgtctttgatgtgcgcaccatggagtgggtgcagaccatcggcctgcggagggtaaggcggcctcggtgccctcctgtgcgggcgggcttctcccggtgcagtctgtgcgtggccgcgcttactgtccctccctggtttccaatccagataaggcccctgaactctgaaggcaccctcaacctcctcaactgcgagcctccacgcttgatctacttcaagagcaagttctcgggtgagccttcctctgcaccgggagtggagggaagggaagttggaggggcgtgtgtccctggtgccgcagcaccgtcaccgcgcgctctgcttctgcaggagcggttctcaacgtgccggacacctccgacaacagcaagaagcagatgctgcgcaccaggagcaaaaggcggttcgtcttcaaggtcccagaggaagagagactgcagcagaggcggtaggagcggggcctcacggggcctgctgggcctcgctctagggagggggccaagaggattctcacgtatccatgaatctcaaaagtgtgtcctttccccagagagatgcttagagacccagaattgagatccaaaatgatatccaacccaaccaacttcaaccacgtggcccacatgggcccaggcgacggcatgcaggtgctcatggacctgcctctggtgcgtgcacggccgggatagggcgggcagggcaccccatctcctcctccccgctcaggcagccatgctggctgagactgtcccaaaggcagtgcctgcgaggctggcgctgtgctctgacctggcgctcctgtcacacaagcccgtctccgctgaagctctgttcacgagcacttaccctgtcacaaggccttgtgcacaggcctcgggccgccctgggcagtgatgctgcaggtacttgtgagagtccaccacgtttcggcctgtgagggcttcctaaggacgtttgccatgaggtggtgatttctcagtaacaccttcgtaccaacagatagcatactttctcttttttacttaagaagtatgtttttggctgggcgtggtggctcatgcctgtaatcccagcactttgggaggccgaggcgggcggatcacgaggtcaggagatcgagaccatcctggctaacacggtgaaaccctgtctctactaaaaatacaaaaagaaattagctgggtgtggcggcaggtgcctgtagtcccagctactggggaggctgaggcaggagaatggcatgaacccgggaggcggagcttgcagtgagccgagattgcaccactgcactccagcctgggtgacagagcaagactccgtctcaaaaaaaaaaaaaattatgtattttaggctgggtgtggtggctcatgcctcttaattccagcactttgggaggccacagtgagtggatcacctgaggtcaggagtttgagaccagcctggccaacatggagaaaccctgtctctactaaactacaaaaataagctgggtgtgatggtgggcatctgtaatcccacctactcaggaggctgaggcaggagaattgcttgaacccaggaggcagaggttgcagtgagccgagatcacgtcattgcactccagcctgggggacagagcaagactcagtctcaaacaaacaaacaaaaaaagtacgctttttataggatttgacctgccctgaagttgctattgccagttcttagttccagactgtccagaacccttgtccaatccagagagccctcttggcccccattttgctcatcaaggtcacgaggccacagccaccgtaggttgcacaaacttcgcagccggccctgccgggtgtcaaccaagcatgctcacgtgttgctatttctgcccagagtgctgtgcccccctcccaggaggaaaggccgggccccgctcccaccaacctggctcgccagcctccatccaggaacaagccctacatctcgtggccctcatcaggtacaggggaagcctggcccccgcagccctgggggaggtggggggtagggggtgctggaatggggagaccccaggcatttgattccgttcttgactttctccctaagaggaaagctgtccttgttctgtaggtggatcggagcctagcgtgactgtgcctctgagaagtatgtctgatccagaccaggactttgacaaagaggtgagacttgcccaggtccagtgctgaggctatgagccaccactgcaggaggaaaagcagcccgaagatctggggccctgggtggtgtcacagcccttttggagcaccccacttgcggtgtgagggtgacgggggcaggggtcggggtggctgtcccctcccccaggaggctcgtgcagcaatctcttggtcagaccccaagctcctttgggaacgctgactagggacagggctgtcacactgccccaggaggaatggaagctttcccgccaacctgcctctttcctctggactccctgtgttgttttatgtacttcaatgtgatacatcagcagtctctttggtctgggctgaccttccacattggttggtctgtctgcccctcccttgggatggcgcttggtgtcagagtgtggggaccacctccaggacaagcgccactgttgtgcgcagctcagccacactgctctggcctcagtttcccctgtgcggaatggggatgagaatgcagtcgagggaggcgaggagctgcagtgctgagggctgaggagtgagctgagggcttagcccccggcgccatccttggagggagggagggagggatgcaggcggaggggccatgctcatctctccaccacacatctcagccccagcactgagatgttttaacatcagctgccgaacggacgggcagatgccttgcacatgttgctggttctgccaaggtcagcgtctcttcctctggaagtcctttgtcttctccatcctttgtccatcctactgttccaccctttattctgcagcaggcccccagcctgtctttgtctggtgggacagtcacatttttgtagcaagcactgctgttactttacagaacgctcctgagtttgagtttgtccgctgtttcctggtcatgggatttgaagtgtgtcttaggctgtcacattatacagaggacatggtgtccctcttagggtactgtgtcctgaggcagccagtgcctgtctcgtctgcatgaccttgtttgttcttttaaatttaagtgaaattcacaaaacaacaatttttttgttttttttattttcataataatatagaggcagggtctcactttgttgcccaggctggtctcccaactcctgggctcaagctgtcctcctaccttggcctcccaaagtgctcagattacaggcgtgagccagcacaccgggcccaaaataactactttaaagttactttaaactactcagtgacatttggtacatccacagagatgcagtcaccacctctttctcattcagaaacatttccactctagctgggcaccacggttcacgtgtgtagtaccagctactagtgaagctgaggtggaaggatggcctgaggagttcaaggccagcctgggcagtgtagtgagatcttgtctctaaaacataataaaaaagacattttcatcatttcaaaataaaccccctgccctttaagcactctctccccgtccctccctcccctcagcacctgggcagccagtagtttcctgtgatttccctgtctggacatttcgtggaaatggaatgcccagcctctcgtatggcagtgtgtttgaccttttgtgcctagctctcacctggcatactgttttgtggctcacccccgttgtgtagcatgcatcagtgctggcgtttctattgctaaataatattctcttgtatggctagaccacggtttgttttcccattcttcccctgaggcacatttgggctgtttctgtccttcagctgttgtgagtggtgctgctgtgaacacgtgtgtgcacatatgtgtttgagtgcctgttttcacattcgggtttatgcctgtgagtgggattgctggatttatgtggtaattctatgtttaactttttgaggaaccaccaaattgttttctgcagcagttgtaccattctatattccaccagcaatgtgagggttctcatatctcgacatcctcaccaatacttgttcttgtttttcttctttttaatagtcgtcctggtggctatgaagtagtacctgattgtggttttgatttgcattctctaaagacttatgtttagcatcttttcatatgcttgttggccatttccgtaccttctttagagaaatgtctactcaaggcctttacccatttttgaaatgggtggtttgtccttttgtggctgggttgtaggagctcctggcatgttctgagtaccaggctcttgtgagagatgtgatgtgcagatgtcttctcttgttctatgggttgtcgttatttacattcctcataattaatgtcttttttttttttttttttttgagacagagtgcagtggcacgatcttggctcactgcaacctttgtttcctgggatcaagtgattctcatgcctcagactcccaagtagctgggactacaggtgcccgccaccatacctggctgatttttgtatttttagtagaggcggggtttcaccatgttggccagactggtctcaaactcctgacctcaagtgatctgcccgccttggcctcccaaagtgctgggattacaggcgtgaggcactatacccggcctagtacagccatcttaacaatatttttactccacgaacatgagatgtgttccatttatttaagctattttttcagcaatgttttgtaatttatagtgtacacatttttcccttctctggttaaactattcctagctattcttttggatgctgttgtaaattgaattttttttttcagtttccttttcagtgtgttcatttctggtgtatagaaacacaactgacttgtgtgtgttgatcttataccctataactttgctgagcttattagttttttgtggattcttttctttgggattttctacgtgtataatcatgtcatctgcaaagagagatagctttacttccttcctaacttggaatccttttcatttctgtttcttccctgatcgctctgcctagaacctctagccccatgttgaatagcagtggtgaaagcaggcatccttgccttgttgctgatcttttttctttttttcttttttttttttttttgagacagagtctcactctacatgtagcccaggctggaatgcagtgatgcgatctcggctcactgcaagctccgcctcctgggttcacgccattctcctgcctcagcctcccgagtagctgggactacaggtgcccaccaccatgccaggctaatttttttttgtatttttagcagagacagggtttcactgtgttaggatggtctcgatctcctgacctcatgatctgcccaccttggcctcccaaagtgctgggattacaggtgtgagccaccgcacccggcccgtggctgatcttaggggaaaattttgtctctcaccattgggtatggttagctgttttattttgttgaggaggttcccctctattcctagtgcttttctcaggaaagagtgtcgcgtttgtgactttgactgcttggttgcaggtgcgcaccactgtgcccggctgatttttgttttttttgttttgttttgttttgtgacggagtctcgctctgtcgcccaggctggagtgcagtggtgcagtctcggctcactgcaagctccgcctcccgggttcacgccattctcctgcctcagcctccccagcagttgggactacaggtgcatgctgccacgcccggctaattttttgtatttttagtagagacggggtttcaccatgttagccaggatggtcccaatctcctgactttgtgatccgcctgccttggcctcccaaagtgctgggattacaggcgtaagccaccacgcccggcctgatttttgtgttttcagtagagatggggtgttaccacattggccaggctggtctcaaactcctgacctcaagtgtgatccacccaccttggcctcccaaagtgctgggattacaggcaggagccactgcgtccggccccatctgatttcttcactacagagttgctgtcttttgtaatgataattaccatgttatttttgagtgggattagacatcaatttgtgactctcaccagcacgcctaagggccccacgaatcgctggtgtagagcgtgtgtgttttcataacatgaagggagaagagcagttgcgacagttgtccctgagcaaacatttgcatccagctgggcacgcgtgcctccccaggctagggcagcgggtgctcaccctgccctcttcctgttcacagcctgattcggactccaccaaacactcaactccatcgaatagctccaaccccagcggcccaccgagccccaactccccccacaggagccagctccccctcgaaggcctggagcagccggcctgtgacacctgaagccgccagctcgccacaggggccagggagctggagatggcctccagcgtcagtgccaagactgagcgggccctccagtgttgtccaaggaaatgtagaatcactttgtagatatggagatgaagaagacaaatctttattataatattgatcagttttatgccgcattgttcgtggcagtagaccacatctgttcgtctgcacagctgtgaggcgatgctgttccatctgcacatgaaggacccccatacagcctgtctcccacccctgacaacccgagagggcatatggggccctgccaacaccacttcctcagcagaaacccgtcatgacgcggctgcttcggaagcagacatctggggacacagcctcagtacccagtcttttccctagttcctgaaactttcctaggaccttaagagaatagtaggaggtcctatagcattcccagtgtcactagaattttgaagacaggaaagtggaggttagtctgtggcctttttttcatttagccattgcacagtcagctgcagaagtcctgctgaccacctagtcatggacaaaggcccaggaccagtgacaccctgcgtccctgtgtgcattaagttcattctgggtcgcagccatgaagtgtcaccagtatctactactgtgaagtcagctgtgctgttttccattcgcttccacggcttctgcctcctgccataaaaccagcgagtgtcgtggtgcaggcaggccctgtggcctgctgggctgagggaagtcagagccccagggcgccacgaagcagccactgggataccccaccccgccccgccctgcccgcccccccccccaccagtcctgcccccgcatggagcccccgtgattagtagcccgtatgatcacgtagacccacccaacacactcctgcacactggccccggcccacggcacagcaatcccctgcgcgtggatttcacctcaccctttgtaccagatgttgagtgaccagctctgtggccctgtgtcgtcagaggcttgtgattaactgtggcggcagacacagcttgtccacagcttgggccaggcttcccctgtcctcccaccggtcggctgcttggcaaggctgttcaggacgtgcacttccccaagtcggcactgagtggcccagcaccgcctagccctgccaccccactgccctcctgggccttctgctggatgggcacctggggggttctggtttttacttttttaatgtaagtctcagtctttgtaattaattattgaattgtgagaacatttttgaacaatttacctgtcaataaagcagaagacggcagttttaaagtt

SEQ ID NO: 12420 - DNA, 512 bp, Homo sapiens
ccatatgatctgccttcgcacccagcagcttggtaccaggagggatgcccaccccttttccgtccgccccaccaggcacggcctttggctccgtccaccccttgcctctctcccgcccctccctccagctcctcaccctcccctcaccggaaggcgggggaagccccactcctagttctgggttcaacttcgcagatcccagcctctggccgcccaggtgacgaccagcgctgcctccagcagtggccagctagacccctcccatgtcccccagtgcgaatgcggcgcaaggctgggctcctagtcctcatgggcggggccggtggcggcatagccaggctgacagcaggtgcaggaaacacctttactgagtaaggccaccctgtccttggcccccggaggagggggaaaggaaggggaggtttgggggctggacgaggaggtggctagcccccagttcgactggggccagagggggtggagagccccaaggtcgacggtcaggcggccgc

SEQ ID NO: 12421 - DNA, 488 bp, Homo sapiens
gaggtggagttctctgctgatccattcagcctgagcagttctcacaccactggctctggggtgctgcttggaccctgtgtctctcttcccagaggggaccctcgggagagcctggccttccccagacaggcctgtggttgttgtctccagttcctgcctgagcctcagtcttagagactcagcccgtcaggatggccctatactctccatcgttctctctgcttggatgatttctcagcttcaccaggctcctcccgcttgctctgaggtggcccgtgccctcgcagctttctgcagaggtgtcactgtactctggcacctgcctgctgatgtagatagcaggggagctgttttctcccttgcgggggtaggagcggtcttagcctcctggtgcgctgtccagggaatgcctgagcacccggctaatgcctggaccaacttctgcatgttcccatgaggaagaccacagggtcggctgcaggtgagca

SEQ ID NO: 12422 - DNA, 5976 bp, Homo sapiens
tttattttattttattttatgattattatactttaagttttagggtacatgtgcacaatgtgcaggtttgttacatatgtatacatgtgccatgttggtgtgctgcacccattaactcgtcatttagcattaggtatatctcctaatgctatccctccccctccctgcaccccacaacagaccccagtgtgtgatgttccccttcctgtgtccatgtgttttccttgttcaattcccacctatgagtgagaacatgcggttttttgtgagaacattttggttttttgtccttgtgatagtttgctgagaatggtggtttccagtttcatccatgtccctacaaaggacatgaactcatcattttttatggctgcatagtattccatggtatatgtgccacattttcttcatccagtctatcgttgttggacattagggttggttccaagtctttgctattgtgaatagtgccacaataaacatacgtgtgcatgtgtctttatagcagcatgatttataatcctttgggtatatacccgtaaggggatggctgggtcaaagggtatttctagttctagatccctgaggaatcgccacactgacttccacaatggttgaactagttttcagtcccaccaacagtgtaaaagtgttcctatttctccacatcctctccagcacctgttgtttcctgactttttaatgatcgccattctaactggtgtgagatggtatctcattatggttttgatttgcatttctctgatggccagtgatgatgagcattttttcatgtgttttttggctgcataaatatcttcttttgagaagtgtctgttcatatcctttgcccactttttgatggggttgtttgtttttttcttgtaaatttgtttgagttcattgtagattctggatattagccctttgtcagatgagtaggttgtgaaaattttcttccattctgtaggttacctgttcactctgatggtagtttcttttgctgtgcagaaggtctttagtttaattagatcccatttgtcaattttggcttttgttgccattgcttttggtgttttagacatgaagtccttgcccatgcctatgtcctgaatggtattgcctaggttttcttctagggtttttatgattttagatctaacatgtaagtctataatccatcttgaattaatttttgtataaggtgtaaggaagggatccagtttcagctttctacatatggctagccaattttcccagcaccatttattaaatagggaatcctttccccatttcttgtttttgtcaggtttgtcaaagatcagatggttgtagatacgtggcattatttctgagggctctgttctgttccattgatctatatctctgttttggtaccagtaccatgctgttttggttactgtagccttgtagtatagtttgaagtcaggtagcatgatgcctccggctttgttcttttggcttaggattgacttggcaatgcaggctcttttttggttccatatgaactttaaagtagttttttccaattctgtgaagaaagtcattggtagcttgatggggatggcattgaatctataaattaccttgggcaatatggccattttcacaatattgattcttcctacccatgagcatggaatcttcttccatttgtttgtatcctcttttatttcattgagcagtgtggtttgtagttctccttgaagaggtccttcacatcccttgtaagttggattcctaggtattttattctctttgaagcaattgtgaatgggagttcactcgtgatttggctctctgtttgtctgttattggtgtataagaatgcttctgatttttgtacattgattttgtatcctgagactttgctgaagttgcttatcagcttaaggagattttgggctgagacaatggggttttctagatatacaatcaattcatctgcaaacaggtacaatttgacttcctattttcctaactgaataccctttatttccttctcctgcctaattgccctggccagaacttccaacactatgttgaataggaggggtgagagagggcatccctgtcttgtgccagttttcaaagggaatgcttccagtttttgcccattcagtatgatattggctgtgggtttgtcatagatagctcttattattttgagatacgtcccatcaatacctaatttattgatagtttttagcatgaagcattgttgcattttgtcaaaggccttttctgcatctattgagataatcatgtggtttttgtctttggttctgtttatatgctggattatgtttattgatttgcatatgtggaaccagccttgcatcccagggatgaagcctacttgatcatggtggataagctttttgatgtgctgctgaattcggtttgccagtattttattgagattgttgcatcaatgttcatcaaggatattggtctaaaattctcttttttggctgtgtctctgccaggctttggtatgaggatgatgctggcctcataaaatgagttagggaggattccctctttttctattgattggaatagtttcagaaggaatggtaccagctcctccttgtacctctggtagaattcggctgtgaatccatctggtcctggactttttttggttcgtaagctattgattattgccacaatttcagatcctgttattggtctattcagagattcaacttcttcctggtttagtcttgggagggtgtatgtgttaaggaatttatccatttcttctagattttctagtttatttgggtagaggtgttgtagtattctctgatggtagtttgtatttctatgggatcggtggtgatatcccctttatcattttttattgcgtctatttgattcttctctcttttattctttattagtcttgctagcgatctattgattttgttgatcttttcaaaaaaccagttccaggattcattaattttttgaagggttttttgtgtctctatttccttcagttctgctctgattttacttatttcttgccttctgctagcttttgaatgtgtttgctcttgcttttctagttcttttaattgtgatgttagggtgtcaattctggatcttttctgctttctcttgtgggcatttagtgctataaatttccctctacacactgctttgaatgtgtcccagagattctggtatgttgtgtctttgttctcgttggtttcaaagaacatctttatttctgccttcatttcattaggtacccagtagtcatacaggagcaggttgttcagtttccatgtagttgagtggttttgagtgagtttcttagtcctgagttctagtttgattgcactgtggtctgagagacagtttgttataatttctgttcttttacatttgctgaggagtgctttacttccaactatgtggtcaattttggaataggtgtggtgtggtgctgaaaaaaatgtatattctgttgatttggggtggagagctctgtagatgtcaattaggtctgcttggtgcagagctgagttcaattcctgggtagtccttgtttacttttgtctcactgatctatctaatgttgacagtgggatgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgccttttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagcccatttacatttaaagttaatactgttatttgtgaatttggtcctgtcattatgatgttagctggttattttgctcattagttgatgcagtttcttcctagctttgatggtctttacattttggcatgtttttgcagtgggtggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattctgttctttaagaatgttgaatattggcccccactctcttctgtcttgtagagtttctgccgagagatccgctgttaatctgatgggcttccctttgtgggtaacctgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggacgttctcctggataatatcctgcagagtgttttccaacttggttccattctccccgtcattttcaggtacaccaatcagacgtagatttggtcttttcacatagtcccatatttctcggaggctttgttcgtttctttttattcttttttctctaaacttcccttcttgcttcatttcattcatttcgtcttctatcactgagaccctttcttccagttgatcgcatcggctcctgaggcttctgcattcttcacttaattctcgagccttggctttcagctccatcagctcctttaaggacttctctgcgttggttattctagttatccatttgtctaattttttttcaaagtttttaacttctttgccattggtttgaatttcctcctgtagctcagagtagtttgattgtctgaagccttcttctctcaactcgtcaaagtcattgtctgtccagctttgttctgttgctggtgaggagctgcgttcctttggaggaggagaggcactctgctttttagagtttccagtttttctgctctgttttttccccatctttgtggttttatctacttttggtctttgatgatggtgacacacagaagggtttttggtgtggatgtcctttctgtttgttagttttccttctaacagacaggaccctcagctgcaggtctgttggagtttgctagaggtccactccagactctgtttgcctgggtatcagcagcggtggctgcagaacagcggtggctatagaactgcggtgactatagaacagtggatcttggtgaaccacaaatgctgctgcctgatcattcctctggaagttttgtctcagaggagtacccggccgtgtgaggtgtcagtctgcccctactggggggtgcctcccagttaggctgctcgggggtcaaggacccacttgaggaggcagtctgccttttctcagatctccagctacgtgcttggagaaccactactctcttcaaaactgtcagacagggacatttaagtctgcagaggttactgctgtctttttgtttgtctgtgccctgcccccagaggtggagcctgcagagacaggcaggcctccttgagctgtggtgggctccacccaattcgagcttcctggctgctttgtttacctaatcaagcctgggcaatggcaggcgcccctcccccagcctcgctgctgccttgcagtttgatctcagactgctgtgctagcaatcagcgagactccatgggcatacgaccctctgagccaggtgtgggatataatctcctggtgtgccattttttaagcccgttggaaaagcgcagtattagggtgggagtgacctgattttccaggtgccgtctgtcacccctttctttgac

SEQ ID NO: 12423 - DNA, 6070 bp, Homo sapiens
tttttttttttcttttatttatttatttattttttcttttttttttttaattatactttaagttttagggtacatgtgcacattgtgcaggttagttacaaatgtatacatgtgccatgctggtgcactgcacccactaactcgtcatctagcattaggtatatctcccgatgctatccctcccccctccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgagttggttccaagtctttgctattgtgaataatgctacaacaaacatacgtgtgcatgtgtctttatagcagcatgatttatagtcctttgggtatatacccagtaatgggatggctgggtcaaatggtatttccagttctagatccctgaggaatcgccacactgacttccacaacggttgaactagtttacagtcccaccaacagtgtaaaagtgttcctatttctccacatcctctccaacacctgttgtttcctgactttttaatgattgccattctaacaggtgtgagatggtatctcattgtggttttgatttgcatttctctgatggccagtgatggtgagcattttttcatgtgttttttggctgcataaatgtcctcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccatgcccatgcctatgtcctgaatggtaatgcctaagttttcttctagggtttttgtggttttaggtctaacgtttaagtctttaatccatcttgaattgatttttgtataaggtgtaaggaagggatccagtttcagctttctacatatggctagccagttttcccagcaccatttattaaatagggaaccctttccccattgcttgtttttgtcaggtttgtcaaagatcagatagttgtagatatgcggcgttatttctgagggctgtgttctgttccattgatctatatctctgttttggtaccagtaccatgctgttttggttactgtagccttgtagtatagtttgaagtcaggtagtgtgatgcctctagctttgttcttttggcttaggattgctttggtgatgtgggctcttttttggttccatatgaactttaaagtggttttttccaattctgtgaagaaagtcattggtagcttgatggggatggcattgaatctgtaaattaccttgggcagtatggccattttcacgatattgattcttcctacccatgagcatggaatgttcttccatttgtttgcatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagtttttaaagggaatgcttccagttttttcccattcagtatgatattggctgtgggtttgtcatagatagctcttattattttgaaatacgtcccatcaatacctaatttattgagagtttttagcatgaagagttgttgaattttgtcaaaggccttttccgcatctattgagataatcatgtggtttttgtctttggctctgtttatatgctggattacatttattgatttgcatatattgaaccagccttgcctcccagggatgaagcccacttgatcatggtggataagctttttgatgtgctgctggattcggtttgccagtattttattgaggatttttgcatcaatgttcatcaaggatattggtctaaaattctctttttttgttgtgtctgtgcctggctttggtatcagaatgatgctggcctcataaaatgagttagggaggattccctctttttctattgattggaatagtttagaaggaatggtaccagttcctccttgtacctctggtagaattcgcctgtgaatccatctggtcctggactttttttggttggtaagctattgattattgccacaatttcagctcctgttattggtctattcagagattcaacttcttcctggtttagtcttgggagagtgtatgtgtccaggaatttatgcatttcttctagattttctagtttatttgcgtagaggtgtttgtagtattccctgatggtagtttgtatttctgtgggattggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtggacatttagtgctataaatttccctctacagactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggtattgagtgagattcttaatcctgagttctagtttgattgcactgtggtctgagagatagtttgttataatttctgttcttttacatttgctgaggatttcttcacttccaactaagtggtcagttttggaataagtgccatgtgatgctgacaaagatatatatgctgttgatttggggtggagagttctttagatgtctattaggtccgcttggtgcagagctgagttcaattcctgggtatccttgctgactttctgtcttgttgatctgtctaatgttgacagtggggtgttaaagtctcccattattaatgtgtgggagtctaagtctctttgtaggtcactcaggacttgctttatgaatcttggtgctcatgtattgggtgcatatatatttaggatagttagctcttcttgttgaattgatccctttaccattatgtaatggccttctttgtctcttttgatctttgttggtttaaagtctgttttatcagagactaggattgcaaccccttccttttttggttttccattggcttggtagatcttcctccatccttttattttgagcctatgtgtgtctctgcatgtgagatgggtttcctgaatacagcacactgttgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtcttgatggtctttatattttggcatgattttgcagtggctggtaccggttgttcctttccatgtttagtgcttccttcaggagctcttgtaaggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatcttcgtggcattctctgtatttcctgaatctgaacgttggcctgccttgctagattggggaagttctcctggataatatcctgcagagtgttttccaacttgattccattctccacatcactttcaggtacaccaatcagacgtagatttggtcttttcacatagtcccatatttcttggaggctttgttcatttctttttattcttttttctctaaacttcccttctcgcttcatttcattcatttcatcttccatcgctgataccctttcttccagttgatcgcatcggctcctgaggcttctgcattcttctcgtagttctcgagccttggttttcagctccatcagctcctttaagcacttctctgtattggttattctagttatacattcttctaaatttttttcaaagttttcaacttctttgcctttggtttgaatgtcctcccgtagctcagagcaatttgatcgtctgaagccttcttctctcagctcgtcaaagtcattctccatccagctttgttccgttgctggtgaggaactgcgttcctttggaggaggagaggtgctctgctttttagagtttccagttcttctgttccgttttttccccatctttgtggttttatctacttttggtctttgatgatggtgatgtacagatgggtttttggtgtggatgtcctttctgtttgttagttttccttttaacagagaggaccctcagctgcaggtctgttggagtacccggccgtgtgaggtgtcagtgtgcccctgctggggggtgcctcccagttaggctgctcggggatcaggggtcagggacccacgtgaggaggcaatctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggctggcctccttgatctgtggtagtctccacccagttggagcttcccggctgctttgtttacctaagcaagcctgggcaatggagggcgcccctcccccagcctcgctgccgccccgcagctccatctcagagtgctgtgctagcaaccagtgagactccgtgggcgcaggaacctccgagccaggtgcgggatacaatctcgcggtgcgccgctttccaagcccgtcggaaaagcgcagtattcgggtgggagtgacccgattttccaggtgccgtccgtcacccctttctttgactcagaaagggaactccctgaccccttgcgcttcccaagtgaggcaatgcctcgtcctgcttcgggtcgcgcacggtgcgcacacccactgacctgcgcccactgtctggcactccctagtgagatgaacccggtacctcagatggaaatgcagaaatcacccgtcttctgcgtcgcttactctgggagctgtagaccggagctgctcctattcggccatcttggctcctcctcctc

SEQ ID NO: 12424 - DNA, 604 bp, Homo sapiens
tttttccatttggttttggtattggttttttatttttatttatttatttttattattattatactgtaagttttagggtacatgtgcacaatgtgcaggtttgttacatatgtatacatgtgccatgttggtgtgctgcacccattaactcgttatttagcattcggtatatctcctaatgctatccctcccccctacacccaccccacatcagtcgccggagtgtgacattccccttcctgtgtccatgtgttctcattgttcaattcccacctatgagtgagaacatgcagtgtttggttttttgtccttgcgatagtttgctgagaatgatggtttccagtttcatccatgtctctacaaaggacatgaactcatcgttttttatggctgcatagtattccgtggtgtatatgtgccacattttcttaatgcagtctatcgttgttggacatttgggttggttccaagtctttgctattgtgaatagtgtcacaataaacatacgtatgcatgtgtctttatagcagcatgatttataatccttcgggtacatacccagtaatgggatggctgggtcaaatggtatttctagttctagatc

SEQ ID NO: 12425 - DNA, 6166 bp, Homo sapiens
ttctttttttaaatttttatttattttttatttatttttatttttttattatactttaagttttagggtacatgtgcacattgtgcagcttagttacatatgtatacatgtgccatgctggtacactgcacccactaactcgtcatctagcattaggtatatctcccaatgctatccctccccccctccccccaccccacagcagtccccagtgtgatattccccttcctgtgtccatgtgttctcattgttcaattcccacctatgagtgagaatatgcagtgtttggttttttgttcttgcgatagtttactgagaatgatgttttccaatttcatccatgtccctacaaaggacatgaactcatcattttttatggctgcatagtattccatggtgtatatgtgccacgttttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatctccacactgacttccacaatggttgaactagtttacagtcccaccaacagtgtaaaagtgttcctatttctccacatcctctccagcacctgttgtttcctgactttttaatgattgccattctaactggtgtgagatggtatgtcattgtggttttgatttgcatttctctgatggccagtgatgatgagcattttttcatgtgtcttttggctgcataaatgtcttcttttgagaagtgtctgttcatgtccttcgcccactttttgatggggttgtttgttttttcttgtacatttgtttgagttcattgtagattctggatattagccctttgtcagatgagtaggttgcgaaaattttctccaattttgcaggttgcctgttcactctgatggtagtttcttttgctgtgcagaagctctttagtttaattagatcccatttgtcaattttggcttttgttgccattgcttttggtgttttacacatgaagtccttgcccatgcctatgtcctgaatggtaatgcctaggttttcttctagggtttttatggttttaggtctaacgtttaagtctttaatccatcttgaattgagttttgtataaggtgtaaggaagggatccagtttcagctttctacatatggctagccagttttcccagcaccatttattaaatagggaatcctttccccattgcttgtttttctcaggttggtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgtccttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcacgatttggctctctgtttgtctgttgttggtgtataagaatgcttgtgatttttgtacattgattttgtatcctgagactttgctgaagttgcttatcagcttaaggagattttgggctgagacaatggggttttctagatatacaattatgtcgtctgcaaacagggacaatttgacttcctcttttcctaattgaataccctttatttccttctcctgcctaattgccctggccagaacttccaacactatgttgaataggagtggtgagagaggccatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggctctgtttatatgctggattagatttattgatttgcgtatattgaagcagccttgcatcccagggatgaagcccacttgatcatggtggataagctttttgatgtgctgctggattccgtttgccagtattttattgaggatttttgcatcaatgttcatcaaggatattggtctaaaattctttttttgttgtgtctctgcctggctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcctctagattttctagtttatttgcatagaggtgtttgtagtattctctgatggtagtttgtatttctgtgggatcggtggtgatatcccctttatcattttttattgcgtctattagattcttctctctttttttctttattagtcttgctagtggtctatcaattttgttgatcctttcaaaaaaccagctcctggattcattaattttttgaaggtcagttctgctctgatcttagttatttcttgccttctgctagcttttgaatgtgtttgctcttgcttttctagttcttttaattgtgatgttagagtgtcaattttggatctttcctgctttctcttgtgggcatttagtgctataaatttccctctacacactgctttgaatgcgtcccagagattctggtatgttgtgcctttgttctcattggtttcaaagaacatctttatttctgccttcattttgttatgtacccagtagtcattcaggagcaggttgttcagtttccatgcagttgagcggttttgagtgagattcttaatcctgagttctagtttgattgcactgtggtctgagagatagtttgttataatttctcttcttttacatttgctgaggagagctttacttccaagtatgtggtcaattttggaataggtgtggtgtggtgctgaaaaaaatgtatattctgttgatttggggtggagagttctgtagatgtctattaggtctgctcggtgcagagctgagttcaattcctgggtatccttgttgactttctgtctcgttgatctgtctaatgttgacaatggggtgttaaaatctcccattattaatgtgtgggagtctaagtctctttgtaggtcactcaggacttgctttatgaatctgggtgctcctgtattgggtgcatatatatgtaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgtatgtgagatgggtttcctgaatatagcacactgatgggtcttgactctttatccaatttgccagtctgtgtcttttaattggagcatttagtccatttacatttaaagttaatattgttatgtgtgaatttgatcctgtcattatgatgttagctgattattttgcttgttagttgatgcagtttcttcctagtcgcgatggtctttacattttggcatgattttgcagcggctggtaccggttgttcctttccatgtttagcgcttccttcaggagctcttttagggcaggcctggtggtgacaaaatcgctcagcatttgcttgtctgtaaagtattttatttctccttcgcttatgaagcttagtttggctggatatgaaattctgggttgaaaattcttttctttaagaatgttgaatatcggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtattttccaacttggttccattctccccatcactttcaggtacaccaatcagacgtagatttggtcttttcacatagtcccaaatttcttggaggctttgctcatttctttttattcttttttctctaaacttcccttctcgcttcatttcattcatttcatcttccatcactgataccctttcttccagttgatcccatcggctcctgaggcttctgcattcttcacgtagttctcgagccttggttttcagctccatcagctcctttaagcacttctctgcattggttattctagttatatattcttctaaatttttttcaaagttttcaacttctttacctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgcattttagagcttccagtttttctgttctgttttttccccatctttgtggttttatctacttttggtctttgatgatggtgatgtacagatgggattttggtgtggatgtcctttctgtttattagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctgcagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttccagcttcccggctgctttgtttacctaatcaagcctgggcaatggcgggctcccctcccccagcctcgctgctgccttgcagtttgatctcagactgctgtgctagcaatcagcgagactccgtgggcgtaggaccctccgagccaggtgtgggatatagtctcgtggtgcgccgttttttaagcccgtcggaaaagcgcagtattcgggtgggagtgacccgattttccaggtgcgtccgtcacccctttctttgactcggaaagggaactccctgaccccttgcgcttcccaagtgaggcaatgcctcgccctgcttcggctcgcgcacggtgcgcgcacccactgacctgcgcccactgtctggcactccctagagagatgaacccggtacctcagatggaaatgcagaaatcaccgtcttctgcgtcgctcacgctgggagctgtagaccagagctgttcctattcggccatcttggctccttattctcattaccttcttgagttgtggctcagacactacaacagagctctgtcacctctttctaaaagctgggaaatggttattgtcaacgccagccccattttggaggcacctggttgcaggggaccacag

SEQ ID NO: 12426 - DNA, 6483 bp, Homo sapiens
tttttttccttttttttttttttttgtatttgcaaattcaaatctttttttttttttattatactttaagttttagggtacatgtgacattgtgcagcttagttacatatgtatacatgtgccatgctggcgctgcacccactaactcgtcatctagcattaggtatatctcccaatgctatccctcccccctccccccaccccaccacagtccccagagtgtgatattccccttcctgtgtccatgtgatctccattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaattgcgacactgacttccacaatggttgaactagtttacagtcccaccaacagtgtaaaagtgttcctatttctccacatcctctccagcacctgttgtttcctgactttttaatgatcgccattctaactggtgtgagatgatatctcatagtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtccattttggcttttgttgccattgcttttggtgttttggacgtgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgtttcggttactgtagccttgtagtatagtttgaagtcaggtagtgtgatgcctccagcttcgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagttggtttgtagttctcctttaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcgtatcagcttaaggagattttgggctgagacaatggggttttctagataaacaatcatgtcgtctgcaaacagggacaatttgacttcctcttttcctaattgaataccttttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacctttattgatttgcgtatattgaaccaagccttgcatcccagggatgaagcccacttgatcatggtggataagctttttgatgtgctgctggattcggtttgccagtattttattgaggatttttgcatcaatgttcatcaaggatattggtctaaaattctctttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaaccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgtgtagaggtttttgtagtattctctgatggtagtttgtatttctgtgggatcggtggtgatatcccctttatcattttttatcgtgtctatttgattctcctctttttctttattagtcttgctagcggtctatcaattttgttgatcctttcaaaaaaccagctcctggattcattgatttttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattattaatcctgagttctagtttgattgcactgtggtcggagagatagtttgttataatttctgttcttttacatttgctgaggagagttttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatgtttaggatagttagctcctcttgttgaattgatccctttaccattatgtaatggccttctttgtctcttttgatctttgttggtttaacgtctgttttatcagagactaggattgcaacccctgcctttttttgttttccatttgcttggtagatcttcctccatccttttattttgagcctgtgtgtgtctctgcacatgagatgggtttcctgaatacagcacactgatgggtcttgactctttatccaacttgccagtctgtgtcttttaattgcagaatttagtccatttacatttaaagttaatactgttatgtgtgaatttgatcctgtcattatgatgttagctggtgattttgctcattagttgatgcagtttcttcctagtcttgatggtctttacattttggcatgattttgcagcggctggtaccggttgttcctttgcatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattacgtgtcttggagttgctcttctcgaggagtatctttgtggcgttctctgtatttcctgaatctgaacgttggcctgccttgctagattggggaagttctcctggataatatcctgcagagtgttttccaacttggttccattctccgcatcactttcaggtacaccaatcagacgtagatttggtcttttcacatagtcccatatttcttggaggctttgctcatttctttttattcgtttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttctttggaggaggagaggcactctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgcagtgtgaggtgtcagtgtgcccctgctgggggtgcctcccagttaggctgctcgggggtcaggggtcagggaccacttgaggaggcagtctgccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaagcaggcctccttgagctgtggtgggctccacccagttcgagcttcccggctgctttgtttacctaagcaagcctgggcaatggcgggctcccctcccccagcctcgctgccgccttgcagtttgatctcagactgctgtgctagcaatcagcgcgattccgtgggcgtaggaccctccgagccaggtgtgggatatagtctcgtggtgcgccgtttcttaagccggtctgaaaagcgcaatattcgggtgggagtgacccgattttccaggtgcgtctgtcacccctttctttgactcagaaagggaactccctgaccccttgcgcttcccaggtgaggcaatgcctcgccctgcttcggctcgcgcacggtgcacgcacccactggcctgcgcccactgtctggcactccctagtgagatgaacccggtatctcagatggaaatgcggaaatcacccgtcttctgcgtcgctcacgctgggagctgtagaccggagctgttcctattcggccatcttggctcccacctcccgaactcatccttttttatggctgcatagtattccatggtgtatatgtgccacattttctttatccagtctatcgttgatggacattttggttggttccaagtctttgctattgtaaatagtgctacagtaaacatatgtgtgcatgtgtctttacagtagaatgatttataatcctttgggtatattcccagtaatgggattgctgggtcaaatggtatttctagttctatatccttgcagaatctcctcactgtcttccacaacggttgaactaacactctcaccaacagtgtaaaagcgtgcctatttctccgcatcctcgccagcatctgttgttgccagactttttaatgatcaccatcccaactggtgtgagatggtatctcattgtggttttgatttgcatttctc

SEQ ID NO: 12427 - DNA, 6483 bp, Homo sapiens; identical to SEQ ID NO: 12426

SEQ ID NO: 12428 - DNA, 49375 bp, Homo sapiens
ttttttttttttttttatactttaagttttagggtacatgtgcacattgtgcaggttagttacatatgtatacgctggtgcgctgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacgtgaactcatcattttttatggctgcatagtattccacggtgtatatgtgccacattttcttaatccagtctatcattgttggacatttgggttggttccaagtctttgctattgtgaataatgccacaataaacatacctgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaaatgttcctgtttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttattttaattagatcccatttgtcaatttttttcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttatttctttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatacttgtgatttttgcacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccttgtcttgtgccagttttcaaagggaatgcttccagtttttgcccattcagtatgatattggctgtgggtttgtcatagatagctcttatcattttgaaatacgtcccatcaatacctaatttattgagagtttttagcatgaaggttgttgaattttgtcaaaggctttttctgcatctattgagatcatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctataattctcttttttcgttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagagtgcatcaacttttgtttgagaaactaaacaattaatgtgtcatttagtttttcttgggtgagtcttgtgatttggtagagagacttggctgtatataaattactgctttttgattatggggatatagttgtaatctctgagcttcagttttctaatctgtgaaatgaaagacctactgatgtgctttctgagccaggcacttttttagatacttgtgcactttatgtcctttgtgttctagaagcaaaaaggctgaactgacagtatattgtgaaagtactttgcttttcaaacagacttgttttagatgaaaaaaaaaaagaaaaaccagtggaaaaggagagcataaagagaaagaggagatgattgagggaggaaggctgagagatattaggatgggacatgatattaaagagataaggctgggcgcagtggctcacgcctataatcccagaactttgggaggccgaggcgggcagatcacctgaggtcaggagttcgagaccagcctgggcaacatggtgaaaccccgtctctactaaaaatacgaaaaattagctgggtgtagtggcaggcacctgtaatcccagctactcaggaggctgagacaggagaattgcttgaacctgggaggcggaggttgcagtgagccgagattgcaccattgcactccagcctgggtgacaagagcaaaattccatctcaaaaaaaaaaaaaaaaaagataagccatagaaagaaagtaaagatcatttccatatctccatgacaggagttatgaatgtgaaaatggtatatatagagacagatgttttgaggtgaaaagagaggtacaaaagtgaggtacatcatgtacctcactttttggctgatcccacatagcctcatttgttaatccaccagatattactggagatagagctgtgaacatggaaacatatggtccctaccttcataaaaagaggagagatggtcactgaacagaaatggcaaagaagaagagatgagtttgtcttaaaaataaggaatgtcaggggtatgaagaattaggagaagaatggagcagccaatgtgaggaaggctcttaggcatcgttaggcggtgtcagagtggtggtgatggtggtggtgatggcagttggccaagaacagctgacagtacaactgcagtgagtatgagtgtcccttagcacagttcctttaacttctcgtgacctcaaggtgggaatggaaaaataacccttgggacagaccaggggttatgctgctcctaatgctacatgtagtagattttggaataatgatccacactagtgaaaattctacggtctatcatggaatatttaaaagccattagttttattatttttatgaatgttaaggagaaaaaaagcaccactaacaggaataaattacactttagtgtttatgttaatttttatcatatctgagttattttgagcacaaattaagtgtacattaaataattcttcttgagctgggtttggaaaaagtcaatgattttaaattgaattcttattaattactatgatagagactaactccttgctagaccagtttcttccttttcctgggcacatagcttgatgacatttcctggcctctcttaaagttgggtggggccatggactgagtcctggcccgtgcatgtgggtgagactgatgtgcaccgcttagatgctcagcctgtgaaaagcagccttgcataagcctccaattacactcttctttctcctgctggctaaatgcagaggaggcctcagaggtacagggattaaagaaggcagcattcctgatttccacatggaaggctgcccgctggaaacccagatgaactctctaagagtacaaagtaaaattctattgggctaggcttctgagataaatagtttgtttgttttagcagctagctagcatttcttcccctgacaaatcaagttagtaatcagatggaaagtcagattacttaatactcatacagttatctagtctgaaatatagcaagcccttcttaaccttgaatttcttttcacaaaaattaagtacatacccatttacttctcaaaacctttccaacaattagaaactgttgaataatgtatatgtggattgcaagtcaccagtactgaagattaatgggaaagtagtgaagagaagagggaggtgaagtatatgaaagcctgggaagagcctttgggatggagccaggggaaagtcagagaacctgaagcaaagtcttcctgggtcttgcacctgtatttctgacaccatagcggggaaatagacagcagagctgcctgagcagtagtgtgccgatgtctgctggaaagaaatttgccagcgaatgcaagttttttaaatcctgggagtgaggacaggggtttgagaaatacccccgggtgccaacctggagttcttttttttttttttgaggcagagtttcgctcttgctgcccaggctggagtgcaatggtgcaatctcgattcactgcaacctctgcctcccgggttcaagcaattcttctgcctcagcctcctgagtagctgggattacaagcatgtgccaccatgccaggctaatttttgtatttttagtagagatgaggtttcaccatgttggctgggctggcctcgaactcctgacctcaggtgatccacctgccttggcctcccaaagtggtgggattacaggcgtgagccaccacgcccagcctggagttctatacctagtgaaaatgttcttccagtaaaagaaaacacaagaacattttccagcaaataaaagctaaaataattctgtaccagaagattcacactgaaaagaatactagcaggaattcctcaggcataatgaaaacgatcccagatggaaaaacagagatgcaggaaagaaagagtaaatgtggataaatccaaatgaatgtacactctacacaatgatagtaatcatgtctcgtgtagtttaaaaatatgttaaactaaaatgcataacaacagtaacacaaaaggctctgggtggggataggtagtgaatggagttaagatgttttaaggttttagcattgcctaggaggtgattaaaatattaatatatgcaatgtagtaataaagaatgcatgttgtaatctgtagagtaactgctaagtaatagtaaaagaatacataataataaagtagaaaatgcagtaacatatttagtaaattcaaaagaaggaaaaacacaaaacaagtgggatcaattaaaatagtaagatggtagatatatatacaaagatatcatgaataccattaaatgtaaatgaactaaagttattacagatttgaaaaaaattaagctgcttctcactggatagaagcacataccaatcatgtactaggtacagtgaaactaagaaaattaggaatctatttatgtgcatttacaatgagattaaaagcaaagtatttgcaaaccacaagtaagtgaaggctccctcctgctcttttgtctttccaaatgaggtttcccaaggtttgaaacttcagtcagcagtgaggagatgggggaatgggaggaaaaaaaaacaaaaaaaggaaaagaattacaactctttaaaaaattgaattctagagcctttgtgaaaggcttgtacttaagaatttgcgtaggagataggtagttaatattttcaagatactgagaaaagaaagttatgagttagcgtatcaattcaattttttttttctccaggaaaaatgctgataaaaaaagaaaatcccataaagtcaactgcaaacatctaaaaacagaactgaatctggtagcatttcacatgggtatataaaaaatatttttttcttctaaagaatgcaaactactctaaaactaggaaggcttttgagtgtaggctctgagactcatggctagagaccatttaggggcaatctttactgcaagtttctcaaacttggacccccatatcccaaagatgaacaagttccataagaagttttaatgttattcatttaaataattttaaacatgtacataaatctcttctggctcatgtagtcaatgtgacctactactgttcccatgggcttctcttcacaatcacattggtgccaaggtcctatgatgtcatggcacagtataagaagaaatgttggacccttgttccaacaaagaaaagctgtgggagaattgttttaccacatggcacattgtagtgatgtagacccacagaatccaatagaaccattaaggcaatagttaattccatactcatattctgagtagatgtattttgcagatcttatgtttggtgtaccgacttcaccacatctatcagtggtaaatgtaataatgaaaggtcagtgaagaattctttgttaaatgtgtactttggggtccacaatgaaaaagattgagccattgaaataatggatctgtggtttaaaatgagttcattgtaaaatggaaacaacaacaacaataatgacaatgatagttcatcattttcaaaaccaaggtgtagctgggctcccttctctatggtccaaatgagagcttgaagacaacggtaggagaaccttgagtaaggaaccatgagtgtttatggctgggattgtttggcttaaggaatccttgacccttgagggaagagcaacatcagctgtgggaaacatcaccagactctttgggtccttaggaaatgaagaagcatgagaccttgctaacatgggagagcaagagaaaaccagggagcagagaataagttcctcctggaagcgcctgctataaaacgtcacagattgctaggcaatatacgtaaagtgagtctctatgagcagcaccaagagaaataacaaacccaaagagccaagcatcagtggagaggaagaactactaaaacaggctctaacacaccagagccatggaatgggactggttgtaatttgaactaacaaaaataataaaggcccttaaggcaattcaagtgtagctcaaaaaaattttctgaaattaaaaacatgagtttcaaacaagcacaacttagtaaatgaattgaaggagaagctgattgctttgagactgacatgctttgcctgtgtctggttgtttattcaaagtatcagttccctttgagtgttatggttggaattgttcatagtttcttcctgaaccccattataacctgaggaattttgttttggaccctttagagtctgagctgactagaggctggcttgtaatctctacaaagctatcatggtctgagggagtgagtgggggctgaaatcacgccaataactctgctccctaagccatgatccccatggtgagctgcatcttcccatagaaaagggtgtgctttcacctcacataaggttgtatgtatggactagcagatgcctggttttcacctcttcccattactgttgttttcggggaaaatggaaatggaaatgtgtagatctcttatggtaacctcaagcattgcctatggcttcccaaaacttatagttttgaaattccaagaagcttataaggcaaagtaattgaaaagagaagcatcagttcatcaaaaagacgtgggagaggcgtcatgatgaataaagtctactttaataattttgtaaaaaaaaatcactgtcccaagatgtttagatgtctaaataattcagaacaggactgaatggcaagtgtcaagacaaagaagccaggatagggagtaggggctatccaaagagtgacttagccaagttttctccaaaattccacatatatgttcagtaaacatttataaagtttcttggtttcaagatgatgaaaacaaagagagtagaagatttagcaaatcattagaacctctgctaaagctaaaaataaaaataagactaagactaagtcatctaatgtggttctttaagctggaccccacaatagacataaacctgtttaaaatgctttttaacttatttaaatcacatttttaataggtacttaggccccaaattaacagcaaaaaaattaaaaataagtcttgcagtaagttttgactaaaagaggcacaacttgatttaaccccaaacaactttgcaattacataatattttccatgaattagcacattaggttaaatgatatgaaacaaaaagagaaaggtgctgatgcctatattgcatttttcaactgtttattttcaggagacatttataggtagcttccagcatgtgtacttgcacatttgttaaagttcatatccttttagagtaattaggaattttcaattagacatacttaaatatcacatatactttaaatattcaatacgaatacttaattatgctttttcttctttttagaccgagtctcactcttactcaggctggagtgcagtggcgtgatctcagctctctgcaacctccacttcccaggttcaagctattctcgtgcctcagcctcctgagtaggtgggactacaggtgtgtggcaccatgcccggctaatttttttgtatttttagtagagactcggtttcaccgtattgtctgggctggtctcaaactcctgatctcaagtgatccacctgccttggcctcccaaagtgctgggattacaggcatgagccaccatgcctgggtcttaattatgcatttttaattggacatactgaaatatgaaatacagattttcatataaatgagaaagggcatctaactctgaaaactgtctctctcataatgttttgttcttccttaatggatgtgctgtatcttgttgagatttcttgttctctgccctgctccatctcacctgggtattcatttcccttgtctgtggtgcaggtggctggttctggaaagcagcacacacaaggtgagtgtgttgcttggtgtgctctccagggactggcatcacagctgaataaagaggtgtgagcctgctccatttggttataccaggccagacccaacacaacttttgttgactttctgcaggtttttgtgaatgattactacaatccttaaatctccacctccagctgaacctactactttcagcactggcaatggcttccttctttatgggagattttggtcatcaaaagtagacttcttcagcctgtgcctcacgacctcacaatacatcttcacaggccctcccttcccttccccttgacttccttcctctctgtggtgctctgagcctttctcacatctttgataactttacctcccacctcaaaaaggactttgtcacttcagctatcttttttctctaacaatttccactaacttatcctctacgtctaaatgagcccaagtatcattagcctgaaaaaagaattataagtttatccctcttttctcactactgtcctctttcttcttgataaggtggttttctggtcaccacaccccattctcccaccctctccctgtttaaccctctggggttgggcttcttcaccactgctttgctgaaagtgctctccagaaggtctccagtagccaactactcatccctcaaaggcttttctatgtcctgggccgtggattcttgcagagatttatgactacaaacaatctctgccttcttgaaactctttcctctcttcatatccgtgactactcagtgcttccctggatctgggccccatgttcactcaatcccctgacttctctggccacactgcacagtgtacaacagctctgaaatcacttaccgtgtccaaatcctggctcagccacttcctatttgggccatgttagaccagtcactttatcctgctgtaccttggtttcctcacctgttaaatggaaagggaatgatatatgccctttgggttttgtgaggattcaatggcatgatgaatgaacacaaagcactttgtgggttgccaggcttataataagagctcagagttggctacaagtattttctccctcttcttgtctctgatatattgtcttccaccacacctacacatagcttcctggactttctctgtgctttcctgccttgctgctcttgctcgcaccattgcccctccatcactcttccatccttccatcttcacctacacctcacctatcgtaatccttctacatcttcttcttcttcttcttcttttttttttgttgttgttgttgagacagggtcttgccctgttaccctggctggagtacagtggtgtgatcactgctcactgtggccgtgaaatactggactcaagcaatcctcccacctcagtctcccaagtagctgggaccataggcatgtgccactaagtctagctaatttttaaaattccttttgtagagatggggtctcactaatgatgcctaggctggtctcaaactcctgggctcaaacaatcctcctgccttggcctccaaaagtgctgggattgctggcatgagccactgcactcggcctctccacttaagaccacacttaaatgccaccttttccatgaagccctctcaggtcactcaagccaaaggtgatttttttctccagtaaagtctcagtctttttgctcatttttctggcatattctgcattgtgttataattgtttaatttgatgatttatctttcttacaagatttaagttccttgatggaaaaaagaacaactagtagcgtttaatagtaggtggccattaatgcaggaatatagtgaaggaactttgggaccatgtgtgctaatccagggaggaaagcattagattagattcagtggaaatgtcattacaaagtatatagatgatcccaagagagtaccgaacagagttgacttagagaattgtgaaacaagattatatgggaaaagcaaaagaatgagcacatggatttttaaatatgtttttaatgattacaaaacactgaggataatatacaggaaactgaaggttataatctcagaaaaactatttgactttaacatacacagtaatggaatgggaagcccaggggatttaggaattaaccaagtacaaaagataagtttatgtgttgagtccatgcttgtttctggaagctcaggaaacaaccaagagagagtttggatttgtctcaataggagaagagaagggaagagagacgctgggacaggtcctgcacacagtcagtcttcactgaatatgaatgtattagtccatttgtgttgctataaaggaatacctggggctggtaatttgtaaacaaaagtttatttggctcatggttctgcaggctgtgtaagaagcatggcgccagcatctgcttcttgtgagggtctcagaccacttctattcatggtggaagacaaaagggagcccctgtgtcacaaagggagagagggagcaagacagaaggcaaggaggtgccaagctcttttcaacaatcagctctcatgaaagctaatagagaactcactaattacatcaaagcatacatgaggactctgcctctatgacccaaacacctcccattaggccccacctgcaatattggggatcacatttcaacacaagatttggaggagacaaatgtccatactatatcaatgagtgtacaaacaagaaatggatttgtcagggtaaaatcttactgacttgaagttaccatatgcaacaagaatagattgatcttgattatttgcctatatggctttaacagggaggatttcactttgctaatatttgtcactgttgctgtttttttctttttttttggagatggagtctcactctgtcgcccaggctggagtgcagtggtgcaatctcggctcactgcaagctccacctccgggttcagaccattctcctgcctcagcctcccgagtagctgggaccacaggcacccgccaccatgcccggctaattttttgtatttttagtagagacagggtttcattgtgttagccaggatggtctcgatctcctgacttcgtgatccacccgccccggcctcccaaagtgctgggattacaggcgtgagccaccgcacccggccgcaagtttacttcttaatgttctctcatctcctggattctgtcaagataccgccatagcttttttcctacttctctggccaccctttctcagcttctcttcttcagtattccattctagcaacttgtcttttctcattttgctgtcggtatccttcctatgtgacccatctgtacccatggtttcaaccctcctccagatactgatacctctgaaatatgcttatgtgttccagacacacacacattcagccttctacctgaaactttcaagtttcacttgacatatgccgaccagatctcagtgtcaaggtcatgaaagacaagtaaatactaaagaactgtcacacattggagaagagtaagaaaaaataacaagtaaatgcaatatgagacctggataaagttctggaacagaaaaagaaaatgaatggaacaatgggtgagatgtcaataaggtctgcagtttagccaatagtattgtgaagctcactggtaaacttgacaatagacagaaattggaggtgctaagtataggcaacttttcgaggagtttcattgcaaagaagagctgactaatggggtgttagctggcaggggaactgagatcaaagaaaggattcttgagatgggaaagataacagcttattagcgtgctgtcaggaatgatccaggaggagaaacaaattgatgatgtaagcatgagacggaagcatctctggagtgacatcctgaaggagctgagaaggaatgagatactgaaggggtcactcttcagagtctttgctttaactccctgctcctccgaggcccaagcttcattgagtgtcagttaagtttaagttcttgaaggaggacaaaacttgccactcttattcagagagtgtcacatctgctcaggcacttaccattctgattttcagttccctctatgtttggtgtctcaggatttcatttctttttctgtggtatcaattatggtcttgaactaatttttaaagcttgtacccatttcatgtttttttatgtgaaaccttttctggctctctcagtgtatggtcttactggaaatgggatctcctagagtgatttttttcaaatgcaaatctgatttaagtaggtcattttcctacttaaatttctgtggtggtttacatttactgtaagaataacatccaagcttcttaagatgacatataaaacctttctttcctgtctgggctcttagctgtccacctctccagccttggtgatcccagtagctcctaggactccccatgccctccaggggctcccctttgcacatggtgctgcctgtggagaatctttctgacactccttatcaccaaacctggattaaatgcctgtctcatgtgcccccacagcctgtgcttagctctggtctagatgttcacacggtgttgtcactgtctgttgaattcctggtttcctctgtagagtcaattcctggttgactcttgatatggttaggctttgtgtccccactcaaatctcatcttgaattataaccccctgtaatccccatgtgtcaagggagagaccaggtggaggtaattggatcatgagggcaatttcccccatgctgtttttgtgatagtcagttctcacaaaatttgatggttttcttttctttttctttttttttttttttgagatggagtttcgctcttgttgcccaggctggagtgcgatggcatgatctcaggtcaccgcaacctccgcctcctgggctcacgcaattcccagcctcagcctcccgagtagctgggatcacaggcatgtgccaccatgcctggctaattttgtatttttagtagagtctgggtttctctacgttggtcaggctggtctcgaactcctgacctcaggtgatctgcctgcctcggcctcccaacgtgctgggattacaggcatgagccaccacccctgacccaaaatgtgatggttttctaagtgtttggtagttcctcctgtattcagacaccctgtgaagaaggtgcctgccttctcttcaccttccaccacaatcgtaagtttcctgtggcctccccagccatacagaactgtgagtcgattaaatctctgtcctttataaattacccagtctcaggaagttctttatagcagtgtgagaacagactaaaacaactctaaaaccccaagtgcttccatatgcttgccttggtacatatttgtgttgagcacaataaggtttatgatataaatcatataaattctcaaaatagatgtaaatcactggagaggaaaacatatcttatttctacaaaaacatattttattgattgctacatcctttaatacatcattgacacaactcagagaaatacagatccttagaagtttagatcttgaaagaatcttagagattacttaatctaccctctttatttcatggataaagaaatgtatcttttttgtatcaatttatgcatctaccagcagtgtacaaaaatgcctattcctgcacacactttctcactagctctgggtattttctgtgttttataacactaataagtgaaagtggacatatttttatatatttcttggcaatttattttcattctttgtgaaatgtctattcatatcttttccccagttttgattgaaatgttgatatttttcatatttatttgtgagtgcattttctgaggatattaactctttgtttttcacatatgttgcaaatgtttctctaggtttgtataactttctttatagtgtcttccttcatctaagttgtcaaacaggtcagttttcctctatggtgtctgaccttgatatcattctaagaatggccttatttactttgattataaaactcttctatatttaatacagtacttaatttttttttacatttcagattttagtccacctaaaaaaggtttaatgatacaagagagtaatctaattttacttttcctcacatttttagctgactgttccaatacgccttctgtaattgttttaaatagtgctgatacaaaatgaaggttctagcatatttttataaagagtgtatatttgggggtctgagaggtctgcgtttgagtaactctgcctctgcctgccttggtgagggttcatggagacagtttaagtacggcattggcacccaggggcattgactagtttcatggtgttgggcaccattatgatttattagtagtaatagtataaatggatgtttttggactctgttctattctgttgatctattcatctatacctgtgtcaggactatactgctttaacttcttgcagtttgagagaatattttaatatgtaatgaaagttaaacaaggaagttaaacaaacagagaaaaacacttgcaatatatatgaaaaacaaagggttaacatctttagttggaaaatatacttacaaatgcaaaatcccctctgtggactttaacactttgtaaataatttttaatcgtgtatgctgtaatgcttttccttactcttctttcccaagtcattagttatacaaacatttaaatatgttttggtattttatgatttagataggattcagaatgcaaccttaattcagaaatttgcaaaagggttacagaaaatggattcaataaagaaaagatgaatggtttaattgtaatttggattagcttgaatttcctcatgaagaagaaattaacttattattttccgttgctactgagaaccaaattaggacatatgtttaaattgcaaaatgagttccagtcagacaaaaacaaagttttttttgttttgttttatttgatctgagtctgactagggaatgaagaatgcttccaaagaaaaacattaaaccctgttttgagattgtgtcttttaatatctggctttccctaccttcaccccatgcttgactcttgtcctgttgaggggaagggaacaaaacccagctgatcgtttgagggacttctatccttgcatgaacgttaacctttaatgcaggctaacctacattttggggactttccacatgtcagaaccaatgtactgccatcctcatcagacagccttgcttaagcacagttttgtacaataatgtccaccaatgaaaaccttcgtttcctttgttttaatcagttcctcttgcattatgtttgaatcatactactgagtcattattttttcacattctgtcttaaaatacggcttttcccccttgtttatttttgcacatatatcatgggatggggagcagcaggaaatgatccttcactgaccattatcatttagtgctctgtggtttcttttgctccatggttgttgtttttttaaattcacattctcactaattttcttaacattcttcccatagtaatacacattactgatgctgctttatgcttgagaaaatggcaaaatgtcactcggtgagctgaaaagggaaataacagagacttacagcactgcagtttccagaaaagttttaatttcctgaaacattgctttcaatcaatatcaatcaatcaaatgttttctcgtggtatactggatgttttgtgagatacagaagaagtatttgtttagttattcatccatcaagtttttattgggagccaactgtgagccatacgacagatgctgagggtatactggacaagaaactagacgaagctttctctctggcagaggaggtaggcatcattgttataagtgctatgaagacaggtatcaaatgaacttatttaatacacatttcttgaccacctcctgctttgcgaaagcactgaagttacataaactgggaagtagatcagcagggttttctgtgaggagtgaccaactataggggctttttgtaaattggactgctctctctcctccaaaagcaaaaataaatatttttccatgtggggatgttatattttttctctttatttggtaatgagctctcaagacaggatgtgggtaaggatagcaagcacctgagaaagaaagtttgagctgcaatatattttattttcctctaccccaattaaataacaatagtcaaacacaatttaaaatttccttctgcctgagactgtcatcctcacctctggaattcctctggaaaatttttacctggttaataataatctctctctctctctttctctctctctctcacacacacacacacacaaacgttattaataataatcactctctctatcacacacacacatacaacacacccacaaacacagcctagctctctcacttggcatcattcttttgccttcatgggaacttaagccaagtttaataagagacttatagtgagttggtgatgtcccaaattctcatgctttcaggagaatggcagccagtaagtgatatcacctgatattcccaggtaacctgggaatgtttcctttgtggtatgttcctgggttggccaagccacagagattgggtaggaaaatgactggttggcatgcaagtacataggcgcactcctgattacgtggaatagagtaggactgtctaactttaaagtgcttgtgaaccacatggggatcttgttaaaatacagattctaattcagtaggttcctggagtaggctccaagattctgcatttcttttctttttcttttcttcttcttcttcttttttttttttttttgagacggtgtctcactctgttgcccaggctggagtgctttggtgcgatcttggctcattgcaacctctgcctcccaggttcaagtgattctcctgcctcaacctcccaagtagctgggattacaggtgcgtgccaccatgcccagctaatttttgtatttttagtagagaccatggtgaccaggctggtctctaactcctggcctcaggtgatccacctgcctcggcctcccaaagtgctggggttacaggtgtgagctactgcacttggccaagatgcagtagctcatgcctgcatcccagcactttgcaccctgcacttctaacataggtgtgcataggtgctctatgcagagaagaatggcctctccctgaccctcttcttcctacttcttccccatcacagaatttgagaactgttggtgggggagtggaattgaacttcttgtctagttgctcctaaaacactggtctacagaatgactacctggtgatttcaccagggagatctttaaaaaatctagattcccagagattctgattcagcagttctgggggaagtcccagtcacctgtattcattcaaagctcccaggccaattgggggagcaaaaaacactttgaaccattaatatctttcttattttataaataaggaaatagggtggttgcatgacctgcccaacctgacctagttgtggtcatcaatactagaacttgggtacccttttccagcccaataccctgctatttccaatctgactacccagggcaattgcttctactaagaaaggaaagcaatttcctacccctgaataagtgattcttaagcataaaataaatgtcaggttcagtgctgtttaatggatccagaacattttcctgtcgttggaagcaaacatgaatagatctaaagtgcaatttgtttccatcctactctaaaaggaagttggatgaagtgtgctatgggaatggaaatgtttcacattttattcctctgggagataatttcataatttaaaaggtctttgttcttgggtgtttttctgataaccaatgaaaatatcaatgctttcagatggcttccatataatcaacaatccttgaattgacatattgtattcctttcttcttgatacttgaagcgttcatatttattttcatttcacttgccatggctcatttattgggctgcctggtctctttgacactgaaactttgcacaagtctgtatcttcgtcttccctcctgagctgtgccaattcatgggctggaactatgatttggatttttcccatggtctgggtaattcctgtttcactgtttttagttctttctttttggaaagaagaaaacctccattaatgttaaataaaagtatctgctggtctagtcccacataaacaagcctattgaaaggctgagaaaggtattatggctttgggaggggtttcctgcagaatctgcatctctaaccccgaacttctctccatttacagggaagatatctcagcccagaagcctctccgcccgcatcctgcagccacactgggctgctctggcaatgagagactctagcccatggacactcttctcataaagagtttcctggtagatgggaaaccttatgaccgtccaggtccattctgcctgcatgcagtaaatcaatctctgtgacacaggttttgcaaaagagaaaagatttgttcacaagggcaccaagcaaggaggcaggagaacagctctcaaattcacctccccaaagataaggcttagggatattaatgggttagggaagtgggatgatctaagccttggggaaatgtgattggtagtaggaaaaactgaagtaacaggttcgttctgcacaagtgtggttggggtttatggcatttcataagacacatgtacagacaatggtggtggtagcatgatctgaggttggagtttttggacctctgacatcagaggcacctcttgggcatacccagttgaagggtcggtggtctctactggtttaaactggacaggagctggctcaggttcctgaacaacaactgaagcgaccactataggtcgcttggtgacctataaatgtgttatctgtaaagtagccagtgaaggttaagtttcagtgttcaggctgggcatggtggctcgtacctgcaatcccagccttttgggaggccatggtgggaggatcgcttgagaccagcctgggcaacatagtgggacctcatctctacaaaaaataatttttgaaaattagctgggcatgatggtgtgcacctgtggtcccagctagtcaggaggctgaggtgggaggattgcttgagtccaggatttcgtgggatcaagctatgatcatcattgcactccagccctggtgacagagttaaaaaaaaaaaaagttttggcatttagcagtgaggccttcagctactgtggccttcagcttcatggaaaagggggaaaaaaatcctaaaaagcaattaaccaaaagcaagcagggcagactcaccttatcaaattaaccccttggttttatgtttgatttgttctcatcctataaatgctacctctactgacagaacaaacaaaggaggaggcttcttgaagtgtattttctttctggagcagtctattaagcaagtagcctgacactaattttctttttcttttttttttgatatggagtttcactcttgttgcccaggctggagtgcaatggcgcaagctcagctcactgcaacctctgcctcgtgggttcaagtgattctcctgcctcagcctcccaagtagctgggattacaggtgtgtgcccacgcccggctaatttttgtatatttagtagagaccgggtttcaccatgttggccaggctgctctcaaactcctgacctcaggtgatccacccgcctcggccttctaaagtgctgggattacatacgtgaggcagtgtgcctggccaagattaattttcatttaaagacatgaccaacatgttgggagcactggctgtcagcaggtgtttctattatacagtggactgagccctggacaagggtgaaagagccaagtgcttggttctactcccctctgcatggtcagatgccctagggagcttcaggattcccaccgttataatggagggaatgccaccctgaccatttcaaatgagaagagatatgtgaaagcccaggataagctgtaaaccttgaaacaaatatatgataggattattagcaccaagataatgttctgcatgttatgggtaataatcaatcttcttcctattagacttttgtaagtggtataaaggatggtgtggcaactgtgtggtttctttggaaattctcctctcagatcttctaccacgggagcattgttaactgagggtctcagtgctgccgtctgaaattcctcacagcattaagcccagcccatgctttctagggccttagtccagccagtcgtaactgtggcaaggatactaagacatgagaaacataggattccgctaaagagtgatttttggctcgaagactcatcagtcatgctgaaattttcctagagctgcacaacagtcgaaggcctccctccctcccttccttccccatctccttcagagacctcaggactcactgtggcctgattgttcttcccacctccttaggctccggctccctccccattttttctcattggtgttgtgctaacaaatctcttgcttatcttaatctccttatagcatctgcttcttagagacccagattaatgcagaccatgaatccatcttcctgtgaatgtgtccagcacctggaattgttagcagtgagcattcccctgaacctggaaccttctttggcacaggcttcttggactaggtcagttctgtggttctactgagttcttcggcacatgaataattcccttgcaagcatcctgctttttgactcagcattctctagccactgactgccaaagagagtcacctgcagggacagaggaagtcacctgcagtcacttgcagagacagagcccagctgcccattccaggacccttggacccactctcgaatgtgctccccagcctctcccttggggccaccacttctctctttactccctcatgcacaaaaaccttcattccacttcctcctccaagtacacagtagcccttaatgtacccttaatagccctctattagaatgaattaggttatcatagaggtttttttttttttttaatgtcagcgatttaaagtaacaaaggtttatgtcctgctcattccatgtctaacatggattggcaggaggggctctgctcatcacagggacttaggatcacagactgggggagacttttctcagtacatgccgtcccaatgaccaagaaagggaagagcaggctggagtttgagtacctgcaattacatgcttccttccagaagtgacacatcaattctgctcacatttcatcagccaaagcaagtcacttgaccatgcctaactgcaagggggtaggggtgtaaaggcaagcaaatggaacacatatgcaaccatcccctcagaaaagatggctccaaaggagtcccagtttttagcacataaatgcttcaccatccctaaaagcctgagagaattaagtttcctgaggactgagaaaaatatttaaatccacacgagggttaagcaaaacatagcaaagggagaagggttaagtttttcacatcctgctgcagagttaacactacaaatgctgggcttggttatgagaacacaaccagcaaagccatggggtttgtgtaagcactgttgatgtcagtaaaacatcacatcccagacttgtatgtggcaataggtcagctcctcgctccctgccttgactgtacctctgcacctgttcaggaatcctggaggagaaacaggaactcaggcagacaagtggtgattcctgccactgtgtcagggtattttttcttgcaaaagtgggccccgactaagcaggacaatatacctatatattgtgaaactgacccttgaaatgcaatgaagtcctattgtcaaaacagccttacaaggacggaaacatcatcttgctcagtccctttgtgaccttcactctcagagaggggtggaaaaggactctcttctctggccttggctaaatggctgtctttctagagcttttctgtttggtccacacttttcctaggatatgggaggtttttaaatgctttggatttaaaataccaaatacagtgtggattgaatttccgttctgttcggtacctcaaacaggccaattcaatagaaaaattaagtcaaaagagtttgttatgttttgtaaggcaaatgaccaacaaatgaactacaatgttcatgtttccagtggctgtacaaaattaatttgcagaaaatgaaaacatgtaaaatagatgaataaagttaaataaaagtctttctgtttaggagataggacagtgtaaactaatttttaaataaagtagtttgaaatagtaaagtaaaattctatttgccttaaaataagacttgtggtcttagacttcaccttttctgggtgaccgctgaggtatagcaccctggtttctctaagcttaaaataattactcaaaaaatattatgtgcagtcctgagccaggctgtattctaggcaccagacagacagccacgggagctacctagtattttggcatgactgacagatgtagtgctctaaaatgtgctgatatgccttttcttggtcactgctcatgaggcaataaccaagtgttctttgctgctctgcaaaacgagaacccagttaggcttctgtgcatggcatggagcagtatgtcctctgggtgctgttttacaggcatacttgccaagttttatgatggaatgatagtttctccttaatagtttttatccaccctggaattacaaagacaaggcccatgtttgcctaaggaaggacaaacaggattgatttcagtctgtcaaagtctgttggtataaaatattgagagaacctttctcaaaaggcatttgtagaagagcattaaatcatcactaacacagtgttttacagagttcagagccctctcattctgtcttagtctagggagagtttggttaaagggtgtaaacaggtgctgaccctggtctgtctaaggatcagaattagagggagatgctttgcttcaacgttatggaaaatgcccttctttacattcatattaagcaaaatttctattagtaatttatagcatgggtcccaattggaatagaatgaagttttcccagaccttccttacaggttgactttttcagtattgggtgaaattattaatcttcccagagaggatcagcatatatagaacttgttttatcaaactagtttgtctccaggtgggactttagtgacactattactaatcatggcctttaatctgctaaaataaaattctagctgattatcgaggcaggcagatcacttgagattgagaccagcctcgccaacatggtgaaaacccctctctattcaaaatacaaaaattagccaggcgtggtggtacctgtaatctcagctgctcaggaggctgaggcaggagaattgcttgaacccaggacatgcaggttgcagtgagccaagatcatgccactgcattccagcctgggtgacagaggaagacttcatcttaaaaaaaaaatccagctgattatcaagcacaaaagtatagatgatgactacaatttacctaacatctacttatatagttatattctcagtactttacaggccttatcttgtttaatttaccaatcaacagatggtgtaattgagaccggactggcatttctcagcctccttcacagctatatctagccatttgaataaattattgtcaatgaaaagtaaacagaagcaatatatagaacttttgagatatctccaaaaaatggaatggtcaagaatcattttcttactcccacaaataatctagtgaagatgctgtttccaaagaaatctatcaagacttccaattaaacatactatatggaacacaaatttatatctgctgtctcccagaactccactataatgatactgaataaattaaacaagcaagtgggagtgaggtaccatatgagatcaggcggatgaagtgaaagactgtatattgaattgcgagattccttcctagtctcctcttcttggctacaaaaaaagttggctgccagatttgtcacctcgagaccccactttcccataatcccaccagccatgagaaaatgactggcctgtaaaaatatattaacttgaaaataatttcgcctagaataaaatgaaaggaaatgagtagatcacaaggcatacatgtatgtaaaaagaaacatagatgactgggcgcagtggctcacacctataatcccagcaatttgggaggcctaggcgggcggattgcctgagctcaggagttcaagaccagcctgggaaacacggtaaaaccccatctctactaaaatacaaaaaattagccgggcgtagtggtgtatgccagtcgtcccagctacttgggaggctgaggcaggagtattgcttgaacccgggaggtggaggttgcagtgagctgagatcgcgccactgcactccagcctgggtgacagagagagactccgtctctaaaaaaaaaaaaaaaaacacaacaacagagaaataagaacttggttgaaacaagtactttagaatcaggaatgagttatatgcctcgtgttaatgagacatgaataattaaaggattcttacattttattatatcaaggacacaatggttaaaaattctaagccaaacgggtgaagttctctgtaagtttggctttctgtttacacatgctctgacccttgaaaatataattatacttactcttaaatatttgcttactaagggcagagaatctccagacaagtaacatctaaatataacaattgtaatttataatcttgagactttgtatactgcagaaaattctatttggtagagacagctgtgtgttcacttgtgttataaactttattcatcatgggaaattgaattttctgtcttgttttgttataattaagccactaattatcaccatacttgttaaaaagttttcaatgtttaccatgtaaatttcccagatatttcctccttgtagttgtataggtgaaatatgagatggagtttataaaatattcatgtctaaaatacaacacaaaatctcatcttgcataggttcaagagaaaagacctataaacactgacacatgttgatcctctgaaataaaagcagcattcccccatgtcaccctccagggaagcagcccctctcctttagacaatctctgcccaagcatatagagattccaatctctctttttttcaatgcctcactcttaaatataaccggtcatccatgggacatccagatatttgagaaaatctttcaacatttaagatagagaacaaaataatcaagaagaaacctcccagagaaagcagagacaatgcaacagaagaacactttagattagaagagcaatgctatctataataaaataatcaagatgttatataaagaggggtgttcagaaatagcaagaaagaggataccatcaactttaaatgggaagtggagcaagaagacttgatggacaataggagagaaaagaacaaattaaagatcaatccagcaggcctaacattagtctaataggcacaaaagtaatagagaacagaaaaaatggagtggaaaaaactgtcagggaaagaatacaagacaattctgcagaactttaggatagaaggtttcaaatttaagagcccactgagtactcagcaacacggctaaaaaaagaccacaccagagcacatcattatgaaattttagatcgctaattataagggttaactttattgtatcagattttgacttcttgacttcaacactgaaaattaggtgcaaatgaagaaatgacttcagcattcagggaaatactgcccaaactattgatcaagaaggtgtgcagaataaaatgtcttagacatccaatttttcaaagactttacctgccatgcaccctttacaagaaggtagtagaggatgtgtctcaaaaacacaaggggttgaaaagcaaaaagaaggcataggatacaagaaagaggtgatctggcacaagaaaacagtaatggaattcccagaatgatggaggaagaacacccagaaatcctctagggcaactatgcctgaaaggagcaagatgacaaaagttgcagggaaaaatgtctcaagaggcaaagaaaggattcacagttgagtcctgctgaagggtttaatgatcattgaattaatgggtacatataaaaaaaaaagaaaatgaaaaaaaacaggcaattaactccaagaaaagtaaagtgctgtacagcaaaggaagtttaaccatagtaactataaatagcacaatgaaaagattttttacttagtcataaaatgccctatttgatataatccaaacctaagccaattcgctttcattataaagtggggtacctgggggagactgttatacaaaataaggcaatgttcctgtaatcctgctggaaataaaactgtttctacttgggatcaagtatgttagaacaggttgctatatacttcctgaagattgtttgcaagacacagaaatccacctgaggatgcttaagtaaaaaaggagtttaagggatatgcacagaatgcaaagcaggaagcaccccaggcctcatgggaatggaaagtcctcagagcacaaccttctccttccttctccttccctttctggtgtctcctatctatgcatatctcctttctcctctcaatgcaaactacttccttgagtcttagtttctgtttagaccctggcttgattgagattctgactttcctgatgctgtcagggagaaaataaagaaaatcaagagaggctctagatactttctgaataacaagtaaagacaagcacaaatttaagttccagaataattcagagaagctgtacagtgtaagttagaaatcacagtgcgagtttgtgtattccatttttaagggagtggcagagactaataagtattcaccattatctactgtctcttcttttgataatcaaacctccacattttagcaaggcacatggctacctagctagagatattcacaggcctcagctggagctggacagatgtggccatgtgacctggttttggtcaatagaatgttagcagaaattatgtgtctacttgcaaggaatatcttgctttccattgcctatattgcttcccacataccagaatccctagctactgtaacttagacttgctaatttttgaagtttatttcttttaaactcataatccacagatttcccctctgtccctttcttttcctgacaatttatctgttgaggaacccaggccctttgacatgtagtttctcacagtctggcttttgcaactgcatgctcacagtgaagcttagcctgttcctctgtcctctggtatttcccttccctggcagctggatttagaggattgatccaactcagattcaaagcccttgataggccacaggtggtactttgttttctcatcagtaatcctaattgagaatgcaaatttattattcaaaattcacaaaattaaataagtataacaaatttaaatacttaagcttttaaagcagaggtccccaacacccaggctgtggacccatctcctgtcagatcagtggcagcattagattctcataggagtgcgacccctattgtgaactgtgcatgtgagggatccaggttgggtgctcctcatgagaatctaatgcctgattatctgagtctgaggtgaaacagtttcatcctgaaaccatccctctatgctccccttccgtggaaaaattgtcttccatgaaactggtccctggtgccaaaaaggttggggactgctgttttaaaggatgtgttttataaattcctaacatttgttttcctgaaattttagaacttaatattgccctaaaacttttgggacactatatttataaagcgatgataaaatacctcctggattcatatggatactttggattcaaattcagcactctagggcttttactctcctcattttggtactactgtatctcctttggtttacattcaaatttcagattcccaaggaaaaaagagaattacaatatcagtgtttaggtattcttaaccataacattaaatatgcgtaataaaaaggacagcagatacacaattttgtgtaatccactctttgatttagagatacaattaatgaaattaatattgtatgggtaaactgttttaagactgtatatatggaaataaattattgtatgccccaatatctttgattcagccttgattaaaattatacttaacatagagtgcaaattgtttttaaacaggaacttgtaggaaacctccaggaagctgttgatacaagtgtctttgagagtcgaaagcattgaaagtgctggattaacagttagcctttatttagatagataaggcagatggtgagtaaatacttccaatatgatttgccataaactgtaacttaaatatataattactctgttttttactgtacgttttcggcttcaccttgtaaccaaacacaggtgcagttgctcaccacttacagagtgcaattaacaagagggagctctggtagaaagaaagtgactattagtggaaaccaggaaaggggaagtgaccggattcctgttcaaagctttgattttagggttgggggaggcaggggtttaaaaaaggaaaacttgataaggaaggcatgcaagaattaggctgagtacaatgtgtgtctggttcaggtggctatcttgggtcccagtccacctggatcgtgggctggagacatctggagacatctcagcaacggccgagttattgattagccagcttgaagtagtctctggaattgtgtcactgagtctccaggcttaggctgtgtgtctgaagattagcccctggaacttctaagaaggcacataattagataccagtacacagttaaataaatgtgaagggagtgtctatgggtgggaaagggagggacgtggagtctattttttttttttttttggtcttgggcttctttttatttttattttattattattatactttaagttttagggtacaggtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcagtgtttggttttttgtccttgcgatagtttactgagaatgatgatttccaatttcttccatgtccctacaaaggacatgaactcatcatttttaatggctgcatagtattccatggtgtatatgtgccacattttcttaatccagtctatcattgttggacatttgggttggttccaagtctttgctattgtgaatagtgccgcaataaacatacctgtgcatgtgtctttatagcagcatgatttataatcctttgggtatatacccagtaatgggatggctgggtcaaatggtatttctagttctagatccctgaggaatcgtcacactgacttccacaatggttgaactagtatacagtcccaccaacagtgtaaaagtgttcctatttctccacatcccctccagcacctgttgtttcctgactttttaatgattgccattctaactggtgtgagatggtatcttattgtggttttgatttgcatttctctgatggccagtgatggtgagcattttttcatgtgttttttggctgcataaatgtcttcttttgagaagtgtctgttcatgtcctttgcccactttttgatggggttgtttgtttttttgttgtaaatttgtttgagttcattgtagattctggatattagccctttgtcagatgagcaggttgagaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagagtttttatggttttaggtctaacgtttaagtctttaatccatcttgaattaatttttgtataaggtgtaaggaagggatccagtttcagctttctacatatggctagccagttttcccatcaccatttattaaatagggaatcctttccccattgcttatttttctcaggtttgtcaaagatcagatagttatagatatgcagcattacttctgagggctctgttctgttccattgatctatatctctgttttggtaccagtaccatgctgttttggttactgtagccttgtagtatagtttgaagtcaggtagcgtgatgcctccagccttgttcttttggcttaggattgacttggcgatgcgggctcttttttggttccatatgaactttaaagtagttttttccaattctgtgaagaaagtcactggtctatttttaggctagggtaaaaggcttctgcagtttgcttcaaggttctatcttgaaacccaagagagaggcaaaaaagatttttaaaaaaggtttgaagctaagctcttgagtttcaattccctgctctcaaattccattccatttctatgaaaagcagctacttcctgctgagaagggtgtagttagggagtattggaatggaatctgttgatcaggagctggaaatattcttgagtccctggattcatagtagggatttgttggagcattatggtgtgaggacctaggatttttggggaaagcgtgtcctgcattcccatataaagtgtacggcagcaataaaatccatagcaaccaaagagagcaatgagcagaaggccaattatactgtgtaggagagtcttcaatgtcttaggaagttgactaaaccatgctgtcacaggctcttgagagagagcatctatagcatatataatatccaatagaaatatgggtatttaaggcctgaatagcttgagttatattgtgagaagaatctggtatctttctatatctatatctatatctatgtctatatctatatctatctatattacacagccttaattaccgcacaagtgttgccctgggccatagttaggatatctaaagccatatgatttaaagacattgtgggattagacatagcactagtttgcctgtatgtcttgtagggctgaggatatgcttttggagttatccaggaaatatgtacagcatttagtcttagttatagttcatggttcccactatcaattgaacccagatttcttgtgtgcatatgacaacaggttggctaaatatacacacttaacaggaggaactatgaatatttacaaagatggtcctgacatatgtgtattgaacaaatatacatgtatgacccatgtttattttgaggtggagaatttacatttaaatatattacttttaggccttatgtatcaaaaggtctttataggacataaagccatgtaagtgtgcactttctgtaaactagcccatggttggtagtctttcattaggggaaagttactgagattagtctcttgtctaattaaagctgtagttatggctggtggcatagaggccaggagtcagtcagttggcttatcttgaagccaggtattgtttggctgctagagaaaaacaaaaatcttgaggcatttgagacatagtttactctttaagtgtaggagtgagtgacttaacccttgcctggcattgccctaggtcctgtttataatttggtattttatctttacaggttctgtttgatcagtcttatgaactgttttaatgttaatgatgatcagttgtgcctaaaatccaaaaagttggggaaggtatagtgaggcgtgtctgactctcccctcttcccatgccctgcttcccatcatgactttaactaattttccagttatttgtggggattgctggctccaagttatttttgtgacaaaattggaatctgttcccatggctaaactttgccctgataggtaatccaaggaaagctgtgaaccaaaatttggggtaaagcagtctctatggcagtttttttccttcagtttctaatgagttttcaatgtttatattctagttacaccataaataacgagttttatctcagcaccagcagcttagtaacagcagatttaaagcaggcagaaaagaagagaagatagagacctttcgaagactctacttaactctgtagtgcaggttaaccatttgagctctacatttttcttgttgtaatttgcccatcagtttaaaatgtgcacataaatgggccataatatgtaaccagctggaatcccaaagaggatgacaaaatcaggggccagaatgttggaaactgcttttccgctgccatgctggatccctggattgagtaggaaaagagaaaaagaaaagacaggaatggagagaagaaaggtcaaattttataggagggaaggggaaagagaaaggaaggaggggaggcttgtgagcctcccaaccaccacacggtacggggtcatggagagactcagcacctcagacctacacggtggtatctatatctatatctatatctatatctatatctatatctatatctatatctatatctacatctatctatattacacagccttaattaatgcacaagtgttgccctgggccacagtgaaccaaacggtggggaacaaatccctcccacctctgcaagtcaccagtcaaggtgaagtgtttccaaccagagggagctaaaggtgcttttggccgagaggaataaggctgtaggtggcttctgagataatcaggaggatgatgtttgaacaaggggaaagagagagagagagagagagaaagggatcattcagggcccacatacaaaggacacacattcatgcaccttcaaacaaatcaccagttaagaggctgagtacagtctcaaatcccttgcctcagtttcaagccggcctcccaggtgaataagtctgaactgagcaaagccctaagggtgccaaaaacacaaataaacataaatgcataaagtgctcaaatggtgtcatcagcggccaagtctaaatagagcagagccacagcgacaccctaaaggaggcagagggtggtcgggtgcactccaacagactcacccagttccaagtttccaaaattccaaaatgtgtcgagttctctaaaggttactctctttgcaccagcaaagcattgaaggcagcaggcaccacagcaggaagagaaagaggatcctcgagacaaaagcgtctcggcagctgcagggcaacttcctaacgttccagccaaggggacacagtagccacagtagcccagtagctgtagctcacaggcggcactgtgccctgccggacagaaactagaccggcaggcccaggctctgggagctcacagtgcttcctgtaagagccaccaaattgtaactgaatgcaggtatggatgctcaccacttgcagagtccaattaacaagagcgaggtctagcagaaagtgactttattaatattaactgaaactagtaaatgggaagtgtccagattcctatccaaagcaaccatttcaattttgtgggggaaggtgggggtttaaaaagggaaaacttgataaggaaggcatacaagaattaggctgagtacaatgtcagagtgtcatgttcaggtgactatcttgggtcctgcccacctggatcgtggaccaccatctcaacaatggccaagttgttaattagccgccttgaagtgatctctggaattttgcaggtgggtctccaggcttggcctgtgtgtctcaagattagcccctggaacttctaagaaggcacataattagatactagtatacagttaggtaaatgtgaagggaatatggtgagaaagggagggatgtgtagtctactttaaggctaagagaaaaggcttctgcagtttgcttcaaggttatgtcttgaaaccccaagagaaaggcaaaaaaagttgtaaaatgcattttgaagctaaattatccggttacaatctaagtctatttactcaggagggccaagagcttcccttcaatattgaaagttcgtattagtagttctaaagactgatgagaaataaatgtttgttagcacttgtgttgggatgtgtgctgtagaaaacagggtttattcactcagtttattcactatgtttgccatattagattgttctcagtcaccaaattattatgactaaccagctgatggacttcactgatctgttaaataaaagtaaaagactgcaatgtacaaagtttcagttaaaacgaactctgctttctgatatatacatcacatatcattatgtgatatataatatatatcacaatatatattaactttcagataacagatgcttctgctgtacattaaattttatgttggatatttaagtttggctataaaaagataagtcaaactattttatttgctagtttgctatacagatctatcttgagttgcctggcttagcttccattttaaatatttttacactattttctttttaaaagtatagaattggtggatcaaagaaattgtcttacagatctattatagtatttactactctcggaaaatatgtgtaactctaataataataaaatacaaagagaacatagtggaaaagcttaaaaaggaaataagttggtgaccaatgaaacaatagactgaacaaaacagataaaatgagaaagtttcaatggcaaaaatgtttaaaccaataagataaaaatgaaagtgaaagctgtcacaggtatgaaattcactatttcagtttacccgtgcacaaagatcgagggctcattatagcattataactggactccatttaggcgttgctaatggtaggaaacttaggcttgctaatttgatacaatgcagtccctttaggtttaaaaatacttttatctaattgctctgttcatttggcaactctcctatttcctcttttcctttccttctccttgggggaggcctgaggttcctgggaagtgttctgacactgggggaggaatgcccgtgcaggggctggcctctgcccctgcacctctctcttgagcttggccatgcactgtgtcgaccctgctcccttgctgacatcttcagctccacatggcttatagtcagctggtccaccgatgttgcttcccctttgtcccagtcatagacccttttcatctgcaggcttccctgtgtcctttgtcagagcaaaggatgattccagaggctgtcctgtgccacctggctggtgtgggcctctgtggggctgctgtccggttcacttgcctggacaacacactcagcagtgctggggtattgctgaatcagactgtacttggagcttctgtggggccttttcttcatttcctcaaggccacagctggcaagggaggcacaaagtttctctgctctgcaggccccccaaactcatcagaaagctccatcaaccccacaactttggggttcaacctgaagaggagagtccgggtgctggactcttctcataaactgtgcctctcagctcacatcctttttgcatccccttttccagccattggttgaattcttatcttttttgtcgggggtggggggggaaacagctttgatattaccatgcatctctcgctggagtgacataaatgacattctctggggcctctgggctctcaaaattaaaacataaacaagagacttgcggttcttgacaagtaggaggctagcaagggccgctggcctcctcctccagacctatccctggggggcccagaaaaaggcagaagtgtatggagctataaataagtaaataaataaagggcactttgggaggctgaggcagatggatcacttgaggtcaggagttcgagaccagcctaactaacaaggtgaaaccctgtctctactaaaaatacaaaaattagccgggtgtggtagtgcatgcctatagtcctagttactcaagaggctgaggcaggagaatcttgaacccaggagacagaggttgcagtgagccaagatctcaccactgcattccatgcactccagcctgggccacagagcgagactccatctcaaaaaaaaaaaaaaaaaaaagaaaaaaaaaaaaagaaaagaaacaatggaaaggggaaatttgagcaagaccctatagctgaaagaggaatgtagagcctgatatgctggggggccaggactgacagcctgataagaaacaggcagatacccatggaatataaaaagctcaatttttgccaaactaataaataacattaataccataaaccttgaattaataaatattgatacaataaaaaacattttctgtggaatttaataatctgactcaaactcacatgacagatcaaagggccaaaaagagccaggagtaatgttaaagttgaaaaagcaaggagacatgccatattagataacagaattgaaaataaagttaagtaattcaacagtgtggtgtaagtgcagggctagacaaatggaataatgggacagagtagagagtccaggaacaggcttatgcacataagaaaacatgctccagaaatggaagaaggccaggtacggtgcctcacggctgtaatctcaacactttgggaggccgaagggagaagattgcttaagcccaggaggttgagaccagcctgggcaacatggaaaaaccctgtctctacaaaaaaataccacaattagccaggcatggcatcatgccatggcatatgtctgtgataccagttactcaagaggctgaggtggaaagatcgcttgagcctggaaggtcaaggctgcagtgaaccatgataatgccactgcactccagcctgggtgatagagtgagaccctgtcttggttaaaaaaaaaaaaaaaaaaaagaaaaaagaaataaatgagatagcaatacagatcagtgaggggagagtggaatattgataaatagaaaaatgatgaaccacaaggagaaaaagtaaaactagagttccacatcttaccatgcacaaaaattgacctacatgaattggaaattgatgcccaaaacaaaatctttttcctttttttttttttttttgagttggagtctccctctaccacctggctagagtacagtggcacggtctccgctcactgcaacctccacctcctgggttcaagcaattcttttgactcagcctcctgagtagctggaactacaagtgcacgccaccacacccggctaatttttgtattttttaatagagatgtggcttcaccatgttgaccaggctggtctggaacccctgacctcaggtgatctgcccgccttggactcccaaagtgctgcgattacaggcatgagccaccgcacctggccttcttctttctttttctttttcttttcttttttttgagagagggtcttaggccgggcacggtggctcatgcctgtaatcccagcactttgggaggccgaggcgggcagatcacctgaggtcaggagttcgtgaccagcctggctaacatggtgaaacctcgtctctgctaaaaatacaaaaattagccaggcgtcgtggtgggtgcctgtaatcctagctacttgggaggctgaggcaggagtcgcttgaacccaggaggtggaggttgcagtgagccgagactgtgccactacactccggcctgggaaacaagagtgaaactcagtctcaaaaaaaaaaaaaaaaaaaaaaaaagaaacggaaaagagagagcatcttgagctattgccctggctgaaatgaagtgatacaatcatagctcactgtagccttgaactcctggctccagggatcctcctgcctctgccttctgccttccaagtagctgggactacaggtaggtaccaccacatctggctagttttttatttttatttttgtagagacaggggtctcactatattggccaggcttggtcttgaacttcccaaagtgcagggattggaggcataagccactgtgccctgcccttcaactgatacaagggacatttaaaagaatttatgttagagcatgaaaatatgttttttaaaaaaacaaaataagcccgaaccataaacaaaatattggtaaatttgactacattaaaaaaagttctgtattataaaagataggatgggggacatgataaaccacagactggaagaaggtgtttacaatgtaggtgatggacaaaggattagtatttaatatgtgcagcattcctaaaaagaaacagaaccaagttgcaaaggatatggataggcaattcatggaggaataagagcttaaactcaagaataattgctatggtttgaatgtgtcccctccaaaattcaggcattgaaacttacaatgtgatggtattaagaagtggggcctttaagaggtgataaggtgattagtgtgcctctccttatgaatggaattagggacccttacacaaggccttgatggacttgcccttctgtcttccaccatgtgaggacacagtgttcctccgctccggaggatgtagcaacaaggtgccacgctgggagcagagaatgttcctcagcaggcagtcacacctgctggcaccttggtcttgcactttccagcctctagaactacaagaaaataaattttggttctttataaatgactcactcttaaatattagcagcacaaacaaaggcagaaataaaaaaatgcaaaaaaaaaaaacccacagtgaggtaaaactatcatattggtaaaagtttaagtctgaaaaccccagtgataggtccttatgaatcaacactgttggggcaggagtgggtgtggggggttgcaaattagaataatcacttagaacaatttggaaaaatttcgtcaagttgagaatgtggatttcctctgatgctgcaatttcacttcaaggtgtacactcccagaaattcttgtacaggtgcacagggagccatatacaggatgctcactgcagcattcaacatttgtaatgctgaatacctggaaatcacattgatgtccataaggacgcataaattaattgtgatgtcttcatactaatttattgatcatgtgatcttgagcttaaaccccaaatttttcttcacttgatgatgaggatcacagtagtacctatctgataaaaagattttttgaggataacatgattaaatactagaacagtgtacaatactttaaaatgcctagaacagtgtcaagcacaaaataaaatccattaacagtggtaacgacagcaacaggagcaatagtagaagtagtatacgacagtacgatgaatatatcaacatggctgaattgtacaaaatgtgaaagagaagaagaaagttgcaggagaatatatacagtataatactatttgtgtgaagtttaaaaccatcaatgcagtaccatataatgtctatggaaacatacgtatattacagaattgtagaaatatgcatgggaatgatgaacaccaatttctggataatataaatccatctaaaatggattttgacgatggagacggggaaataggatctaagagggtaacggaggcttcagtagtatctatcatattttatttttaagcttgattttgtatgatatttgccatctatattattgtatgcctgaaaacaataaattttaaagatattactttggctgggaacatactttgtgtttttcatctaccccttatctatgccctcattacacattggctgctccaaaaatgattaaatctaggaggccttcatttaaaatgtccaaagcaaacaaacaatctcatttcaaaaactcatagaaaaatacttccattttggttttttctggcacagaaataagtttcttgagaaagtggggctgtgctgtgtgttttgtttattgtctagcataggacgggaattaaaaatacattcacaaattagttggtgattcacttctttggaatttaaaaataaatttcccacaaaattataataattactatcttttgagacaggatcttactctgttgcccaggctggagagcagtggcactgacatggctcactgcagcttcaaattcctgggctcaagagattctcccacctcagcctcccaagtaactgtgatcacaggcatatgccaccacacttggctaattttaaatttttttgtagagaaggagtctctctgtgttacccagactggtcttgaactcctgggctcaagtgattctcctaccttgtcctcccaaagtgctaggactatagatgtgagccaccatgtccagtccatgaataatttaaagagagtgactaatttctcaccctaactcataaaatcctatttaatccatgttgttctttaaattgcaggcaattgtaacaaatgcagaaaaactttttttttttttggcttggtactattgtggtaacatcagtctcaacacaggcatactttcattgaaaaaggaaaattctaaattagctggtgttttaaatttccctgtctttcatagtatttaataacctctgtttacaaatacacaattcatcttaattccaaatataccataattacatttttctaaaatggatttttttcagtgttggaaattcttaattgaaagcccgcacccctaactgatttgtgggagctctaaagagaagtatcaggaaagctctaccccagctcagtcctactttcttggttactacctggttcccactcactttcagggccagaagctgtctggtgagagaaaggtggacacccctacctgggtaaataaaagttaggggtggagtggggactgggcagaagtgacagagatggcacaagtaaggagaaaaacaggatttcatcaagaagatccaggtggaagccaggaaatgacaggctctcaggaaaaagtagcatggaacaaagtcaagagtgaacaggaaagaaatgaagatccaaaagcaggaagaatttaagttgttcaaaaccaaggctattgatttgggctggagtttctgcttaggtgggacctgtgtggctgagctgggggcaagagcttaaaggagttacagacaggacacctgggaggaatttcctttgaacaaaccaaatcccttgtctatctgaaaactgaaatccatttcttctccctcttttcttccttttccatattctccctccttctttctttcctccttcttctttcatttggaaaaaaatttatgtatgttccaccatccagaatgaaaaaatgttattccattacatttgcttcaaatacttttaataaaaaataaagtattaaaaacagatttgtaccccttctcagtcccgtacatctccttccctcccaagcacatccactatcatgaatttcgtgtgtgttcttctagttcgtgctttttctttcctttggtaatttgactatacatctatctgcctattgttaaagaaaaaaatattaaatgatacttgttaaagcatggtaaggaagactttattcaggaccatcatgacatgcattgggaccacagcaatgggattttgcagtggggaagagagattgggctcaactttgaattcagcatgggcaagtgggaatttatagccaaggggcagagtggggatcagtggatggaaaactactaagagaaaacgtcaggggtaagggggtttcctgtctaaagtgacctaataggattcttgctgaagatgggccagagtgatcagacgccacctgggagatagtggaggatgaactcggtcagatattgagcatggttagatatcaagggtgggcattcttgctaaactgacttagcaaggttctttgctaaaactgaattttgtaaagaggtgcacagatgggcttatgaaaaggttcaggagactgaataaaggttggccaaagaatcttttttaccataaacactataatatactgttttgtgtgtctcaaagatagatgtaaatatattataccttgcatattgttcaacaatttgcctttgtcatggaacatactttttagctctagccatgttgacttatgctgataaaatttgttcctcataagtagtgtagtattccatcatacaacgtgccacattttttttcttttttttttattatactttaagttctagggcccatgtgcacaacgtgcaggtttgttacatatgtatacgtgtgccatgttggtgtgctgcacccattaactcgtcatgtacattaggtatatctcctaatgctatccctcccccctccccccaccccacaacaggccccggtgtgtgatgttccccttcctgtgtccaagtgttctcattgttcaattcccacctatgagtgagaacatgcagtgtttggttttttgtccttgcgatagtttactgagaatgatggtgtccagcttcatccatgtccctataaaggacatgaactcatcattctttatggctgcatagtattccatggtgtatatgtgccacattttcttaatccagtctatctttgttggacatttgggttggttccaagtctttgctattgtgaatagtgctgcaataaacatacgtgtgcatgtgtctttatagcagcatgatttataatcctttgggtatatacccagtaatgggatggctgggtcaaatggtatttctagttctagatccctgaggaatcgccacaccaacttccacaatggttgaactagtttacaatcccaacagtgtaaaagtgttcctatttctccacatcccctccagcacctgttgtttcctgactttttaatgattgccattctaactggtgtgagatggtgtctcattgtggttttgatttgcatttctctgatggccagtgatgatgaccattttttcatgtgtctattggctgcataaatgtcttcttttgagaagtgtctgttcatgtcctttgcccacttgttgatggggttgtttgtgtttttcttgtaaatttgtttgagttctttgtagattctggatattagccctttgtcagatgagtagattgcaaaaattttctcccattctgtaggttgcccgttcactctgatggtagtttcttttgctgggcagaagctctttagtttaattagatcccatttgtcaattttggctttcgttgccattgcttttggtgttttagacatgaactccttgcccatgcctatgtcctgaaaggtattgcctaggttttcttccagggtttttatggtttcaggtctaaaatttaagtctttaatccatcttgaattaatttttgtataaggtgtaaggaagggatccagtttcagctttctacatgtggctaaccagttttcccagcaccatttgttaaatagggaatcctttccccatttcttgtttttctcagatttgtcaaagatcagatggttgtagatatgtggcattatttctgagggctctgttgtgttctattggtctatatctctgttttggtaccagtaccatgctgttttgggtacagtagccttgtagtatagtttgaagtcaggtagcgtgatgcctccagctttgttcctttggctcaggattgacttggcaatgtgggctcttttttgcttccatatgaactttaaagtagttttttccaactctgtgaagaaagtcattggtagcttgatggggatggcattgaatctataaattaccttgggcagtatggccattttcatgatattgattcttcctacccatgagcatggactgttcttccatttttttgtatcctctttgatttcgttgggcaatggtttgtagttctccttgaagaggtccttcacatcccttgtaagttggattcctaggtattttattctctttgaagcaattgtgaatgggagttcactcatgatttgactctctgtttgtttgttattggtgtatgagaatgcttgtgatttttgcatagtgattttggatctgagactttgctgaagttgcttatcagcttaaggagattttgtgctgagatgatggggttttctagatatacaatcatgtcatctgcaaacaaggacaatttgacttcctcttttcctaatagaataccctttatttctttctcctgcctgattgccctggctagaacttccaacactgcattgaataggagtggtgagagagggcatccctgtcttgtgccagttttcaaagggaatgtttccagtttttgcccattcagtatgacattggctgtgggtttgtcataagtagctcttattattttgagatatatcccatcaatactgaatttattgagagtttttagcatgaaggggtgttgaattttgtcaaaggccttttctgcatctattgagacgatcatgtggtttttgtcgttggttctatttatatgctagattacatttattgatttgcatatgtcgaaccagtcttgcatcccagggatgaagcccacttgatcatggttgataagctttttgatatgctgctggattcggtttgccagtattttattgaggatttttgcatggatgttcatcaaggatattggtctaaaactctctttttttttgttgtgtctctgccaggctttgatatcaggatgatgctggcctcataaaatgagttagggaggagttcctcttttcctattgattggaatagtttcagaaggaatggtaccagctcctccttgtacttctggtagaattgggctgttaatctgtctggtcctggactttttttggttggtaagctattaattattgcctcaatttcacagcctgttattggtctattcagagattcaacttcttcctcgttttgtcttgggagggtgtgtgtgtccaggaatttatccatttcttctagattttccagtttatttgcatagaggtgtttatagtattctctgatggtagtttgtatttctgtgggatcggtggtgatatcccctttatcattttttattgcatctatttgattcctctctcttttattctttattagtcttcttagtggtctatcaattttgttgatcttttcaaaaaaccagctcctggattcattgattttttgaagggtttttttgtgtctctatctccttcagttctgctctgatcttagttatttcttgccttgtgctagcttttgaatgtgtttgctcttgcctctctagttcttttaatcgtgatgttaggctgtcaattttagatctttgctgctttctcctgtgggcatttagtgctataaatttccctctacactgctttgaatgtgtcccagagattctggtatgttgtgtctttgttctcgttggtttcaaagaacatctttatttctgccttcatttcgttatgtacccagtagtcattcaggagcaggttgttcagtttccgtgtagttgagcggttttgaatgagtttctgaatcctgagttctagtttgattgcactgtggtctgagagacagtttgttataatttctgttcttttacatttgctgagaagtgctttattttcaactatgtggtcaattttggaataagtgcaatgtggtgctgagaagaatgtatattctgttgatttggggtggagagttctgtgtatgtctattaggtctgcttggtgcagagctgagttccattccaggatatccttgttaactttctgtcttgttgatctgtctaatgttgacagtggggtgttaaagtctcccattattattgtgtgggagtctaagtctttttgtaggtctctaaggacttgctttatgaatctgggtgctcctgtattgggtgcatatatatttaggatagttagctcttcttgttgaactgatgcctttaccattatataatggccttctttgtctcttttgatctttgttggtttaaagtctgttttatccgagactaggattgcaacccctgcctttttttgttttccatttgcttggtagatcttcctccatccctttattttgagcctatgtttgtctctgcatgtgagatgggtttcctgaatacagcacactgatgggtcttgactctttatccaatttgccagtctgtgtgttttaattggagcatttagcccatttacatttaaggttaatattgttatgtgtgaatttgatcctgtcattatgatgttagctggttattttgctcattagttgatgcagtttcttcctagcattgacggtctttacaatttggcatgattttgcagtggctggtaccggttgttcctttccatgtttattgcttccttcaggagctcttttagggcaggcctggtggtggcaaaatctctcagcatttgcttgtctgtaaagtattttatttctccttcacttatgaagcttagtttgtctggatatgaaattctgggttgaaaattcttttctttaagaatgttggatattggtccccactctcttctggcttgtagagtttctgctgaaagatcaggtgttggtctgatgggcttccctttgtgagtaacctgacctttctctctggctgcccttaacattttttccttcatttcaactttggtgaatctgacaattatgtgtcttggagttgctcttctcgaggagtatctttgtggcgttctctgtatttcctgaatttgaatgttggcctgccttgctaggttgggaaagttctcctggataatatcctgcagagtgttttccaacttggttccattctccccatcactttcaggtacaccaatcagatgtagatttggtcttttcacatagtcccatatttcttggaggctttgttcatttctttttattcttttttctctaaacttctcttctcacttcatttcattcatttgatcttccatcactgaaaccctttcttccatttgatcgaatcagttactgaagcttgtgcattcgtcacgcagttctcgtgccatggttttcagctccatcaggtcatttaaggacttctctacattggttattctagttagccattcatctaatcttttttcaaggtttttaacttctttgccatgggttcaaacttcctcctttagctcagagaagtttgatcatctgaagccttcttctctcaactcgtcagagtcattctccatccagttttgttcctttgctggcgaggagctgcgttcctttggaggaggagaggcactctgatttttagaattttcagtttttctgctctgttatttccccatctttgtggttttatctacctttggtctttgacgatggtgacatacagatggggttttggtgtggatgtcctttctgtttgttagttttccttctaacagtcaggaccctcagctgcaggtctgttggagtttgctggaggtccactccagatgctgtttggctgggtatcagcagcagaggctgcagaatagcgaatattggtgaacagcaaatgttgctgcctgatcgttctctggaagtttcgtctcagaggggtacccggctgtgtgaggtgtcagtctgcccctactgggggtgcctcccagttaggcaactcgggggtcagggacccactcgaggaggcagtctgtccgttctcagatctcaagctgatcctgctgggagaaccgctactgtcttccaagctgtcaga

SEQ ID NO: 12429 - DNA, 6084 bp, Homo sapiens
ttttttttttttttcaattctgctactagtttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctccaccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtgtatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcgtagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcatctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgggctgctggattcggtttgccagtattttattgaggatttttgcatcaatgttcatcaaggatattggtctaaaattctcttttttggttgtgtctctgcccggctttgatatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcgacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagtggcttgagtgagattggtaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttgggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcatgatgatgttagctggtgattttgctcattagttgatgcagtttcttcctagtctcgatggtctttacattttggcatgattttgcagcggctggtaccggttattcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctcatgggctttcctttgagggtaacccgacctttctctctggctgcccttaacattttttccttcatttcaactttggtgaatctgacaattatgtgtcttggagttgctcttctcaaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtggatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccattgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggtgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctccctcctctgctactcggtatt

SEQ ID NO: 12430 - DNA, 6172 bp, Homo sapiens
gcttctctattttattttattttattattattatactctaagttttagggtacatgtgcacaatgtgcaggttagttacatatctatacatgtgacatgctggtgtgctgcacccattaacttgtcatttagcattaggtatatctcctaatgctatccctccccctccccccaccccacaacagtccccagagtgtgatgttccccttcctgtgtccatgtgttctcagtgttcaattcccacctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgtcggacatttgggttggttccaagtctttgctattgtgaatagtgccccaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgactgccattctaactggtgtgagatggtatctcattatggttttgatttgcatttctctcatggccagtgatggtgagcattttttcatgtgttttttggctgcatacatgtcttcttttgagaagtgtctgttcatgtcctttgcccactttttgatgggattgtttgtttttttcttgtaaatttgtttgagttcattgtagattctggatattagccctttgtcagatgagtaggttgtgaaaattttctcccattttgtaggttgcctcttcactctgatggtagtttcttttgctgtgcagaagctctttagtttaattagatcccatttgtcaattttggcttttgttgccattacttttggtgttttagacatgaagtccttgcccatgcctatgtcctgaatagtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccaatgcttgattttctcaggtttgtcaaagatcagatagttgtagatatgtggcgttatttctgagggctctgttctgttccattgatctatatctctgttttagtaccagtaccatgctgttttggttactgtagccttgtagtatagtttgaagtcaggtagcatgatgcctccagctttgttcttttggcttaggattgacttggcgatgtgggctcttttttggttccatatgaactttaaagtagttttttccaattctgtgaagaaagtcattggtagcttgatggggatggcattgaatctataaattacctggggaagtatggccattttcacaatattgattcttcctacccatgagcatggaatgttcttccatttgtttgtatcctcttttatttccttgagcagtggtttgtagttctccttgaaggggtccttcatgtcccttgtaagttggattcctaggtatttcattctctttgaaggaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagcatgatattggctgtgggtctgtcatagatagctcttattattttgagatacgtcccatcaatacctaatttattgagagttttcagcatgaaggttgttgaattttgtcaaaggccttttctgcatctattgagataatcatgtagtttttgtctttggttctgtttatatgctggattacatttattgatttgcatatattgaaccagccttgcatcccagggatgaagcccacttgatcatggtggacaagctttttgatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattctctctttttctattgattggaatagtttcagaaggaatggtaccagttcttccttgtacctctggtagaattcggctgtgaatccatctggtcctggactctttttggttggtaagctattgattattgccacaatttcagagcttgttattggtctattcagagattcaacttcttcctggtttagtcttggaagggtgtatgtgtcgaggaatttatccatttcttctagattttctagtttatttgcgtagaggtgtttgtagtattctctgatggtagtttgtatttctgtgggatcagtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgatcttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagatcctggtatgtagtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctgttaggtccccttggtgcagagctcagttcaattcctgggtatccttgttgactttctgtctcgttgatctgtctaatgttgacagtggggtgttaaagtctcccattattaatgtgtgggagtctaagtctctttgtaggtcactcaggacttgctttatgattctgggtgctcctgtattgggtgcatatatatttaggatagttagctcttcttgttgaattgatccctttaccattatgtaatggccttctttgtctcttttggtctttgttggtttaaagtctgttttatcagagactaggattgcaacccctgcctttttttgttttccatttgcttggtagatcttcctccatccttttattttgagcctatgtgtgtctctgcacgtgagatgggtttcctgaatgcagcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctggatggtctttacattttggcatgattttgcagtgactggtaccggttgttcctttccatgtttaatgcttccttcaggagctcttttagggcaggcctggtggtgacaaaatctctcagcatttgcttgtctgtaaagtattttatttctccttcacttacgaagcttagtttggctggatatgaaattctgggttgaaaattcttttctttaagaatgttgaatattggtccccactctcttctggcttgtagagtttctgctgagagatcagctgttagtctgatgggcttccctttgtgggtaacccaacctttctctctggctgcccttaacattttttccttcatttcaactttggtgaatctgacaattatgtgtcttggagttgctcttctcaaggagtatctttgtggtgttctctgtatttcctgaatctgaatgttggcctgccttgctagattggggaagttctcctggataatatcctgcagagtgttttccaacttggttccattctccccgtcactttcaggtgcaccaatcagacgtagatttggtcttttcacatagtcccatatttcttggaggctttgtttgtttctttttattcttttttctctaaacttcccttctcacttcatttcattcatttcatcttccatcgctgataccctttcttccagttgatcgcatcagctcctgaggcttctgcattcttcacatagttctcgagccttggctttcagctccatcagctcctttaagcacttctctgtattggttattctagttatacattcgtctaaatttttttcaaagtttttaacttctttgcctttggtttgaatttcctcctgtagctcagagtagtttgatcgtctgaagccttcttctctcaactcgtcaaagtcattctccatccagctttgttccattgcttgtgaggaactgcgttcctttggaggaggagaggctctctgctttttagagtttccagtttttctgctctgttttttccccatctttgtggttttatctacttttggtctttgatgatggtgatgtacagatgggtttttggtgtgcatgtcctttctgtttgttagttttccttctaacagacaggaccctcagctgcaggtctgttggagtttgctagaggtccactccagaccctatttgcctggctatcagcagcagtggctgcagaacagcggattttcgtgaaccgggaatgctgctgtctgatcgttcctctggaagttttgtctcagaggagtacccagccgtgtgaggtgtcagtctgcccctactggggggtgcctcccagttaggctgctcaggggtcaggggtcagggacccacttgaggaggcagtctgcccgttctcagatctccagctgcgtgctgggagaaccactgctctcttcaaagctgttagacagggacatttaagtctgcagaggttactgctgtctttttgtttgtctgtgccctgcccccagaggtggagcctacagaggcaggcagacctccttgagctgtggtgggctccacccagttcgagcttcccggctgctttgtttacctaagcaagcctgggcaatggcgggcgcccctctcccggcctcgctgccgccttgcagtttgatctcagattgctgtgctagcaatcagcgagactgtgtgggcgtaggaccctccgagccaggtgagggatataatctcctggtgggccgttttttaagcgtgtcggaaaagcgcagtattagggtgggagtgacccaatttttcaggtgccgtctgtcacccctttctttgactaggaaagggaactccctgaccccttgcgcttcccaagtaaggcaatgcctcaccctgcttcagctcgcacatggtgcgctgcacccactgtcctgcgcccactgtctggcactccctagtgagatgaacccagtacctcagatggaaatgcagaaatcacccgtcttctgcgtcgctcacgctgggagctgtagaccggagctgttcctattcggctatcttggctgccc

SEQ ID NO: 12431 - DNA, 6065 bp, Homo sapiens
ttgtatttcttttttttttttttttttaattatactttaagttttagggtacatgtgcacattgtgcaggttagttacataatgtatacatgtgccatgctggtgcgctgcaacccctaacttgtcatctagcattaggtatatctcccaatgctacccctcccccctccccccaccccaccacagtccccagagtgtgatattccccttcctgtgaccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgagcattttttcatatattttttggctgcataaatgtcttcttttgagaagtgtctgttcatgtccttcgcccactttttgatgggttttttttttttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacatgtaaatctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgacgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttctatttccttgagcagtggtttgtagttctccttgaagaggtccttcacatcccttgtaagttggattcctaggtatcttattctctttgaagcaattgtgaatgggtgataactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgatttcctcttttcctaattgaataccctttatttccttctcctgcctgattgccctggccagaacttccaacactatgttgaataggagtggtgagagagggcatccctgtgttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggttctgtttatatgctggattacatttattgatttgcatatattgaaccagccttgcatcccagggatgaagcccacttgatcatggtggataagctttttgacgtgctgctggattcggtttgccagtattttattgaggatttttgcttcaatgttcatcaaggttattggtctaaaattctcttttttggttgtgtctctgcctggctttggtatcagaaggatgctggcctcataaaatgagttagggaggattccctctttttctattgattggaatagtttcagaaggaatggtaccagttcctccttctacctctggtagaattcggctgtgaatccatctggtcctggactctttttggttggtaaactattgattattgccacaatttcagcacctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcggtggtgatatcccctttatcattttttattgtgtctatttgattctcctctctttttttctttattagtcttgctagcggtctatcaattttgttgatcctttcaaaaaaccagctcctggattcattgattttttgaagggttttttgtgtctctatttccttcagttctactctgattttagttatttcttgccttctgctagcttttgaatgtgtttgctcttgcttttctagttcttttaattgtgatattagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaacgtatattctgttgatttggggtggagagttctgtagatgtctattaggtctgcttggtgcagagatgagttcaattcctgggtatccttgttgactttctgtctcgttgatctgtctaatgttgacagtggggtgttacagtctcccattattaatgtgtgggagtctaagtctctttgtaggtcactcaggacttgctttatgaatctggatgctcctgtattgggtgcatatatatttaggatagttagctcctcttgttgaattgatccctttaccattatgtaatggctttctttgtctcttttgatctttgttggtttaaagtctgttttatcagagactaggattgtaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagaatttagtccatttacattgaaagttaatattgttatgtgtgaatttgatcctgtcattatgatgttagctggttattttgctcgttagttgatgcagtttcttcctagtctggatggtctttacattttggcatgattttgcagcggctggtaccggttgttcctttccatgtttagcgcttccttcaggagctcttttagggcaggtctggtggtgacaaaatctctcagcatttgcttatctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttcttgaggagtatctttgtggcgttctctgtatttcctgaatctgaacgttggcctgccttgctagattggggaagttctcctggataatatcctgcagagtgttttccaacttggtttcattctccgcatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttcaatgtcctcccgtagctcagagtaatttgatcgtctgaaaccttcttctctcagctcgtcaaagtcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcagtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggtagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggctcccctcccccagcctcgctgccgccttgcagtttgatctcagactgctgtgctagcaatcagcgagattccgtgggcgtaggaccctccgagccaggtgtgggatatagtctcgtggtgcgccgttttttaagccggtctgaaaagcgcagtattcgggtgggagtgacccgattttccaggtgcgtccgtcacccctttctttgactcggaaagggaactccctgaccccttgcgcttcccaggtgaggcaatgcctcgccctgcttcggctcacgcacggtgcgcacacccactggcctgcgcccactgtctggcactccctagtgagatgaaccgggtacctcagatggaaatgcagaaatcacccgtcttctgcgtcgctcacgctgggagctgtagaccggagctgttcctattcggccatcttggctcctccccccatctgcttgtatttc

SEQ ID NO: 12432 - DNA, 42299 bp, Homo sapiens
attttttttttttttaagtctttttctttttttttttctttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtatctgttcatgtccttcgcccactttttgatggggttgtttgtttttttcttgtaaatttgtttgagttcattgtagattctggatattagccctttgtcagatgagtaggttgcaaaaattttctcccattttataggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccaagagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggaggttttgggctgagacgatggggttttctagataaacaatcatgtcgtctgcaaacagggacaatttgacttcctcttttcctaattgaataccctttatttccttctcctgcctgactgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattctgaaatacgtcccatcaatacctaatttattgagagtttttagcatgaagggttgttgaattttgtcaaaggctttttctgcatctattgagataatcatgtggtttttgtctttggctctgtttatatgctggattacatttatttatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtaggattcagctgtgaatccatctggtcctggactctttttggttggtaaactattgattattgccacaatttcagagcttgttattggtctattcagagattcaacttcttcctggtttagtcttgggagagtgtatgtgtcgaggaatgtatccatttcttctagattttctagtttatttgcgtagaggtgtttgtagtattctctcatggtagtttgtatttctgtgggatcggtggtgatatcccctttatcattttttattgtgtctatttgattcttctctctttttttctttattagtcttgctagcggtctatcaattttgttgatactttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcgtttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgttgggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgacctgcttcggctcgcgcacggtgcgcgcacacactggcctgcgcccactgtctggcactccctagtgagaagaacccggtacctcagatggaaatgcagaaatcacccgtcttctgcgtcgctcacgctgggagctgtagaccggagctgttcctattcggccatcttggctcctcccccaagtgttgaattttatcagaagccttttctgcacctattgagatgatcatgtggtttttgtctttagttctgtttatgtgatgaatcacatttattgatttgcatatgttgaaccaaccttgcatcccgtataagtgtacttgatcatggtggattaacttttaatgtgttgctggattcagtttgcaagtattttgttgaggatttttgcatcaatgttcatcaaagatattgacctgaagttttctttttttattgtgtctctgtcatgttttagtatcaaggtgatgctggcctcatagaatgagttaagaggagtccctcctcctcaatttttttggagtagtttctgtaggaatagtacctgctcgtctttgtacatttccactgatcattttactgtctccatagttttgtcttttccaaaatgtcatatagttgcaatcctatagtatgtagccttttcagactgccttatttcgtttagaaatatgcaattaagtttcttctatgtctttttgtggcttaatagctcctttctttgtagcactgaatagtattccattgtatggatgtaccacagtttgtttatccattcacctgttgaaagatctcttggttgcttccaagtctttgcaattacaaataaagctgctctaagcattcgtgtgcaggtttttttgttttgttttgttttgttttgttttgagacagagtcttactctgtcacctaggctggagtgcaatggtgtgatctcggctcactgtagcctccatctcccaggttctagcaattctcatgcctcagcctccccagtagctgggattacaggcacccaccactacgcctggctaattttttctatttttagtagagatggggttttaccatgttggccaggctggtcttgtactcctgacctcaggtgatccatccgcctcgacctcccaaagtgctgggcatgagccacgatgcccagcccctgtgtaggtttttatgtagacataatttgcagcttatttgagtaaataccatggagcacagttcctacactgtatggtaagaatgtatttagttttatgagaaattgccaaactaccttccaaaatggctgtaacattttatattccagagagcagtaaattagagtttctgttgtcttacatcctcaccagcatttggtggtgtcagtgttttagattttcaccattctaattggcatgtagtggtatctcgttgttttagtttgcagttccctaatatgatattgagcatcttttcatatgcatatttgccatctgtttattttctttggtaaagtatctgtttagctcaactctcttttgccttttttttttttaaatactgggtcttgctatgttgccccgactggatttaaattcctgggctcaagtgatcccagtgcctcagcatactgagtagctgggactgcaggcacataccaccatttgttaattgttttctcattgttgacttttaagcattctttttagattttatatttctggggttttgttttgtttttttgagacagagtctcacttccgtcacccaggctggagtgcagtggtataatctcggctcactgcaacctctacctcctgggttcaagcaattctagtgcctcagcctcctgcatagctggaattacaggcgcacgccaccacacccagctaatttttgtatttttagtagatagggtttcgccatgttggccaggctggtcgcaaactcctgacctcaagtgatctgcccgcctcagcctcccaaagtgctgagattacaggcatgagctaccatgcccagccaatttctgttctttatatgtgttttgcaaagatttttttttccccattttgtggcttgctgttttattctcttaacagtgtctttcaaagagcagaagtgtttaaatgttcttaaatatattgggtcaatcttttgtttgtttgttttaagaaatcagtgtattaaatttatatacaaaattgattcttagctatgttttaattttgttagcatcagtcactaataacaaaactgagattgttctacttggtagaatttagagggattttgccctccctctaaatcctatctaaaaacttttataactttcctcttctgttcattatgagatagacctgtgatgactgcctgtgtacttcaaagtcctttctctgagttttcttagttggtcactaaaacaggcaacattctacttggcagagacaaaatgttgatcatttctataatattttgtttggaggttataaatcattgcagcttctcattgacatggcttatttcaggttaggaaccagaacctagggctctcctcccatgaaattctactaaagccagggtgtatcagtaaaaatgtaatcctaccccagtacacatgtaaagtagagaattgcatgcaaagtgccggttttcatatatggaaatacactcttttgcaggtgcacctttgcttctcacttaggaaataagccgaaaaattgacaactgagcttctcttttgagaagatcaagatatttagcaactggagaacagtgtagtgtaatggtaaaagaccaagctcttgggttagaaagacttggattcaagtctcagtgtaaggcacactacgtaacctctataagcctccatgttcacatctgtaaaatggagttaatgcctattatacagggtcatattgatagaattaaatgctctgtataaattaggtgcagaccaaaacagactcttttgatagattaaatgtttatcccctttgtccattcccttatctggaccaatgaaatgagtttgctttccactaaggacatggaaacataccttgaatttcttcatcttgcatgagaattattttcagaatctttctctagccttcactcacaggggaactggccccaggtgcacgttttgagtgctttcccacagtttacctcagctgtactctcctactaataatgccttcctgaaactaggcacttagaatggtcccaggccacagccagacatggcctcccatgtggcttcaggtcagccagagccagtcaatccgatatcctactactcgtaccctcttcttctgtttatgacattatggatccaaatacagataggtgtgcagctacttaaataagtctaactccagtaataccaaaataaccctaaatctgcaacagatgcaaggatgccccctgggggcaattgttaagtgtgatgacagctgggcatcaattaatacatttgtcacctgctcatgagataggatcatgggaggtttggcaaagggacagtctgttgaacactgcacaaaacttagtagcaagaaaaattatttgtgcaggtattcatttttattttactttaatgttctgccttatctagttgcctgttttgagtcacaactttctctgtgcatttagatgaggttaataagatggctggtgagagcagtgcccccttcagccaagattaccaaaaaaaaccttgttcaaatgcccctcagaatttttcctgggaaatatgggccttctcattatgggcttaatgttcataatttattaggtaataactatttaaaataaaactaagtaaagcagaaaatatatacttttctaacatttggagacttgtttgctaaattaaaagacgaagtgccaagactataaattactttcgtatgttgagggtgaatgtttaaattgtacttttttatttttaacagaatgtttactcatgagcttagcatttaaatggttaaaacaaggctttgaagttaacactccattaagatgaatgggggtaattcacacctctgcttgtgctatattatttcagtctggttgcagagaaaacaagacagcagtaggttgatttactgtgtgaaggccctttaaacacccaaggtctggaaatctttggggtgtgtgtgtgtgtgtgtatgcttttccatctagaagcaggatctgaaattcaatacaatctaggtatagaatcgaggtcttgaaaatactaaagattctctgctatccagcaattccatatctggcatttgacgggtagcacgttactggatcaacccaacctctctggctttgtttgctactgtactgtagtgtttcttcctaccacagcattttttaaacttcagcttagtatactggtaaatccatcagtggaaaagcagaaacgaattatccattttccggtgaactttgtatgtgccttcagatgggttatgagctaagcattggtcttcatgtgctcctttttaaaacattttcatctttgcaaaatctcctgttctatatttacctacatataaagcatctacctttaagaactttacaattttttctcatatccctggggtagtgaagtaagcagagatcagttgaaaaagagacatttctttctcaatgtgtcctttaaaccagttctatattgtatttgaaatgtgtattccacccattggtggaagtgctacagccatttgaccctgaaatgattcattttagggcctgggaataaggttatcttaacacaaatgaaatggcaaacactgtataagatgttaatgagtttggaagatctatctttaaggtaaacagatttttctcttctctcttctctgtcctgcatgtttgcaggctcaggttactgggtaatctgtgggtagctaggtgtggagagtacttccactctggctggctgtagtgctgacactgccaatacagtatatacagagagaaaatagatgctagaaacagagggactcaaactgaattaattttaacctgtttttctttttggcatgttaacagctctctgtggctgtgttagaattagccctatgttaaacatactttacttcctgcaaatttttctgcctagattttaggtgtcataatttttgaccttagaacatttcagaatctttttattgtactgagaaatttgttttttaaaaaactcaaatacacaatttattcttctgataatcttcctgtattttttccataaggaggtaggaaaagtaggaaacaaaattttgatggaggatgaataaagatattgtggacatggtttctttattgcaatcagaatcctttctgtttgtcacccttcctaaacaatctgataaatgtgtttattatcacagtaatctgttgtcctgctttgccaagctgtcagtcaggacaagcaattataaggaacaggaagactcatcttggctgatggccaggtgggcaggtgggaataagaggtttattcacctgtggtacaaagtaaatgggtagaaaggaaaattgagttgccagggagaaaaaaaaaacacaaaaacagatggatgaaaagacattgtaatatgggatgctataaagaaaaagacttgcagagaaatgtttctcacttgtttgagtgtacagtcatcccttgggggattggttccaggatctccctcatatatcaaaatccatgcacattcaagtcctgctgcagaaccacatatacaaaatatcaaccctgtgtaaacatgcgcagattttgcatcctgaaaatactatattttttatccgtatttgattgaaaaaagtcaactgttagtgaacccgtgcagttgaaacccatgttgttcaagagtcaactgtgtatatattttatctagtgttcatcagtggacagatacacaacacaagcaaaagggctggctaattcattcagcaaattcttagcacatattatgtcctagaagttgagctagtcccaaggtcatgaaactatgtaagacatacatacatcttgcttgaaaaaagttcagatacaacttttatttttctgactgaacattttcagaccaacttgataagtgaaattgcttaaatgaaaaattatacatgtatttttaatatatacatatgtttttaaaaaaagattttggagtcaaaattacctgtgttcgaatcccagcttctgtctctttctatatctttctaattttggacaagttactattctctgaacttgctgaagactcaatatttgactgggttttctctcaaccagaggaaactctccttcaagtgagattacatatttgggaaaaactcgagtaagccgttaagcattgaatatacgtacacttttattactttactgtccctcaaatcacataacttccaaccatgttgtctcttctgccgtctctgcttcagacatttagtcagcagcctgactagaaaacggtattctagaaatatcctgaccaatgcatttattttcactactgatgtatttttccccggaaaaagtaattcttgtagtttcatagtaaatattatccacatattttgactttacatcagcatttttagcaatgacattacacttttggcttataaagtatgtggtcagaaaagctgcaggccttttttaggtaaattaccctggtttctagaaccctgtacttgtgctgttgatttacattttttaaatatgagggaatatacatgcacacacacacacatatatatatatacacatatgtataggtacacatatacatacatacatatgtatctgttatctatgtgttaaatttcatcctgttagcttcagtgcaccacttaagcagttgagatcttttttttgaatcttgattctagtgcatcagtcaccattcccgcttttgtgacattcttcatcatacttacattttttcatcccattcacagataaaaatgttaaatgagacaagactaaccagagggccctgcagcccaccgctatcagtatttctcttgagttgttattaatctatactttggatgaagttgttaatattcctgtagtgtcatctaacctgcatttcctcacttcccttggaagtgacccccaaatcagtgggtacagcctaaactcctatctgttttctgtatttctagttgcttcagaacatttctgcttgggggctccacaatcacttcaaacttaacatgtccaaatccattcctcactacagttttctcatatctgtcagcagcccctgttttcatccaacatcccaactggctttcttgcttccattcctgctacctacagtccactttcatactgcaaagtagttgtttaaaaattcaaatcagattatattgctaccctgattaatttcctccaagggctttccatctcacttagaatgaaatccatgccatggcctacaaggctcaattttgtctgtacctacttatttctctgatgtcaatgtatctttcattctccagccacactggcctttctgcccctggaacacaccaagcttgttccctcacacttactgttttccctacttagagcataattttcaaagacctttgcaagccgggcttcttatttaagcctcgggtcaactgtcaccccctcagagaggtctgccctgcctgtcttatggtcatgaccgtcttatggcccccaacacatggtagtgcttttaactttaccctgttatacaggtcactgctggaaatcttgtttatgtgttgtctgtgtccactagactgaaagtttcataagaactgggacataactgtcttatttataaccaaatcctcagagcttaggacagtgcctggtactttggagtggcttaatatttgttgaatgaatgcataaaggaatctaacagactgtgtccttctactctttacctctaatctgtcacaatgtcagttcttctttgaaatgcctcctagatttgcttttatgctgacccagcctcctgccagactcctatctaaatctcagccttcatctctttgtgcctgaagtattgcagtgattatcacttcaggctgttctttggcatcacttgggcaactttgcaaaaattaccacatgcaggttccaccccaaccagttaaatccaaatctctgagggttacgacccaggcatcgataaacttcttagagcttcccagatgactccaatgcacaactactggattgccatatctacctgctagcagatgtatgtcttccagcccattttgcctgttactgttctctggtctccttggaatcctgctttcatagtattactctcttgctcaagaacctataatggctcactactacccccattaatcccagataatggctcactgctacccccattaatcccagataatggctcgctactacccccattaatcccagattcccttgcctcatccactaagctatatttgagccctttcttacgtatgttctacaatacccttaaactgttttttctgtctagcacttgatttgccttttattaccctcttctatattgttactcctctccctactcccacttccaggtacatacccagaatgtgacttattttccacctatccaaatgcttctcattcttcaacacccagctcaaatcccacttctgtaaacactttattctccactctagtctaccccttattatctgtatgattattttggtataccattagtaccttgtaagatttttcgtatttttttcataaactacttttgtaattttgtattcagtttttgagtgggtaatgtgcacatggtacagattttaaatttacaaaaataccctcccatccaattctatccccagcatccagttttcctccttggaagcaaccacttttacaactttctgtgttcttcccagtatattctatgcctctcttagagagagagagagagaatacacaaacacaaggagaatacacggatatacacccgcaaatgttggcatacaacatgaaatcctttgcccctttgacttctctttacttaacattatgactttttttagttgtgctaaaacaaaaaataaacaacacctaacatgaaatctgccctcttaacaaacttgtaagtgtacgatatagtgttgttaattatatgcacattgtatagtagatacctaaaactttttcatccggcatgactaaaactctgtgcctaattgaacagcaactccctatttccctgttcctgcagtccctggcaactgccattttactttttgcttctatgagtttgactgctctcgccatcttgtaccaaggaatcatgtagtattttgtccttttgtgactggcttgtttcacttagcatattgtcctcaagtattatgcatattgcagcacatggaagaattttcttcattctttaaggctgaataatattccattgtatgtgtataccacaatttctttatccatgaatctgccaatagacatttaggttgttttcacctcttggctattgtggataatgcagcaacaaacatgggagtgcaaatatctcttccaagattctgttttcaatcattttgtttaaatatccagaagtgagattgctgtatcatatggtagttctattttaaattttttgaagaatctctatactggtttccttaatggttgcactattttatgtttctatcagcagtgcacgagggttccaatttctccatatccttgccagcatttgttttttgttattttgataatgatcatcctaacaggtgtgaggcaatatctcattgtggttttgttttgcatttccctgataagtagtgatgttgagcatcttcatataatgtctggtcgtttgtatgtctttggggaaatttctttcatgtcctttgcccattttaaaatttaatttttttgttactgagttgttgtagttccttctatattttgtatattaaccccttatcagatatgcggtttgcaaatattttctctctccttaagatttttattctgttgattatttcttttgctgtgcagaatctcttctgttggatgttgtcccacttgtctatttttgatttagcattatgttttggagattattttgtatcagtatacacaaaactccctaaatattttaacagctgcatagtattctgttaatgcatagaccataatttaattagctagtttcctatcaatgcatattgagggattttttattttcaaatgttgcaattttatataatgcttcaaatgttatctttgtatacatatgtcatttagcacatatattaatatatctgtagtatatatttctatccatttaactggaattctgggtcaaagggcatgtgcatttttaattttggtaggtattactacattgaccttcattaaagattttattggctgggcacagtggctcatgcctgtaatcacagtactttgggaggctgaggtgagtggatcactcgagcccagaaattcaagaccagcctgggcaacatggcaaatccctctctctacaaaaaatacaaaaattagccaggtgtggtggcgtgtggccatagtccgagctacttgcgaggctgaggtgggaggattacatgatcccagggaggttgaggctgcagtgagttgtgattgctctactgcactgtagcctgggtgacagagtaaaatcctgtctcaaaaaaaaaaaaaggaaaaaagaagatatactgatttatattcacaacaactatgtaggaattaccctttcaattttgtgttgttatttagcttttcacatttaaatactttacctctctgactccgttgtaattaacccaaagacaggaactatgacattacatattagcatctctcacagtagttggtgctcagtaaatatttgttaaatcttgtgtatttagggagttttcccatgagtggcgtttctgatgagtcccatgtgagaattgtcccctttgcatgtttgctgtttccaggaaagggtgtgattgtgtgtgatattcttaggcgagatgcttagtctattttgtgttgctggagcctgggaaatccaatatcaaggtaccaacacgtttggtgtctggtgagggccttgtctccactcccaagatggcctttgaatgttccaccctctggaggggaggaatactgttcctcaaatgacacataagtgaaaagagaaagcccgcttccaaaggcacttttattttattttatttttattatttttatttttaatctttgtgagtacatagtaggtgtatatatttatggagtacatgacatgtttcgatacagacatgcaatgtgaaacagtcacaccatggagaatggggtatccatcccctcaagcatttatcctttgtgttacaaacaatccaattatacttagttatttttaaatgtgcgattaagtaattattgactatagtcatcctgttatgctatcaaatagtaggtcttactcatattttctatttttttgtgctcatttaccattttcaccctgcccctactaccccacaacccttgtcagcctctggtaaccatccttctgctctgtatgtccatgaattcaactgttttgatttttagatcccacagataagtgagaacatttgatgtttgtctttctgtgtctggtttatttcacttaacataatggtctccagttccatccatgttgttgcaaatgaaaagatctcattgtttttatggctgaatagcactccattgtgtatatgttccacattttctttattcattcatctgttgatggacacttaggttacttccaaatcttggctattatgaacagtactgcaacaaacatgggagtgcagatagctcttcagtatacctattttctttcttttgggtatacactcagcagtgggattgctggaccatatggtagctctatttttagttttttgaggaacctccaaactgttctctacagtggttgtactaatttacatcccccccaacagtgcataaaggtcccctttccccttttctccacatcctctccggcatttattattatctgtattttttataaaagccatttttattggggtgagatgatatggcaattttgatttgcatttctctgatgatcagtgatgttgagcaccttttcatatgtctgttagccatttgtttgtcctcttttgagaaatgtctattcaaatattttgcccattttttgattggattattatattttttccaatggagttgtttgagttcctcatatattctgattcttaatcccacttcagatgggtagtttgcagatattttcttctgaaagcacttttattatgatattaaacctactgaggaaggtggagccctcatggcctaatcacctcttaaaggctccatctcccaataccattacattggcaattaaatttcaacgtgagttttggggggaacaaacatttaacccatagcagacaccattcatttatatttttcttccaggatcctgtattatcattaactcagaaaggccaactaatccttggatctattatcaaatttggtttgtttgaataattaagtataaattagctaaatggaaaggctctcctctgtaagttctttaccatctttttatgatgaaaaattttaaacatgaatgcaagttgaaataatatgcccatatacctaccactgaaacttagcatttggtcgtatttattttgtgactcacatataaattatatttatatgtaaatatacagttaactttagaacaacatgggttttctaactgtgtgggtccacttatatggggatttttttctgcctctgccaccccgagaaggcaagaccaacccctcccctgccttcttctcagcctcctcaacatgaagacaatgagaatgaagacctttatgatgatccagtttcacttaatagtaaatatgttttctctttcttatgattttcttaatgacatttttgtttctctagcttactttattgtaagaaaatagtatataatacaaataacatacaaaatgtgtgttaatcaactgttattggtagggcttacagtcaacagtaggctattagcagttaagttttggtgggagagtcaaaaattgtacacagattttcaactgtgtggtgggtgggcacctctgacccccacattgttcaaaggtcaactgtaaatacatttatatttgctgaataatttgcaaagtaagttactgacattccatgaagcagtaagtaaagttgaaaattattttttgtaaaagtcaccatctaccttagctcaggctactataacaaaataccatagattggatggcttaacagaaatttatttctcatagctctggaagctgggaagtccaagaacatggtgctggctagaattattttggtcctggtgagggcctcttcctggcttgcaaatggctgccttcttgtgtcctcacatggtggagaaagagtgatctctgttcctcttcctataaagccactaatcccattatgagggtctcaccctcatcacttaatctaaccctgattatctcccaaagaccccatcttgaaatacttgtgggttagggcctcaatatgaattgaggggttggaggagacacaattctgtccacagaactttctgtgaacaagcctattattccctccctccctacctacctccctccctcccttccttccttccttctctttcttttctttctttcttctttcacaaatgttgtccctttctccaaaaggataagaagctgcttgatgcagctgtcaccagaacttctcttagtaagggaaatatccttaatgtctttttttttttggtggtggtggggaatatcttgataagtcatttaggtatgaacggtgaattcttatacagtggcacagcaatgtgagtttactaaatgcctgtgaattgtatactttaaagagggtcattttatgttatgtgaatttcacctcaatcaaaaaaaatgtgaccctatgaaaatggttggcaagaggagaggaagtgagagagatagctaaaccactctgcataaaagagaaaatgtgaatttgggaactggagaaaagcaaagggaaagaggcagagagtgctaacccagtggtgggagtctagaggaaaagtggctgacgggcattttaagaacagaagcgtttaatattcagttttaatttgcctgtctctgtctcctgaaactaataaagtcagtagacacaaaaataccttgtgtgaacagaattgtgcatgtaaacccttctttagactcacatgggacagaacacatacagccttatgctatccaggtgatccagaaacctcaaaaagtgaaattcaaaggcagagatggccaagaaaaaatgtaagccacttgcttcctcccagagtccgtgggcacatcaggagggttgtgggacgatcctcatatgagggatgtgattgaaccaacttttcctaattctcaaagtgtattgaactttccttgacatctcattggcaatatattgtcatttcattgctttaagggctcattatttactagtcatcaattgtacctgtaggggaatgcctctttttagagacaagagaccagacctccacagaggtagatcttggagattggagcagttctagaatttctaacatttccccttacggtcatcttgctaggttctctgtaacaaagcctggtagttcagaaatcaggctccaagaacgtgccatagatcaacctgtttgtgtgtgtgtgtgtgtgtgtgtgtgtgtgtgtgtgtgtgtgtgtgtgtgtgtgtatgtatttgggatcagagccactcaacttcctttttttttgaaacggagtttcactttttttgcccagactggagtgcaatgctgtgatctcggctcactgtaacctccacctcccaggttcaagcaattctcctgcctcagcctcccaagtagctgggattacaggcatgagccaccacacccagctaattttgtatttttagtagagacgaggtttctccatgttcatcaggctggtcttgaactcccgacctcaggtgatctgcccgtcttggcctcccaaagtgctgggattgcaggcatgagccaccacacccggccttcaactcaacttctacttagatggtggcagtaggaatcagagggagtggggcccctagggaagagcactcccatggaaaaagagtagaaacaaattttataattccctggttttcttacccagttctccaacctgctaaaatctgaaaaagtttcatactttaaatgaatggaagatcattagtctcataaaataatatgacactactgagctggcacttcggtgtatagaccaggttctatgccaagcacattctcatgtaatctgaggtaagcacagttatattccccatttaatagattagaaattaaagtttagagagactgtaaggttaaatgacttgttcaaggttatacatccttaagatgccatcctaagaatagaaactgaagtttgactataaaggctgtgtgcttaattaccatgtaaataaagtgtatccaactgttggagtttttttctacaaaaaggttctgctcatagcagatacatagtcaatattgactgtgttgaaggctgctttattcatttaaaatgtggcacctaaatctgttctgttacatcagccagacagtattttggccggccttgtgtcctcttgagtcatggttcattgccacagcactgttgtttctcctttgttaagtatttcagaggaaattctggacaaaggaaaggtatatgggtcttcaagtagagcagggatgtgttccagtagttgtcaactagactgagaaaacttggatgtcttacgaaacaatgtcagaaatccatttctgtgttctgtgactttctacaaacacaatttttaaaaatccaaatatagcttagaccatcagtagtctaattcagtgtttcccagatttgagatttcttttggaactttagaacgtcaaaatgaatcttgggacattgataagattgcagactttttattttataaattgattaaggatattaaacttgccactttcaatataaaaaattaaggaaggttataacctttgtgaaaaacttgctacatagttatttatctcatcaaagaccagtgaaaactttctcatagaccaacacttggaaactatcagtctaaataaccagtctatattcaaaaattcagtaaagatttcttcacttctaatgctcattgacttcagttatcttataggtggaaagaagtagatacaaaaacagatcttgattacaaaattcgttgatgacctagttgactctttccccagtcattactaatcctaacctttgggagcgaaaaatatctaaataagttctggtttacaaatttgcaaaatttttgtcaacacttcagaattcagaaaaaaacacaggacatttttactatataacttcctaagtttatatgatatatcaaaagtcagtaaggattataccataataatatttacatttcacagggaagcaaaatacttggagcctctccttgtctttgtctaaagatttgtcattcatttgcattcaaataaattctttgctttcattcatccagaatggttctcaatttattagctcatgagactacataaatagacttgtattcatacattttaatttcagtgtaaaatggctttcctcaatttttttttctactcaactctcccaaaagatgtctaatcactcccacactcagttacttaaacatttcataatgttgttacttctatagtaaaacaaaaagtaatttgcttttaataaatcagagagccctactgtagcaatctagaactttattctggcgagagcaaattctcaaattatatttccagcctcatttgtgaatagctgattttccctgtcacaaagcattgttaggtaggtacagtatttttctttagttggtaaactactggaacttacaatccaatggaggtgacctctatacaatacctgggacggtaataccctgaagcgcagggtgtggctattgcatgtgccacatgcacatgaggccatctgtgcgtgcttgttgaaagaatgacatatcttggtgagtaatatgaacattaaaagctctgctggataagctcatagaggtggggttcactgccttctgggtgagtggggaagactttgtgaagaaagcaacaactgaagtaaaattgaaggataaccaaagtagaaatgagaatgaaaggaagatactcctgtttggaaagaaaatactaacaatatgtacaggaaaatacaaggtatactttggagatgacaagtaaaaattttgccaggagcacagatgtaatagcaatttgagaagtaaagctgaagggtaggatcctgatgtagagaatgctggacccaggctgagcttggactttacatcaagtagaagtggtagagaaagattaattgcctctctgcattggactagtgccatcgtcttccaaaagctaaaaagaagcactttaggccttcaagggctagttatctaaaaaccacacttgatttgttcttaagtctcagctcctgggcatatgaggaactttttctggagttttggaaaattcctcatgccctcagatcctattaagacctctggcatctttttttttttaattatttaatttatttatttttattttttattttatttatttatttatttatttattttgagacagggtctcattctgtcgcacaggttggcgtgcagtggtgtgatctcagctcattgcaacctctgcctcccggactcaagcaatcctcccacctcagcctccagagtagctgagactacaggtatgcgccaccatgcccagctaatttttgtactttttgtagagacagggtttcaccatgttgcccaggctagtctcgaactcctgagctcaagcaatccgcccactttggcctcccaaaattctgggattacaggcgtgagccaccgagccaggtcaagacctctggcatcttaagagacttcctatgagttcctgcctccaaacttttttttttttttttttttttgagacagagtctcgctctgtcgcccaggctggagtgcagtggcgggtattggcttactgcaacctctgcctcccgggttcaagcgattctcctgcctccacctcctgagtagctgggattacaggcacacactactacacctagctaatttttctatttttattagaggcggggtttcaccatgttggtcaggctggtctcgaacttctgacctctggtgatctacccacctcagcctcccagagtgctgggattacaggtgtgagccactgtgcccggcctcctgcctccaaacttttgcacaaaccattcatgttgtttttctctttcccctccaaagcgtttcttctccctcaaaacctgtttccacactcaacctcctctagaaggacttacctgactatgacttaatgtaactgctccattactcaggaaacctatgctcaacatcttgatgctacatttaatttctctaaatgataaaatatacaaattcttgtatatttgtatgtctaaccaccctgcgacagcctttaggaaaggttccacatctgccaactcctttgtatcctccatccagaacctgcctcccatccctactttacccatccacctcagagacttcatggtacagtgcagtatacttggtgagtgttgatggtttaagagtgtgccctgaacaacgaaggatttctttgaggctgaaatcctgtgggatccatggaatgggagtttcacctgtctttggcttctgctcctttccccagcatgtgtagagcttctagaacagtccccagcaagagaggatcacttggtacacctctttcttatcctcactgtctccagtctctgctgtaggcctgctagtgatgatcaggatacaggttttaacatggccaagctgttaataacctgagattgggcaccatgaacaataagcattaaaaggcaataacaacaacaacaacataacctgttaattttatgcaggcttaattttttaaagaactatttcttcctaacttgcttttactcttcttcatctactttctcatacctatgactgacaatgataaggacacccacccactatacacacctaattccatccctccaaatttgatttcgtgttctctagagctggcgtgttatgtgacctattgtggggagaggctcagctgagggactctgtgatgccaaatggacaaaggcacacttttttctccaggtcccagcctggtgaaagtcatagcacctgagaatttggagctgactctctcctttggaaattgtgccttccaaaaatatatcttacactgcctgtacctgcatgcaataggttttggttcttaccaactgcagcttcagtctgaacttgagttctaccctcatggatgcaaatcaaaacagctcagaatcaagtctgggaagcaagtcgaagtggtttgatttgcatggggagcttttgtctctgcatgaaggcagccaaattccctaggctccccagccctccggaaatatgctttacaggacccgggggcccaggcccagtcgggtgggtgtgatttgaatgttctctgctacagctgctgcaccgggccctggtcactgctgttggtttcgctccattttactgcctcagaatccccctgtgcatgttagtggttaatacagcagccaggagacgccagacagctctcggcacctggttcaaatttaaggctcatttacacatgatgtcacacacgcattgtcagcgcgagggaggtcaggatggttcattttgggaaggttcacattgttgagtctttacaacactcactgctattaatgctttaaccatctgacttggatttcggttttctggcatgaggtaatcccaggcactagatttatatgctgaatgggaagccagcaatggtggctaatcatgctggtttgcagatctgcacctctggagccttgggatggaattagagggccacatggcaagtagcaaatcataggcgttttgagcaggagaggaattagccagacctggaagcaggggccatagatggggtgttgtctgagccaggaagtttgattgaagaatggaaaccaaggtaaattggacaaggatctgggcccagagaccacaggaattattctactttgaccagtgctttgggtcattgcttgaactgtccttttgctcatcactcatagaaatcccagacccatcttcccaggtccagcgtaagtctttcatgttccatgaagcctttcctgaccacccatcccacagcaggggctgaggtggttagatcaccagaggtcagaagttcgagaccagcctgaccaacatggtgaaaccccatctctaataaaaatacaaaaattagctaggcgtagtagtgtgtgcctgtaatcccagctactcaggaggtggaggcaggagaatcgcttgaacccgggaggcagaggttgcagtaagccaatacccgccactgcactccagcctgggcgacagagcgagactctgtctcaaaaaaaaatttctctcctgaatccctaagtacttttgttactgagtacttaatttgtgcgactagctcattttaccctcacaattccaaagggaaggctttattatttctcttttacagatgacaagacaggttcagagaggttaaataatgtatccagtgtcaaacttttaaaagtcaggatggaatcctgattccaagcttaggttctgaaccactggggtaggctgtgtagtactacattttctgtggaacgtggtatcggtaacatgggagagacaggctgtgcctcaggaagatgccacatgggagtgcacagcagtgctgtagtgcctcgtgtttatgtgtagtcccaggtgcctggctgtaaacaactgcagggcagtgaccatcacctctgcttttctgcatccccacacttcctaacacagtgtcccccaaagtgtgcatcaatggatggatgaatattagcacccccgcaccaccctcacctaaaacatactgaaaagtttgagatctttggataaccaccccatcccctgctgttgtcttctgtcatacggctgaaatcgtaaaactggtctgcctgtcacagctccagtgagcctacttactcactggaaattcagagaatgtctttagtcctgttgactgctttgattttgttttttaacttgtaccaagacctgttgccatgatgggtctctgcaaatgggctttcttgttccatgagtctctgttttagtcaagtgaagggcacactccttttcattggccacctcttacttttcctccaagaggagtactcactcccagaaccctttgctgggctctcatgccgagcttaggtgccccttcagtgtgcttctgcagcactcattaccccgtagtagcattgtagtttaattcctgtttgcttgactgaagcagagactcacctgcagacgcctgtaggtgccttccacgttgctcagatgaacagtagagaagggtcaggcctgccctaggtttctacccctctcctcaaggccctttctagtcaccacgccacatcctgctcatgactgcagggatcatgcctctgggcctctgtccatgcagctgcctctgcctgcactccaggacaggggccttctctgctgtccactggagccctgtggaagggactcctgaccctagccttagggaagtcatctctaaaggctgttttattacagtgtttcctcagaatgaccctatagacacagtgttttctcagtgtcctctcacctttgaacatatccgggaataattgaaaaaaccaggcaatcaaatgtgcctctcataaatcaccatcacttcagagcagaacttaagagtttggtttgcaagccacaccaaatagtttgagcttggccctctaccatttcctcctgctctgagcccagaggttcacctagtggactgtagcaatggattcccttgcccctggcttcctgttgggttcagccagagagcagcaccagtgggagcctacagagggaggaaagtgaggtcaaggtgtctgctgcctcctccctgcctgccaggccactgtgggtagactacacctcaggtggccctccccatgtgtagccatgcttgccaggttctgggttctggaaacctccacctcctcttgccccttcagtcatagggtggtagcccccttcattgctattagctgttatgcactcaattgtgttccaaccccaaattcgtaggttgaggccccaatccccaggacctcagaatgcaactgtatttggagatagggtctttaaagaagtaattaaattaaaatgaggccattaagccctaattcaatgtgactggtgttcttgtaagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcacccagtttgtggtattttgttgtggcagttctagcaaactaatacagtggtacttactattccatggggatttccctaaatgttgcttattacagtgtgtaagtccttctggtaagctttccttttgggaagtcatctgtttcttgttgggaccctgatggatatccaggcttagatgccaacaggaggttttagtgacaaaggcaagaaaatctgtcactggaagtgtctccctgctaccggtgtccctccctatcatgtgaacccacctgggtaccctagtgctactccagggtatttccttttcttagaaggtgagtgactttggactgatcattccctgtgagcttcagttttcctcttcgtaaagcataggtaacaaaagctgcctttttggggtattttgaggcaacatgttggatgcagatatgaatggactgcgataacccagtaaggaaacaaggttgctcttctatagcagtatttgtaaacaatttcattgatacatacgcacaaagcattgaaatctttgaaggcaagaaaatggtgatgtttactagggaaggcagctctgagtctagcataggggagactgtgcgatttgcccagcaactttctatgccctcctcccaagtccaggaaaccttgaaaaccacagtgcagcagagacagagacccgtgtaccaacctattctcagtcaggttttcattagctcttcataaacaaccagtcaatcaatttcaacttttacttcacagtctcctgctgtagaggccccatacatacaaccggtgaatggagcatctctttcccttcttccttttcgtttgggaatgaagtcaaatctggaggccagagcagctcagacacctaaataggtacacagtatgcagtaagatgagattctgtttctggctcctcattcctatttccaataaatgaagcttctcaaccatgttattttcacctgcccaagctaaaacacaatcttcactgtccccatagctccaaagagggaaatcctgacataacatggggatgctgctagagtctttgccctctctgcaagctagactcgctactggcccttcccagagtgggccaagagaccaggcttattcctcagttggacatctgacctttcacaaaatagagttctcccctgggaggatgatgcctccagggcaataggaacacttttttgttagcttattactatctctatccaattctacaccacaaggcattcttgtgggtgtgaaaagctattgaggaatgaaatggccctgtgggctagacaggtgaaaagagaataaaatctcagcatgtgaaggtctaggaagagtgtcacttaaacttttaaaaaaaagccagacaaactgcaagtttactactttttttggagagctgaggtcacagggcagccaattagcctaaaaatctaaggactggaggaggcctatgaagaagcatgggacacaagcccttgcttacctggagcagatgtagccaacagaagaactcagcaggagtaggtaaagaattggtggcgaatgagtgaggactggtgagagtatggagaccctggggaatgcatatgtagagggagtttgcaccttcttggagacttttctccatggactccaccaggcactgtatcccaccagaaaagactggccaaagtcctgagaaagaatccctcacagtgcaggtatgggggaaagggaaaatagccactgcaaaggggcatgaaccccaccctttctcctttctagaaaaaaagccttaatctacaggagaaagggaaaaatactgtttcctttagtctactggcaaaacttagggaagaacagaacaaaatacctctctgtcccaaggaaggggcaggaatacagaaacaagaactaagaatgtattgccaataaatgtacttgagaagaaatgttaaagaagttcttcaggtaggagaaatgtgaaacaagatagaaatgcgtaactaaagacacaaaaatatgaagagcgctggaaattgattaaatgaaggtaaactaagatacatgtaaaatgtttaaatgatcctaaaagataaatgactgtcaagagtaaacatagtagcaatgtattatgtgtgtataggataggtaaaagtaaaatgtatcgtaacaatgatacaaaggttgggagggaggaattgaggagaaattattttaagatccttacattatgaatgaagcagtatattatttgaaggtaaactctgatcaattaaagatgtattgtgtaaatgctaggacaacaactaaaaaatttctcaactataaatcaaataatggagataaaatgcaatcataaaaaagtgttcataagagtagaagtcaatgaaattgaaaaacagaaaaacaataaagtcaataaaaccaaaacctatttcttataaaatatcaataaaattgataagcctttagccagactgacaaaaaatagaggagatacaaattaccaatatcaggaatgaaagagggaaactactacagatcccatagacaataacaagataataagggaatgctataaacaactctatgaccatacattggacaacacagatgaatgaattaatttcttaaaagatacaaatgatcaaaactcaccccagaagaaatatacaattttaatagtgatatatattaaagaaattgaattgtacttataagcctctgaaatattcaacagttaacaaacaagaataggtctagatatttcaatggaaaattctaccagacatttaaagaggaactatcactaattatatacgatatattctagaaaataaaagagggggtaacatctcaattcattttatgaagccagcattaccctgatatcaaggcagataaagacagtttcgaaacctatagaccagtatctctcatgagcattgatgcagaaatactcaacaaaatattagaaattatgaaaagaagaatacaacatgaacaaatgggttatgctgggaaagcaagtttgattttttaaattaatttttaaataataaaataattattccattatattaacagcgtaaagaagaaaagctgcatgattatattaatttatgcagaaaaggcatttgacaaaagtcagcattcattcatgatagttattctcagcaaaataggaattggaaatttcctcaagctgataaagggcatctaaaaaaatgaaaacaaaaaacaaccctacagctaatattatacctaatgctgaaagactgaatgttttctcctaatattaggagataagaatatcctctcataccactcctgttcaacattttactgaaaggcctagccagtgcaataaggcaataaaaagaaatatagaacatacagattggaaatgaaaaaaatgaaatagtccctactcactgacaataggattgtttatgtaaaaaaaaaaaaaaatcccaaaccatcaccaaaaaacccgacctaattaatatgtgaattcttaatcatgacatgttatgaatgtccagttttccatgtgtgtgtgtttgtgtgtgtgtttgtgtttgtgtgtgtatttatggagttatcattcttgctttctgactatccagcattcaaacattatcagtattggaggagaatctcaaaatatatgtctttaccagcaagctaaagggaccagatagatatttcttctctctatttcatgggaggtataactatatgactgagtcttgaccgatcaggtgctcccatgctgggctcaaatttcaaggaagtaatgaaattatacaggtggctgttggagatttctcatgaggacagctgaatcaggagtccctcaatgcagaggtttgtgtccggggatggtgggattttgtttataacactaccaggctggaccatgatatgagctggctgtgttcttggttgcctcaccaccctttgttcctgccctgttgccgaccctagttcaccagccttattgttgagtctataagctaccttctaataaggctattttctacctgatatccagagtttattccttctgttgttatcaacaatgtgtgtgtgtgtgtgcatgcgcgcatgtgtgtgtgtgtgtatgtattaaaaaatgggaatggcattatactgcttatattgtcctgttactttattacttaaacatatatactgtcaacatttttccatgtccatgatgttgctctatttaatcattttaattattgcctggcattaacttatagggatttattgtaatctgtttaaccaatctcccatgactggacatttaggttgcttctaacatttatttataataaacaacactgctatgcatatctatacatataaatcttttggattttaactaattatttccttaaagttctagatgtagaattgctatatcaaagggtaggtacgtttttcaggtttttgattcatactgccaaatttcttaacctctccctcaaaaaacttgtgacaatttatactaccatcagtcatatgcctttatgacaatgttgatttccaggcatactaccaacttagattattatctttgtgaaatttttgagttattacttatgttcagtgactttgtaaatatttgttagctgtttgtgattattgctttgtgagtgactgctattgtcttttgttcataattcttttgagggaaaggaacatactttttatttaatttataagagctcataattttatttatatttatatatataagtatatatatatatatgtgtgtatatatatatatgtgtgtgtgtatgtatatatatatatatatatatatatatatatatgtgtgtgtgtgtgtgtatatatatataattttttttttgagatggagtctctgtctgtcacccaggctggagtgcagtggcatgatctcagctcattgcaacctccacctcccaggttcaaatgattctccttttatattaaggcatctatctgtctaacatctgtggatctatacatcatatatattaaggtataatggccatgtatattgctattttcccccaatttttatttgtgtttttgctttgtttattctattctgaattttttccccatttgtatatagtctattaaacaatgctttatagtttctgtctttggttgatacttcaaaataactttcccgtcccaaaatggtaacagtatttacattttttactggtactcttatgtgtttttttttaataaaataatcatatagaactaattttgttttaaggtacgaggtactagctaacattttcttcagagttactaaattcttaagtatgtttgaatttgtgaactctgtatttctgaacttttcttaatgtctccttaatctatgctagggctaaattactcaattaattaaacaatttcaagatttcagaagttttaatatttaatgagaagtcttcagccttggggtagaatgttgttgcttgttacttagtgctggggagtcaggggtgcgcttgatcctagtacactctcaggctttggcaggccctgtatgcctggatcttaggagtaaggctttctcagaaatcctgcccctcctcctcctcctcctgtggcagctgaaccctgccttgtgtcatgtgcaggagagaatgtctggatctggggctcaggactgtttcttgcccgttccccagggatcaagggtgttttggctttccccttccccaagctgcagtaggtcttcacctgtgccctgactgcaacaggctgtactgtccctccccagtggcttaggtgggaggagggtgtggctgtagccttatgcctttccttcagcaatgttgcccctctttcctgggcctgcactgtgcagggaggcttctttgctctcccaccctgccttcagtcctttctcaatcagtaggtggaagggagtggagaagagcctgcaagtgggcaccaattcctcttgtgtctgcagcccccaggggtgctacactcatgctagtctgcttctggcctttagtaatttgttaaaagctttagatgaattctttttatgtttttgtatggcacccagtgtttcttcccatactcagccacatctcttcttggggacgcagcctttccttagatttcaggcttttgggttccgtgtgatctcagctttctggtggactcaagaaaaggtatgggtttttggtcatctgactttattgttgttgttagggtgggagagacactattttaagctttctttatagtaagcaggaggggaactcctgtgttttcatagctaatcaagcatggaccctgcccttattctctttttaaaaattttcttggctattctcacatatctgttctcttaaatatactttagaatcatttgctcaagtacctcaaacccaaacacctccaaaagaattccttttggattgacatggtatcaaaatatgtaaactgacttcagtcccagatgttgtcgaaacttcattcccaagatctgaatagagcagtcagagcggattgtgattgaaagaccacctccaaggccagcctgcctctaaatcccacctgttttgttttggtgtcttgaaattccagcattagagtgcagaaaaatagttctaggaccttagaggatgaaaatgtatgcagtttgtgttggaaggaccagcataataactaatgtgcaaccatcactgcacttacaaattaaggtcacagatctagacaaagtattgtgtgaattaagtgagtcagtgagtgagtgagtatggagagggactctgttaagaacaggggagctagaggggaaatgactggatctggaactgagagcacccgagtagctgagaatgcggactctaaatcttctggggacaagaggagaggagcaaaagccccacagccacctctgtggttgtcacacttcaatctggcagctagagaaaagcccgaaccaggccaggtaaggctcccctcaaggactatgtagattgtgtgctacaggcaaaaaaggggaaaaccctccaagaggatccagcagtgatcacagctattgatttgtactcccacggcccttgcggccatgcatctcttaaaatcaaatgaaacaaccatcaacaattgtggtaagaattttccagtaggagaaatagagaaaggaaaaaaaattctgagaaaacaaaacaaaacccttcttgatgttttccacagactgctttagaaagagaaagactgatgcaatccaatcaaggacagtgatcctcggttgacccaggatatttcacagacccagaatgcagaaggcacagacgcccacaagcaggcctcagttttgacttcttaaatgcaaccattttttgtaaattaatattgaattttcaaccaactccagcacctcattaaggaggggcctgttctttgccaaactcttccaagggaacctgctgggtttgagtgtaggtgtcagcaaacatttcccagtatgttctaatggggaaatatttattttgtaacactccttcctaaccgaaaatacaattatgtgacatgttttatatgaccaaggggatttgggctaagattttgtatccataatgtgccctaatattgagaaatatcatttttaaagtattctctttggcattgacagggggctacattctggaaaaatagcacttcatgggaatttccctttagccctgagaaaaaatagtttgggaacacataacagtatatttggtttgggatgttaaatcctgcagggtctctgaaagaggcaaatgggtgtgagaaagaattagttactgcaagtttatttcataatggcctataaaaaatatacgtgttccatttctaaagctgctatgcccttactatagctatagctattttttaaaacaagaaagactttccacaagtcattttctactttgggtgggataacatttagagcaaggtataaaggacctttgccagagtaattaccatttaaggcaaaggtctccaagattttacttggagctgaagatcttggcgcagccctggctctgtggaacaccacacacatccagtgaccatgggaaagctggctccctgctgggtagtgctgcagcattagtacaagtctcatgctctgaagggtgaaatgtgatgatctgctaagtgaaggctctgtcaggagaagccagaggagtggtaacagctcaccaaaccaaaatccatgaagtcccagccctttttcatcgtcaccatttttgcatatagaacatgtccctatggggacatccagggagtgggtgccaggactcagtgtgcccagcccaaggccaaagagagtttattagcagaaggatcacttacatgatttggaaccacaggagagagagatgtgtggtggctgaaagcagaacttgggctaatgtttataagagagaccagccaagaagcctatgcattaattagtgttctgctggttgttctgttaggaggcatcattcatcacttaaaataagaccttttatttatttatttattatactttaagttctagagtacatgtgcacaatgtgcaggtttgttacatatgtatacatgtgccatgttggtgtgctgcacccattaactcatcatttacattaggtatatctcctaatgctatccctccccccaccggccacccaaagacaggccccagtgtgtgctgttccccatcctgtgtccaagtgttgtcattgttcacctctcacgtatgagtgagaacatgcggtgtttggttttctgtccttgcaatagtttgctcagaatgatggtttccagcttcatccatgtccctacaaaggacatgaactcatccttttttatggctgcatagtattccatggtgtatatgtgccacattttcttaatccagtatatcactgatggacatttgggttggttccaagtctttgctattgtgaatagtgcctcaataaacatatgtgtgcatgtgtctttatatcagcatgatttatattcctttgggtatatacccagtaatgggatggctgggtcaaatggtatttctagttctagatccttgaggaatcgccacactgccttccacaatggttgaactagtttacagtcccaccaacagtgtaaaagtgttcctatttctccacatcctctccagcacctgttgtttcctgactttttaatgatcgccattctaactggtgtgagatggtatctcatggtggttttgatttgcatttctctgatggccagtgatgatgagcattttttcatgtctgttggctgcataaatgtcttcttttgagaagtgtctgttcatatcctttgcccactttttgatggggttgtttgattttttcttgtaaatttgtttaagttctttgtagattctggatattagccctttgtcagatgggtagattgtaaaaattttctcccattctgtaggttgcctgttcactctgatggtagtttcttttgctgtgcagaagctctttagtttcattagatcccatttgtcaattttggctttggttgccattgcttttggtgttttagtcatgaagtccttgcccatgcctatgtcctgaatggtattgcctaggttttcttctatggtttttatggttttaggtctaacattcaagtctttaatccatcttgaattaattttagtataaggtgtaaggaatggatccagtttcagctttctacatgtggctagccagttttcctagcaccatttattaaatagggtatcctttccccatttcttgtttttctcaggtttgtcaaagatcagatggttgtagatgtgtggtattatttctgagggctctgttctgttccattcatctatatctgttttggtaccagtaacgtgctgttttggttactgtagcctcgtagtatagtttgaagtcaggtagtgtgatgcctccagctttgttcttttggcttaggattgtcttggcaatgtgggctcttttttggttccatatgaaccttaaagtagttttttccaattctgtgaagaaagtcacagatggcattgatggggatggcattgaatctatacattaccttgggcagtatggccattttcacaatattgattcttcctacccatgagcatggaatgttcttccatttgtttgtgtcctcttttatttcgttgagcagtggtttgtagttctccttgaagaggtccttcacatcccttgtaagttggattcctaagtattttattctctttgaagcaattgtgaatgggagttcactcatgatttggctctctgtctgtttttggtgtataagaatgcttgtgatttttgcacattgattttgtatcctgagactttgctgaagtcgcttatcagtttaaggaggttttgggctgagatgatgaggttttctaaatatacaatcatgtcatgtgcaaacagagactatttgacttcctcttttcctaattgaataccctttatttcttctcttgcctgattgccctggccagaacttccaacactatgttgaataagagtggtgagagagggcatccctgtcttttgccagttttcaaagggaatgcttccagtttttgcccattcagtatgatattgactgtgggtttgtcataaatagctcttattattttgagatacatcccatcaatacctagtttattgagagtttttagcatgaaggggtgttgaattttgtcggaagccttttctgcatctattgagataatcatgtggtttttgtctttggttctgtttatttgatggattatgattattgatttgtatatgttgaaccagccttgcatcccagggatgaagcccacttgatcatggtggataagctttttgatgtgctgctggattcagtttgccagtattttattgaggatgtttacattgatgttcatcagggatattggtctaaaattctcttttgttgttgtgtctctgccaggctttgttatcaggatgatgctagcctcataaaatgagttagggaggattccctctttttctattgattggaatagtttcagaaggaatggtaccagctcctccttgtacctctggtagaatttggctgtgaatgcatctggtcctggactttttttggttggtaggctcttaattattacctcaatttcagagcctgttattgatctattcagggatccaacttcttcctggtttagtgttgggagggtgtatgtgtcaaggaatttatccatttcttctagattttctagtttatttttgtagaggtgtttatagtattctctgatggtagtttgtatttctgtgggatcggtggtgatatcccctttatcattttttattgcatctatttgattcttctctcttctttattagtcttgctagtggtctatcaattttgttgatcttttcaaaaaaccagctcctggattcattgatttgttgaagggttttttgtgtctctatctccttcagttctgctctgatcttagttatttcttgccttcggctagcttttgaatgtgtttactcttgcttttctagctcttttaattgtgatgttagggtgtcaattttagatctttcctgctttctcttgtgggcatttagtgctataaatttccctctacacactgctttgaatgtgtcccagagattctgttatgttgtgtctttgttctcattggtttcaaagaacatctctatttctgcctccatttcattatgtacccagtagtcattcaggagcaggttgttcagtttccatgtatttgaggggttttgagtgagtttcttaatcctgagttctagtttgattgcactgtggtctgagagacagtttgttataatttctgttcttctacatttgctgaagaatacgttacttccaactatgtggtcaatcctggaataagtgcactgtggtgctgagaagaatgtatattctgttgatttggggtggagagttctgtagatgtctattaggtccacttggtgcagagctgagttcaattcctggatatccttgttaactttctgtctcatggatctgtctaatgttgacagtgggatgttaaagtctcccattattattgtgtgggagtctaagtctctttgtaggtctctaaggacttgctttatgcatctgggtgctcctgtatggtgcatatatatttaggatagttagctcttcttgttgaattgatccctttaccattatgtaatggccttctttgtctcttttggtctttgttggtttaaagtctgttttatcagagactaggattccaaccccagcttttttttggttttccatttgcttggtagatcttcctccatccctttattttgagcctatgtgtgtctctgcacatgagatgggtctcctgaatatagcacactgatgagtcttaactctttatccgatttgccagtctgtgtattttaatcggagcatttagcccacttacatttaaggttaatattgttatgtgtgaatttgatcctgtcgttatgatgttagctggttattttgctcgttagttgatgcagtttcttcctagcatcgatggtctttgcaatttggcatgtttttgcaatggctggtaccggttgttcctttccatgtttagtgcttacttcaggagctcttataaggcaggcctggtggtgacaaaatctctcagcatttgcttgtctgtaaagtattttatttctccttcacttatgaagcttagtttggctggatactaaattctgggttgaaaattcttttctttaagaatgttgaatattggcccccactctcttctggcttgtagagtttctgctgagagatcagctgttagtctgatgggcttccctttgtgggtaacccgacctttctctctggctgcccttaacattttttccttcatttcaactttggtgaatctgacaattatgtgtcttggagttgctattctcaaggagtatctttgtggtattctctgtgtttcctgaatttgaatgttggccttccttgctaggttgggggagttctcctgaataatatcctgcagagtgatttccaacttggttccattctccctgtcactttcaagtacaccaatcagatgtagatttggtcttttcgcatactcccatatttcttggaggctttgttcatttctttttactcttttttctctaaacttctcttctcacttcatttcattcatttgatcttccgtcactgataccctttcttccccttgatcgaatcagctactgaagcttgtgcatgcatcacgtagttctcgtgccatggttttcagcaccatcaggtcatttaaggtcttcctatgctgtttattctagttagcctttcatctaatcttttttcaagtttttagcttctttgcgatgggttcgaacatcctcctttagctcggagtagtttgttattaccgatcatctgaagccttcttctctcaactcatcaaagcctttctccatccagctttgttctgttgctggcaaggagctgcgttcttttggaggagaagaggcactctgatttttagaattttcagcttttctgctctggttt

SEQ ID NO: 12433 - DNA, 10907 bp, Homo sapiens
attttctttttttttaattttttatttatttatttttttttattacactttaagttttagggtacatgtgcacattgtgcaggttagttacatatgtatacatgtgccatgctggtgtgctgcacccactaacgtgtcatctgtcattaggtatatctcccaatgctatccctcccccctcccccgaccccaccacagtctccagagtgtgatattccccttcctgtgtccatgtgatctcattgttcaattcccacctatgagtgagaatatgcggcgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcatttgggtatatacccagtaatgggatggctgggtcaaatggtatttctagttctagatccctgaggaatagccacactgacttccacaatggttgaactagtttacagtcccaccaacagtgtaaaagtgttcctatttctccacatcctctccagcacctgttgtttcctgacattttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcactgtagattctggatattagccctttgtgagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgtattggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggtgactgtagccttgtagtatagtttgaagtcaggtagtgtgatgcctccagctttgttcttttggcttaggattgacttggagatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttggattcctaggtattttattctttttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcggtatgatactggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtgtaaaattctcttttttggttgtgtctctgcccagctttggtatcagaatgatgctggcctcataaaatgagttagggaggattccctctttttctattgattggaatagtttcagaaggaatggtaccagctcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgctggtttcgaagaacatctttatttctgccttcatttcattatgtacccagtagtcattcaggagcaggttgttcagtttccatgtagttgagcggctttgagtgagattcttaatcctgagttctagtttgattgcactgtggtctgggagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatctttctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtcttgatggtctttacattttggcatgattttgcagcggctggtaccggttgttcctttccatgtttagtgcttccttcaggagctcttttagggcaggcctggtggtgacaaaatctctcagcatttgcttgtctataaagtattttatttctccttcacttatgaagcttagtttgcctggatatgaaattctgggttgaaaattcttgtctttaagaatgttgaatattggcccccactctcttctggcttgtagggtttctgccgagagatccgctgttagtctgatgggctttcctttgagggtaacctgacctttctctctggctgcccttaacattttttccttcatttcaactttggtgaatctgacaattatgtgtcttggagttgctcttcttgaggagtatctttgtggcattctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttcttttgattcttttttctctaaacttcccttctcgcttcatttcattcatttcatcttccattgctgataccctttcttccagttgatggcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcactctgctttttagagtttccagtttttctgttctgttttttccccatctttgtggttttatctacttttggtctttgatgatggtgatgtacagatgggttttcggtgtagatgtcctttctggtcgttagttttccttctaacagacaggaccgtcagctgcaggtctgttggaataccctgcagtgtgaggtgtcagtgtgcccctgctggggggtgcctcccagttaggctgctcgggggtcaggggtcagggacccaattgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcctggtgcgccgtttttcaagccggtctgaaaagcgcaatattcgggtgggagtgacccgattttccaggtgccgtctgtcacccctttctttgactcggaaagggaactccctgacccttgcgcttcccaggtgaggcaatgcctcgccctgcttcggctcgcgcacggtgcacgcacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccttctctctgtttgtcttttattggtgtatatgaatgcttgtgattttttgcacattgatattgtatcctgaggtgctgaagttgcttatcagcttaaggagattttgggctgggacaatagagttttctaaatatacaatcatgtcatctgcaaacagagacaatttgacttcctcttttcctaattgaacaccctttgtttctttctcttgcctgattgccctggccagaacttccaatactatattgaataggagtgatgagagagggcatccttgtcttgtgccagttttcaaagggaatgcttccagtttttgcccattcagtacgatattggctatgggtttgccataaacagctcttattgagatacgttcaatcagtgcctactttattgagaattttttaggatgaagggtgttgaatttttgttgaaggacttttctgcatctgttgaaataatcacgtgctttttgtcattggttctgtgtatgtgatggattacatttattgatttgcatatgttgaaccagccttgcatcccagggatgaagccaccttgatggtggtgcataagctttttgatgtgctgctggatttggtttgccagtattttattggggattttcgcatcgatgttcatcagggatactggcctgaaattttctttttttgttgtgtctctggcaggttttggtatcaggatgatgctggccttgtaaaatgagttagggaggatcccctctttttctattgtttgaaatggtttcagaaggaatggtaccagctcctctttgtacctctggtagaatttggcagtgaattcatctggttctggactttggtaggctattaattactgcctcaatttcagaagttgttattggtctattcagggattcgacttcttcctggtttagtcttgggagggtgtatgtgtccaggaatttatccatttcttctagattttctggtttatttgcatagaggtgtttatagtattctctgatggtagtttgtatttctgtgggatcagtggtgatatcccctttatcattttttattgcatccatttgattcttctctcttttctttattagtctggctagcagtctatccattttttgatcttttcaagaaaccagctcctggattcattgatttttttttttttgaagggtttttcatgtctctatctccttcagttctgctctgatcttagttatttcttgtcttctgctatcttttgaatttgtttgctcttgcttctctagttcttttaattttgatgttagggtgtcgattttagatcttttctgctttctcttgtgggcatttagtgctataaatttccctctacacagtgctttaaatgtgtcccagagattgtacgttgtgttgttagttctcattggtttcaaagaacatctttgtttctgccttcatttcgttttttacccagtagtcattcaggagcatgttgttcaatttccatgtagttgtgcagttttgagtgagtttcttaatcctgagttctaatttgattgcactatggtctgagagactgtttgttatgatttccattcttttgcatttgctgaggagtgttttacttccaattatgtggtccattttagaataagtgcgatgaggtgctgagaagaatgtatattcttctgatttggggtagagagttctgtagatgtttattaggtctgcttgttccagcgctgagttcaagtcctggatatccttgctaattttctgtctcattgatgtgtctaatattgacagtggggtattaaatctcccactattattgtgtgggagtgtaagtctctttgtggatctctaagaacttgccttatgaacttggatgctcctgaatggtgtgcatatatatttaggatagttggctcttcttgttgcattgatccctttaccattaggtaatggccttctttctcttttgatctttgttggtttaaagtctgttttgtcggagactaggattgcaacccctgctttttttttttttctttctatttgcttggtaaatcttcctccatccctttattttaagcctatgtttgtctttgcatgtgaggtgggtctcctgaatacagccactgatgggtcttgacgcttatccaatttgccagtctgtgtcttttaattagggaatttatcacatttacatttaaggttaatattgttatgtgtgaatttgattctgtcattatgatgctaactggttattttgcctgttagttgatgttgtttctttatagtgttgatggtctttacaatttggtatgtttttgcagtggctggttccagttgttcctctccatgtttagtgtttccttcaggagctcttgtaaggcaggcctggtggtgacaaaatctctcggcatttgcttgtctgtaaaggagtttatttctccttcacttacgaaactgagtttgcctggatatgaaattctgggttgaaaattcttttaagaatgttgaatattggcccccactctcttctagcttgtaaggttcctgcagagagatctgctgttggtctgatgggcttccctttgtgggtaacctgacctttctctctggctgcccttaacaatttttccttcatttcaactttggtgaatctgatgattatgtgtcttggggttgctcttctcaaggagtatctttgtggtgttctctgtatttcctgaatttgaacgttggcctgtcttgctaggttggggaacttctcctggatgatatcccgaaaagtgttttccaacttggttccattctctccatcactttcaggtacaccaatcagaggtggatttgatcttttcacatagtcccatatttcttggaggctttgtttgatccctttcatccttttttctctaatcttgtcttctcacttcatttcattaagttgatcttcactttctgatatcctttcttctgcttgattgattcagctatttatagttgtgtatgcttcacagaattctcatgctgtgtttttcagctccatcaggtcatttatgttcttctcgaaactggttattccagttagcaattcgcgtaaccttttttcaaggttcttagcttccttgcattgggttagaacatgctgctttagctcagaggagtttgttattacccactttctgaagcttacttctgtcgagtcatgaaactcattctccatccatttttgttccattgctggtgaggagttgtcatccttgagaagaggtgttcaggtttttggaattttcagcctttttgcgcgggtttctccccatcttagtgaatttatctaccgtcggtctttgtagtcagtgaccttcggatggggtctctgagtagatgtgctattcctattttttagtttttttttcttttttttttgtgacagagtctcattctgttgcttacgctggagtgcagtggtgcaatcatggctcactgcaagctccacctcctgggttcatgccattctcctgcctcagcctcctgagtagctgggactacaggcacccaccaccacgcctgcctaattttttgtgtttttactagagacgggtttcactgtgttagccaggatggtctcaatctcctgaccttgtgatctgccctcctcggcctcccagagtgctgggattacagccgtgagccactgcacctggcctagttttccttctaacaggaccctgtgctgcaggtctgttggagtttgctggaggtccactccagaccctgtttgcctggatatcaccagaggaggctgcagaacagcaaagactgctgcgtgttgtttcctctggaacctttgtctcatacgggcacctgccagatgccagccagagctctcctgtatgaggtaggtctgttggcccctactgggagctgtctcccagtcagtacacatgggtgtcagggacccacttgaggaggcagtctgatccttagcagagcttgaacgttgtgctctcttcagagccagtaggcagggacgtttaagtctgctgaagctgcacctacaaccgccccttccgccagatgctctgtcccagggagatgggggttttatctatatgtttgggggtactgcctttttttttcagtgatgcccttgccagagaggaggaatctatagaagcagtctggccacagaggccttgctgagctgcagtgggctccacccagtttgaacttcccggtggctttgtttacactgtcagggtaaaactgcctacttaagcctcagcactggttgacaccccttcccccaccaagcttgagcatcccaggttgacctcagactgttgtgctggcagcaagaacttcaagttgtggatcttagcttgctggactccgtgggggttggacccaccaagccagaccacttggctccctgccttcggccccttttccagggaagtgaatggttctgtctcactggtgttctggcaccactgaggtatgggaaaaaaaaaaacaacacaaaactcctgcagctagctcagggtctgcccaaatggctactcagttttgtgcttgaaacccaggacactggagggtatcttctggtctgtgggttgcaaagactgtgggaaaagcacagtgtctgggccagagtgcactgttcctcatggcacagtccctcacagcttcccttgggtaggggagagaatttcctgaccccttgcacttcctgggtgaggcgacaccccacaccccaccttagctggaaatgtggaaaaatcacctgccttctgtggcgatctcgctgggagctgcatactggagctgttcctatttggccatcttg

SEQ ID NO: 12434 - DNA, 6943 bp, Homo sapiens; identical to SEQ ID NO: 11539

SEQ ID NO: 12435 - DNA, 5251 bp, Homo sapiens
atttatttatttattttttaatttattattattatactttaagttttagggtacatgtgcaaaatgtgcaggttagttacatatgtatacatgtgccatgctggtgcgctgcacccactaactcatcatctagcattaggtatatctcccaatgctatccctccccccttcccccaccccacaacagtccccagagtgtgatgttccccttcctgtgtccatgtgttctcattgttcaattcccacctatgagtgagaatatgcggtgtttagttttttgttcttgcgaaagtttactgagaatgatgatttccaatttcatccatgtccctacaaaggacatgaactcatcattttttatggctgcatagtattccatggtgtatatgtgccacattttcttaatccagtctatctttgttggacatttgggttggttccaagtctttgctattgtgaataatgccgcagtaaacatacgtgtgcatgtgtctttatagcagcatgatttatagtcctttgggtatacacccagtaatgggatggctgggtcaaatggtatttctagttctagatccctgaggaatcgccacactgacttccacaatggttgaactagtttacagtcccaccaacagtgtaaaagtgttcctgtttctccacatcttctccagcacctgttgtttcctgactttttaatgattgccattctaactggtgtgagatgttatctcactgtggttttgatttgcatttctctgatggccagtgatggtgagcattgtttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggctgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttctcctagggtttttatggttttaggtctaacgtttaagtctttaatccatcttgaattgatttttgtataagatgtaaggaagggatccagttttagctttctacatatggctagccagttttcccagcaccatttattaaatagggaatgctttccccattgcttgtttttctcaggtttgtcaaagattagatagttgtagatatgcggcgttatttctgagggctctgttctgttccattgatctatatctctgttttggtaacagtaccatgctgttttggttactgtagccttgtagtatggtttgaagtcaggtagtgtgatgcctccagctttgttcttttggcttaggattgacttggcgatgcgtgctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcgtgatttggctgtttgttgttggtgtataagaatgcttgtgatttttgtacattgatttttgtatcctgagactttgctgaagttgcttatcagcttaaggaaattttgggctgagacaatggggttttctagatatacaatcatgtcatctgcaaacagggacaatttgacttcctcttttcctaattgaataccctttatttccttgtcctgcctaattgtcctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagataggtcccatcaatacctaatttattgagagtttttaccatgaatggttgttgaattttgtcaaaggccttttctgcatctattgagataatcatgtggtttttgtctttggttctgtttatatgctggattacatttattgatttgcgtatattgaaccagcctttgcatcccagggatgaagcccagttgatcatggtggataagctttttgatgtggtgctggattcggtttgcgagtattttattgaggatttttgcatcaatgttcatcaaggatattggtctaaaattctctttttttggttgtgtctctgcctggctttggtatcaggatgatgctggcctcatgaaatgagttagggaggatcccctctttttctattgactggaatagtttccgaaggaatggtaccagttcctccttgtacctctggtagaattcggctgtgactccatctggtcctggactctttttggttggtaagctattgattattgccacaatttcagctcctgttattggtctattcagagattcaacttcttcctggtttagtcttgggagtgtgtatgtgtcgaggaatttatccatttcttctagattttctagtttatttgcgtagaggtgtttgtagtattctccgatggtagtttgtatttttgtgggatcggtggtgataatcccctttatcattttttattgtgtctatttgattcatctctctttttttctttattagtcttgctagcagtctatcaattttgttgatcctttcaaaaaaccagctcctggattcattaattttttgaagggctttttatgtctctatttccttcagttctgctctgattttagttatttcttgccttctgctagcttttgaatgtgttttctcttgcttttctagttcttttaattgtgatgttagggtgtcaattttggatctttcctgctttctcctgtgggcatttagtgctataaatttccctctacacactgctttgaatgcgtcccagagattctggtatgttgtgtctttgttctccttggtttcaaagaacatctttatttctgccttcatttcgttatgtacccattagtcattcaggagcaggttgttcagtttccatgtagttgagtggttttgagtgagtttcttaatcctgagttctagtttgattgcactgtggtctgagagatagtttgttataatttctgttcttttacatttgctgaggagagttttacttccaagtatgtggtcaattttggaataggtgtggtgtggtgctgaaaaaaatgtgtattctgttgatttggggtggagagttctgtagatgtctattaggtctgcttggtgcagagctgagttcaattcctgggtatctttgttgactttctgtcttgttgatctgactaatgttgacagtggggtgttaaagtctcccattattaatgtgtgggagtctaagtctctttgtaggtcgctcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagaggctaggatcacaacccctgccttttttttgttttccatttgcttggtagatcttcctccatccttttattttgagcctatgtgtgtctctgcacgtgagatgggtttcctgaatacagcacactgatgggtcttgactccttatccaatttgccagtctgtgtcttttaattggagcatttagtccatttacatttaaagttaataatgttatgtgtgaatttgatcctgtcattatgatgttagctggttattttgctcgttagttcatgcagtttcttcctagtctcgatggtctttacattttggcatgattttgcagcggctggtaccagttgttcctttccatgtttagtgcttccttcaggagctcttttagggcaggcccggtggtgacaaaatctctcagcatttgcttgtctgtaaagtattttatttctcctttacttatgaagcttagtttggctggatatgaaattctgggttgaaaattcttttctttaagaatgttgaatattgtcccccactctcttctggcttgtagggtttctgccgagagatccgctgttagtctaatcggcttccctttgtgggtaacccgacctttctctctggctgcccttaatattttttccttcatttcaactttggtgaatctgacaattatgtgtcttggagttgctcttctcgaggagtatctttgtggtgttctctgtatttcctgaatctgaacgttggcctgccttgctagactggggaagttctcctggataatatcctgcagagtgttttccaacttggttccattctccccgtcactttcaggtacaccaatcagatgtagatttggtcttttcacatagtcccatatttcttggaggctttgctcgtttctgtttgttcttttttctctaaacttcccttctcgcttcatttcattcacttcatcttccatcactgataccctttcttccagttgatcacatcggctcctgaggcttctgcattcttcacatagttcttgagccttggttttcagctccatcagctcctttaagcacttccctgtattggttattctagttatacattcttctaaacttttttcaaagttttcagcttctttgcctttggtttgaatttcctcccgtagctcggagtaatttgatcgtctgaagccttcttctctcagctcgtcaaagtcattctccgtccagctttgttccgttgctggtgaggaactgcgttcctttggaggaggagaggcgctctgctttttagagtttccagtttttctgctctgttttttccccatctttgtggttttatctacttttggtctttggtgaccgtgatgtacagatgggtttttggtgtggatgtcctttctgtttgttagttttccttctgacagacaggaccctca

SEQ ID NO: 12436 - DNA, 6169 bp, Homo sapiens
ttcttctttttattttattttattattattatactttaagttttagggtacaagtgcacaacgtgcaggttagttacatatgtatacatgtgccatgctggtgtgctgcacccattaactcatcatttagcattaggtatatctcctaatgctatccctccccctaccccccaccctacaaccatccctggtgtgtgatgttccccttcctgtgtccatgtgttctcattgttcaactctcacctatgagtgagaacatgcggagtttggtttttggtccttgcaatagtttgctgagaatgatggtttccagcttcatccatgtccctaaaaaggacatgaacttatcgttttttatggcgcatagtattccatggtgtatatgtgccatattttcttaatccagtctatcgttgatggacatttgggttggttccaagtctttgctattgtgaatagtgctgcaataaacatacgtgtgcatatgtctttatagcagcatgatttatagtcctttgggtatatacccagtaatgggatggctgggtcaaatggtatttctagttctagatccctgaggaatcgctacaccgacttccacaatagttgaactagtttacagtcccaccaacggtgtaaaagtgttcctatttctccatatcctctccagcacctgtcgtttcctgactttttaatgatcgccattctaactggtgtcagatgatatctcattgtggttttgattttaatttctctgatggccagtgatgatgagcattttttcatgtgtctgctggctgaataaatgtcttcttttgagaagtgtctgttaatacccttcacccactttttgatggggttgtttgtttgtttcttgtaaaattttttgagttcattgtagattctggatattagccctttgtcagatgagtaggttgcaaaaattttctcccattttgtaggttgcctgttcatgctgatggtaatttcttttgctgtgcagaagctctttagtttaattggatcccatttgtcaattttggcttttgttgccattgctttcggtgttttagacatgaagtccttgcccatgcctatgtcctgaatggtattgcctaggttttcttcttgggtttttatggttttaggtctaacatgtaagtctttaatccatcttgaattaatttttgtataaggtgtaaggaagggtccagtttcagccttctacatatggtcagccagttttcccagtaccatttatcaaatagggaatcctttccccattgcttgtttttgtcaggtttgtcaaagatcagatagttgtagatatacggcattatttctgagggctcttttctgttccattggtctatatctctgttttggtaccagtactatgctgttttggttactgtagccttgtagtatagtttgaagtcaggtagcgtgatgcctctggctttgttcttttggctcaggattgacttggcgatgtgggctcttttttggttccatatgaactttaaagtagttttttccaattctgtgaagaaaggcattggtagcttgatggggatggcattgaatctataaattaccttgggcagtatggccattttcacgatactgattcttcctacctatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagaccgatggggttttctagatatacaatcatgtcatctgcaaacagggacaatttgactttctcttttcctaattgaatgccctttatttccttctccggcctgattgccctgcccagaacttctaacactatgttgaataggagtggtgagagagggcatccctgtcttgtgccagttttcaaagggaatgcttccagtttttgtccattcagtatgatattggctgtgggtttgtcatagatagctcttgttattttgagatatgtcccatcagtacctaatttactgagagtttttagcatggagggttgttgaattttgtcaaaggccttttctgcatctattgagataatcatgtggttttggtctttggttctgtttatatgctggattacatttattgatttgcatatgttgaaccagcctttcatcccagggatgaagcccacttgatcatggtggatacgctttttgatgtgctgctggattcgatttgccagtattttattgaggatttttgcatcaatgttcatcaaggatattggtctaaaattctcttttttggttgtgtctctgcgaggctttggtatcaggatgatgctggcctcataacatgagttagggaggattccctctttttctattgattggaatagtttcagaaggaatggtaccagttcctccttgtacctctggtagaattctgctgtgaatccatctggtcctggactccttttggttggtaagctctggattattgccacaatttcagagcctgttattggtctattcagagattcaacttcttcctggtttagtcttgggagggtgtatgtgtcgaggaatttatccatttcttcaagattttctagtttatttgcgtagaggtgtttatagtattctctgatggtagtttgtatttctgtgggatcgatggtgatatcccctttgtcatttttgattgcgtctatttgattcttctctcctttcttctttattagtcttgctagcggtctatcaattttgttgatcttttcaacacaccagctcctggattcattgattttttaaagggttttttgtgtctctatttccttcagttctgctctgatcttagttatttcttgccttctgctggcttttgaatgtgtttgctcttgcttctctagttcttttaattgtgatgttagggtgtccattttagatctttcctgctttctcttgtgggcatttagtgctataaatttccctctacacattgctttgcatgtgtcccagagattctggtatgttgtgtctttgttctcattggtttcaaagaacatctttatttctgccttcatttcattatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagtgctttacttccaactatatggtcaattttggaataggtgtggtgtggtgctgaaaagactgtatattctgttgatttggggtggagagttctgtagatgtctattaggtctgcttggtgcagagctgagttcaattcctggatatccttgttaactttctgtctcatttctctgtctaatgttgacagtggggtgttaaagtctcccattattattgtgtgggagtctaagtctctctgtagatcactaaggacttgctttatgcatctgggtgctcccgtattgggtgcatatatatttagaatagttagttcttcttgttgaattgatcccgttaccattatgtaatggccttctttgtctcttttgatctctgttggtttaaagtctgttttatccgagactaggattgcaacccctgcctttttttgttttccatttgcttggtagatcttcctccatccctttattttgagcctatgtgtgtctctgcacgtgagatgggtttcctgaatacagcacactgatgggtcgtgactctttatacagtttgccggtctgtgtctttttaattggagcatttagcccatttacatttaaggttaatattgttatgtgtgaatctgatcctgtcattatgatgttaactggttattttgcttgttagttgatgcagtttcttcctagccttgacagtctttacagtttggcctgattttgcactggctggtaccggttgttcctttttatgtttagtgcttccttcaggagctcttttaggggaggcctggtggtgacaaaatctctcagcatttgcttgtctgtaaagtattttatttctccttcacttatgaagcttagtttggctggataggaaattctgggttgaaaattcttttctttaagaatattgaatattggcccccactctcttctggcttgtagagtttctgctgagagatcagctgtcagtctgatgggctgcccttggtgggtaacctgatctttctctctggctgcccttagcattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgtgttccaacttgattccattctccccgtcccttccaggtacaccaatcagacgtagatttggtcttttcacatagtcccatatttcttggaggctttgttcgtttctttttattcttttttctctaaacttcccttctccgctgatttcattcatttgatcttccatcactgataccctttcttccagttgatcgcatcggctcctgaggcttctgcattcttcacgtagttctcgagccttggctctcaggtccgtcagctcctttaagcacttctctgtattggttattctagttgtacattcgtctaaatttttttcaaagttttcaacttctttgccttggtttgaatttcctcctgtagctcggagtagtttgatcatccgaagccttcttctctcaactcgtcaaagtcatcctccgtccagctttgttccattgctggtgagctgtgttcctttggaggaggagaggcgctctgctttttagagtttccaatttttctgctctgttttttcccccgtctttgtagttttacctacttttggtctttgatgatggtgatgtacagatgggtttttggtgtggatgtcctttctgtttgttggttttacttctaacagacaggaccctcagctgcaggtctgttggagtttgctagaggtccactcccgaccctgtttgcctgggtaccagcagcggtggctgcagaacagtggattttcatgaatcgcgaatgctgctgtctgatcgttcctctggaagttttgtctcagaggagtacccggccgtgtgaggtgtcagtctgcccctaatggggggtgcctcccagttaggctgctcgggggtcaggggtcagggacccacttaaggaggcagtctgcccgttctcagatctccatctgcatgctgggagaaccactgctctcttcaaagctgtcagacagggacatttaagtctgcagaggttactgctgtctttttgtttgtctgtgcgctgcccccagaggtggagcctacagaggcaggcaggcctccttgagctgtggtgggctccacccagttcgagcttctgggctgctttgttttcctaagcaagcctggcaatggtgggcacccctcccccagcctcgctgccaccttgcagtttgatctcaggctgctgtgctagcaatcagcaagactctgtgggcgtaggaccctcggagccaggtgtgggatataatctcctggtgcgcttttttttaagcccgtcagaaatgcacagtattggggtgggagtaacccgattttccaggtgccatctgtcacccctttctttgactagggaagggaactccctgaccccttgcgcttcccaagtgaggcaatgcgtcgccctgcttcagctcacgcacgatgcgctacacccactgtcctgtgcccactgtctggcactccctagtgagatgaacccagtacctcagatggaaatgcagaaatcacccgtcttctgcgtcgctcacgctgggagctatagaccggagctgttcctatcctgccatcttggctccacc

SEQ ID NO: 12437 - DNA, 6060 bp, Homo sapiens
tcattttcctttttttttttttttttttttttttttttttattatactctaagttttagggtacatgtgcacattgtgcaggttagttacatatgtatacatgtgccatgctggtgcgctgcacccactaatgtgtcatctagcattaggtatatctcccagtgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctctgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcatctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggagtattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctccttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccctctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcgatggtctttacattttggcatgattttgcagcagctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttcttgcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttcttgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctggattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctggtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggatgcagtctgcccgttctcagatctccagctgagtgctgggagaaccactgctctcttcaaagctgtcagacagggacacttaagtctgcagaggttactgctgcctttttgtttgtctgtgccctgcccccagaggtggaacctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcataggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccccc

SEQ ID NO: 12438 - DNA, 6032 bp, Homo sapiens
ccaaatttttttttttttattatactttaagttttagggtacatgtgcacattgtgcaggttagttacatatgtatacatgtgccatgctggtgcgctgcacccactaactcgtcatctagccttaggtgtatctcccaatgctatccctcccccctccccccaccccaccacagtccccagagtgtgatattccccttcatgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcgtgtgtctttatagcagcatgatttatagtcctttgggtatatacccagtaacgggatggctgggtcaaatggtatttctagttctagatccctgaggaatcgccacactgacttccacaatggttgaactagtttacagtcccaccaacagtgtaaaagtgttcctatttctccacatcctctccagcaactgttgtttcctgactttttaatgattgccattctaactggtgtgagatgatatctcatagtggttttgatttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttacctgttcactctgatggtagtttcttttgctgtgcagaagctctttagtttaattagatcccatttgtcaattttagcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagacagtcattggtagcttgatggggatggcattgactctataaattaccttgggcagtatggccgttttcacgatattgattcttcctacccatgagcatggaatgttcttccatttgtttgtatcctcttttatttccgtgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatatgtcccatcagtacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagatcctgttattggtctattcagagattcaacttcttcctggtttagtcttgggagagtgtatgtgtcgaggaatttattcatttcttctagattttctagtttatttgcatagagttgtttgtagtattctctgatggtagtttgtatttctgtgggatcagtggtgatatcccctttatcattttttattgtgtctatttgattcttctctctttttttctttattagtcttgctagcggcctatcacttttggtgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgaaattcttaatcctgagttctagtttgattgcactgtggtctgagagatagtttgttataatttctgttcttttacatttgctgaggagagctttacttccaactatgtggtcaattttggaataggtgtggtgtggtgctgaaaaaatgtatattctgttgatttggggtggagagttctgtagatgtctattaggtccgcttggtgcagagctgaattcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaaaccctgccttttttgttttccatttgcttggtagatcttcctccatccttttattttgagcctatgtgtgtctctgcacgtgagatgggattcctgaatacagcacactgatgggtcttgactctttatccaacttgccagtctgtgtcttttaattggagaatttagtccatttacatttaaagttaatattgttatgtgtgaatttgatcctgtcattatgatgttagctggtgattttgctcgttagttgatgcagtttcttcctagtctctatggtctttatattttggcatgattttgcagcggctggtaccggttgttcctttccatgcttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctagcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgtagagtgttttccaacttggttccattctccgcatcactttcaggtacaccaatcagacgtagatttggtcttttcacatagtcccatatttcttggaggctttgctcatttctttttattttttttctctgaacttcccttctcgcttcatttcattcatttcgtcttccattgctgataccctgtcttccagttgatctcatcggctcctgaggcttctgcattcttcacgtagttctcgagccttggttttcagctccatcagctcctttaagcacttctctgtattggttcttctagttatacattcttctaaatttttttcaaagttttcaacttctttgcctttcgtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgcgttttacagtttccagtttttctgtcctgttttttccccatctttgtggttttatctacttttggtctttgatgatggtgatgtacagatgggttttcggtgtggatgtcctttctgtttgttagttttccttctaacagacagcaccctcagctgcaggtctgttggaataccctgccgtgtgaggtgtcagtgtgcccctgctggggggtgcctcccagttaggctgctcgggggtcaggggtcagggacccacttgaggaggccgtctgcccgttctcagatctccagctgcgtgctgggagaaccactgctctcttcaaagctgtcagggacatttaagtctgcagaggttactgctgtctttttgtttgtctgtgccctgcccccagaggtggaggctacagaggcaggcaggcctccttgagctgtggtgggctccacccagttcgagcttcctggctgctttgtttacctaagcaagcctgggcaatggcgggcgcccctcccccagcctcgctgccgccttgcagtttgatctcagactgctgtgctagcaatcaacgagattccatgggcgtaggaccctccgagccaggtgtgggatatagtctcgtggtgcgccattttctaagccggtctgaaaagcgcaatattcgggtgggagtggcccgattttccaggtgcgtccgtcacccctttctttgactcggaaagggaactccctgaccccttgtgcttcccaggtgaggcaatgccttgcccggcttcggctcgtgcacggtgcgcgcacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccccct

SEQ ID NO: 12439 - DNA, 4947 bp, Homo sapiens
tttttgtcttttctttttattattatactttaagttctagggtacatgtgcacaatgtgcagatttgttacatatgtataaatgtgccatgttggtgtgctgtaccccttaactcgtcatttacattaggtgtatcacctaatgctatccttcccccctcaccccaccccacaacaggccccagatgtgatgttccccaccctgtgtccaagtgttctcattgttcagttcccatccatgagagagaatatgcagtgtttggttttctgcccttgcgatagtttgctcagaatgatggtttccagcttcatccatgtccctacaaaggacatgaactcaccccttttttatggctgcatatattccatagtgtatatgtgccacattttcttaatccagtctatcattgatggacatttgggttggttccaagtctctgctattgtgaatactgccacaataaacatacgtgtgcatgtgtctttatggcagcatgattcataatcctttgggtatatacccagtaatgggatgcccgggtcaagtggtatttctagttctagatccttgaggaattgccacactgtcttccacaatggctgaactagtttacagtcccaccaacagtgtaaaagtgttcctatttctccacatcctctccagcatctgttgtttcctgactttttaatgatcaccattctaactggtgtgagatggtatctcactgtggttttgatttgcatttctctgatggccagtgaggatgagcattttttcacgtgtctgttggctgcataaatgtcttctttcgagaagtgtctgttcataccctttggccactttttgattgggttgtttggtttttttcttgtaaatttgtttaagttctttgtagattctggatattagccctttgtcagatgggtagattgcaaaaattttctcccattctgtaggttgcatgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaaatctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtatgatattatttctgagggctctattctgttcccttggtctatatctctgttttggtaccagtaccatgctgttttgcttacggtagctttgtagtatagtttcaagtcaggtaacatgatgcctccagctttgttctttttgcttaggattgtcttggcaatgcaggctcttttttggttccatatgaactttaaagtagttttttccaattctgtgaagaaggttattggtagcttggtggagatggcattgaatctacaaattaccttgggcagtatggccattttcacaatattgattcttcctatccatgagcatggaatattcttccatttgtttgtgtcctcttttattttgttgagcagtggtttgtagttctctttgaagaggtccttcacatcccttgtaagttggatttgtaggtattttattatctttgaagcaattgtgaatgggggttcactcatgatttggctctctgtttgtctgttattggtatataggaatgcttgtgatttttgcacattgattttgtatcctgagactttgctgaagttgcttatcagcttaaggagattttgggctgagacaatggggttttctaaatatacaatcatgtcatctgcaaacagggtcaaaacagaagtcaaaaaaaatttgacttcctcttttcctaattgaataccgcttatttctttctcttcactgattgccctggccagaacttccaacactatgttgaataggagtggtgagagagggcatccctgtcttgtgacagttttcaaaggaatgcttccagtttttgcccattcagtatgatattggctgtgggtttgtcataaatagctcttattattttgagatatgtcccatcaatacctagtttattgagggtttatagcatgaagggctgttgaattttgttgaaggccttttctgcatcaattgagataattatttggtttttgtctttggttttgtttatatgatggattacatttattgatttgcatatgttgaaccagccttgcatccccaggatgagacccacttgatcatgttggataagcctcttgatgtgctactggattcagcttgccagtattttattgaggatttttgcatcgatgttcaccatggatattggtctaaaattttctttttttgttgtgtctctgccggtctttggtatcaggatgatgttggcctcataaaatgaattagggaggattccctctttttctgttgattggaatagtttcagagggaatgttaccagctcctctttgtacctctggtagaatttggctgtgaatccttctggtcctggactttttttggttggtaggctattaattattgcctcaatttcagagcctgttttggtctattcagagattcaacttcttcctggtttagtcttgggagagtgtatgtgtccaggaatttatccatttcttctagattttctagtttatttgcgtagagttgtttataatattctctgatggtggtttgtatttctgtgggatcagtggtgatagcccctttatcactttttattgcatctatttgattcttctctcttttcttctttattagtcttgctggcagtctatcaattttgttgatcttttcaaaaaaccagctcctagattcattgattttttgaagggttttttgtgtctctatttccttcagttctactctgatcttacttatttcttgttttctgctagcttttgaatgtgtttgctcttgcttctctagttcttttaattgtgatgttagggtgtcaattttagatatttcttgctttctcttgtgggcacttagtgctataaatttccctctacacactgctttaaatgtgtcccagagattttggtacgttgtgtctttgttctcattggtttcaaagaacatttttatttctgccttcatttcattatttacccagtagtcattcaggagcaggttgttcagtttccatgtagttgagcagttttgagtgagtttcttaatcctgagttctagtttgattgcactgtggtctgagagatagtttgttataatttctgttattttacatttgctgaggagtgctttacttccaactatgtggtcagttttgtaataagtacagcgttgtgctgagaagaatgtatattcttttgatttggagtggagagttctgtagatgtctattagatccacttggtgcagagctgagttcaattcctggatatccttttaactttctgtcttatgaatctgtctaatgttgacagtggggtgttaaagtgtcccattattattgtgtgggagtctaagtctctttgtaagtctctaaggacttactttatgaatctgggtgctcctgtattgggtgcatatatatttaggatagttagctcttcttgttgaattgatccctttacgattatgtaatggccttctttgtctcttttgatcgttgttggtttaaagtctgttttatcggagactaggattgtaacccctccttttattttgttttccatttgcttggtaagtcttcctccatccctttattttgagcttatttgtgtctctgcacgtgagatgggtctcctgaatacagcacactgatgggccttgcctctttatccaatttgccagtctgtgtctttttattggagcatttagcccatttacatttaaggttaatattgttatgtgtgaatttgatcctgtcgttaagatgttagctggttattttgctcattagctgatgcagtttcttcctagcattgatggtctttacaatttggcatgtttttgcagtggctggtactggtggttcctttccatgtttagtgcttccttcaggagctgttgtaaggcaggcctggtggcgacaaaatctctcagcatttgcttgtctgtaaaggattttatttctccttcacttatgaagcttagtttggctgcatatgaaattctgggttgaaaattcttttctttaagaatgttgaatattggcccctactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttactcttctcgaggagtatctttgtggtgttctctgtatttcttgaatttgaatgttggcctgccttgctgggttggggaagttctcctggataatatcctgcagagtgttttccaacttggttccattctccccatcactttcaggtacaccagtcagacgtagatttggtcttttcacatagtcacatatttcttagaggctttgttcatttctttttactcttttttctctaaaattctcttctgcttcatttcattcattttaccttcaatcactaatactctttcttccacttgatcaaatcagctactgaagcttgtgcatgcatcacgtagttcttgtgttatggttttcagctccatcaggtcatttaaggacttctctgcactgcttattctagttagccattcgtctaatcttttttcaaggtt

SEQ ID NO: 12440 - DNA, 5310 bp, Homo sapiens
tttatttatttattttattattatactttaagttatggggtacatgcgcacaacgtgcaggtttgttgcatatgtatacatgtgccatgttggtgtgctgtacccattaatttgtcattcaattaggtatatctcctagtggtatccctccccacaccccccaccctatgacaggccccagtatgtgatgttccccaccctgtgtccaagtgttctcattgttcaattcccacctatgagtgagaatatgcagtgtttggttttctgtccttgcgatagtttgctcagaatgatggtttccagcttcatccatgtccctacaaaggacatgagctcatcattttttatggctgcatagtattccatggtgtatatgtgccacattttcttaatccagtctatcattgttggacatttgggttggttccaagtctttgctattgtgaatagtgccgcaataaacatatgtgtgcatgtgactttatagcagcatgatttataatcctttgggtatatgcccagtaatgggatggctgggtcatatggtatttcttgttctggatccttgaggaatcaccacactgtcttccacaatggttgaattagtttacattcccaccaacagtgtaaaagcattcctatttctccacatcctctccagcacctgttgtttcctgactttttaatgatctccatgctaactggcatgagatgtgtggttttgatttgcatttctctgatggccagtgatgatgagcattttttcacgtatctgttggctgcataaatgtcttcttttgagaagtgtctgttcatatccttcgcccactttttgatggggttgttttattttttcttgtaaatttgtttaagttctttgtagattctggatattagccctttgtcagatgggtagattgtaaaaattttctcccattctgtaggttgcctgttcactcagatggtagtttattttgctgtgcagaagctctttagtttaattacatcccattggtcaattttggcttttgttgccattgcttttggtgttttagtcatgaagtccttgcccatgcctatgtcctgaatggtattacctaggttttcttctagggtgtttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatggttgtagatgtgtggtattatttccgagggctctgttctgttccattggtctatatctctgttttggtaccagtaccatgttgttttggttactgtagccttgtactatagtttgaagtcaggtagcgtgatgcctccagctttgttcttttggcttaggattgtcttggcaatgcagactcttttttggttccatatgaactttaaagtaattttttccaattctgtgaagaaagtcattggtagcttgatggggatggcattgagtctataaattaccttgtgcagtatggccattttcacaatattgattcttcctacccatgagtatggaatgttcttccatttgtttgtgtcctcttttatttcattgagcagtggtttgtagttctccttgaagaggtccttcatgtcccttgtaagttggattcctaggcattttattctctttgaagcaattgtgaatgggagttcactcatgatttggctctctgtttgtctgttattggtgtataagaatgcttgtgattttcgcacattgattttgtatcctgagactttgctgaagttgcttatcagcttaaggagattttgggctgagaggatagggttttctaaatatacaatcatgtcatctgcaaacaggaacaatttgacttcctcttttcctaattgaataccctttatttctttctcttgcctgattgccctggccagaacttccaacactctgttgaataggagtggtgagagagggcatccctgtcttgtgccagttttcaaagggaatgcttccagtttttgcccattcagtatgatattggctgtgggtttgtcataaatagctcttattattttgagatatgtcccatcaatacctagtttattgagaggttttagcatgaaggactgttgaattttgtcaaaggccttttctgcatctattgagataatcacgtggtttttgtctttggttccgtttatatgatggattccatttattgattcgtgtatgttgaaccagccttgcatccaagggaggaagccaacttgatcgtggtggataggctttttgatgtgctgctggattcggtttgccagtattttatggaggatttttgcatcgatgtttatcagggatattggtctaaaattctctttttttgttgtgtctctgccaggttttggtatcaggatgatgttggcctcataaaatgaattagggaggattccctctttttctattgattggaatagtttcagaaagaatggtactagctcctctttgtacctctggtagaattcgggtgtgaatctgtctggtcctggactgtttttggttggtaggctattaattattgcctcaatttcagaacctgttattggtctattcagggattcaacttcttcccagtttagtgttgggagggtgtgtgtgtccaggaatttatccatttcctctagattttccagttttttttttttttggtgtagaggtgtttatagtattttctgatggtaggttgtatttctgtgggatcgatggtgatatcccctttatcattttttattgcatctatttgattcttctctcttttcttctttattagtcttgctagcggtctatcagttttgttgatcttttcaaaaaaccagctcctggattcattgatttttttttttggttttttaattaattaatttatttatttttttattattatactttaagttttagggtacatgtgcacattgtgcaggttagttacatacgtatacatgtgccatgctagtgtgctgcacccactaacttgtcgtctagcattaggtatatctcccaatgctgtccctcccccctccccctaccccgcagcagtccccagagtgtgatgttccccttcctgtgtccatgtgatctcattgggattcattgattttttgaagggttttttgtgtctctatctccttcagttctgctctgttcttagttatttcttgccttctgctagcttttgaatgtgtttgctcttgcttctctggttcttttaattgtgatgttagggtgtcaattttagatcttacctgctttctcttgtgggcatttagtgctataaatttccttctacacactgctttaaatgtgtcccagagattctggtatgttgtgtctttgttctcattggtttcaaagaacatctttatttctgccttcattttgtcatgtacccagtagtcattcaggagcaggttgttcaatttccatgtagttgagtggttttgagtgagtttcttaatcctgagttctagtttgattgcactgtggtctgagagacagttttatataatttctgttcttttacatttgctgaggagtgctttacttccaactatgtggtcaattttggaataagtgcgatgtggtgctgagaagaatgtatattctgttgatttggggtggagagttctgtagatgtctattaggtctgcttggggcagagctgagttaaattcctggttatccttattaactttctgtcttgttgatctgtctaatgttgacagtggggtgttaaagtctcccattattattgtatgggagtctaagtctctttgtatgtcactaaggacttgctttatgaatctgggtgctcctgtattgggtgcatatatatttaggatagttagttcttcttgttgaattgatccctttaccattatgtaacgacattctttgtctcttttgatctttcttggtttaaagtctgttttatcagagactaggattgcaacccctgcttttttttgttttccatttgcttggtagatcttctgccatccctttattttgagcctgtgtgtgtctctgcacgtcagatgggtctcctgaatacagcacactgatgggtcttgagtctttatccaatttgccagtctgtgtcttttaattggagcatttagttcatttacatttaaggttaatattgttaagtgtgaatttgatcctgtcattatgatgttagatggttattttgctcattagttgatgcagtttcttcctagcattgatggtttttacaatttggcatgtttttgcagtggctggtaccggttgttcctttccatgtttagtgcttccttcaggagttcttttagggcaggcctggtggtgacaaaatctgtcagcatttgtttgtctataaaggattttatttctccttcacttatgaagcttagtttggctggatatgaaattctggattgaaaattcttttctttaagaatgttgattattggcccccactctcttctggcttgtagagtttctgccgagagatccgctgttggtctgaatggcttcactttgtgggtaacccgaactttctctctggctgcccttaacatttttttccttcatttcaactttggtgaatctgacaattatgtgccttggagttgctcttctcaaggagtatctttgtggcattctctgtatttcctgaatttgaatgttagcctgcctcactagtttggggaagttctcttggataatatcctgcagaatgttttccaacttggttacattctccccatcactttcaggtacaccagtcagacgtagatttggtcttttcacatagttccatatttcttggaggctttgttcatttctttttactcttttttctctaaacttctcttctcacttcatttcattcatttgatcttcaatcactgataccctttcttccacttgatctaatcggctactgaagcttatgcatgcatcacatagttctcatgccatggttttcagctccatcaggtcatgtaaggacttttctacactgtttattctagttagccattcgtctaatctttttttcaaggtttttagcttctttgcgatgggttcgaacatcctcctttagctcggagaagtttgttattactgattgtctgaagcctttttctctcaattcatcaaagtcattctgcatccagctttgt

SEQ ID NO: 12441 - DNA, 4835 bp, Homo sapiens
tttatttattattatactttaagctctatggtatgtgtgcacaacgtgcaggtttgttacatatgtatacatgtggcatgttggtgtgctgcacccattaactcgtcatttacattaggtatttctcctaatgcaatccctccccactcccccaaccccacgacaggccctggtgtgtgatgattcccaccctgtgtccaagggttcccattgttcaattcccacctatgagtgagaacatgtggtgtttcgttttctgtccttgcgatagtttgctcagaatgatggtttccagctttatccatctccctacaaaggacatgaactcatcattttttatggctgcatagtattccatgatgtatatctgccacatgttcttaatccagtctatcactgatggacatttgggttggttccaagtctttgcaattgtgaatagtcccacaataagcatatgtgtgcatgagtctttataatagcatgatttataatcctttgggtatacccagtaatgggatcactgggtcaaatggtatttctagttctagatccctgaggaatcaccacactgtcttccacaatggttgaactagtttacagtcccaccaagagtgtaaaagtgttcctatttctccacatcctctccagcacctgttccctgactttttattgatccccattctaactggtgtgagatggtatctcattgtggttttgatttgcatttctctgatggccagtgatgctgagcattttttcacgtgtctgttggctgcataaatgtctttttttaagaagtgtgtgtttatattcttcgccccctttttgatggggttgtttgattttttcttgtaaatttgtttaagttctttgtagattgtggatattagccatttgtgagatgggtagattgcaaaattgttctcccattctgtaggttgcctgttcactctgatggtagtttcttttgctgtgcagaagctctttagtttaattagatcccatttgtctattttggctttagttgctattgcttttggtgttttagtcatgaagtccttgtccatgcctatgtcctgaatggcattgccttggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatagttgtagatatgtggtattatttctgagggctctgttctgttccattgttctgtatctctgttcggtaccagtcccatgctgttttggttactatagccttgtagtatagtttgaagtcaggtagaatgatgcctccagctttgttctttttgcttaggattgtcttggcaatgcgggctcttttttggttccacatgaactttaaagtagttttttccaattctctgaagaaagtcattggaagcttgatggggatggcattgaatctataaattcccttggccagtatggccgttttcacgatattgattcttcctttccacgagcatggagtattcttccatttgcttgtgttctcttttattttattgaacagtggtttgtagttctccttgaagaggtccttcacttcccttgtaagttggattcctaggtattttataccgtttgaagcaattgtgaatgggagttcactcatgatttgcctctatgtttgtctgttattggtgtataggaatgcttgtgatttttgcatattgattttgtatcctgagacttagctgaagttgcttatcagcttaaggagattttgggctgagaggatggagttttctaaatatacaatcatgtcatctgcaaacagggacaatttgacttcctcttttcctaattcaataccctttatttctttcgcttgcctgattgccctggccagaacatcgaaaacactatgttgaataggagtggtgagagagggcatctctgtcttgtgccagttttcaaagggaatgcttccagtttttgcccattcagtataatattggctgtgggtttgtcataaatagctcttattattttgagatagatcccatcaatacctagtttattgagagtttttaacatgaagggatgttgaattttatcaaaggccttttctgaatctattgagataatcatgtggtttttgtctttggttctgtttatatgctggattacatttattgatctgtgtatgttgaaccagccttgcatcccaggaatgaagccaacttgatcgtggtggataagctttttgatgtgctgctggatttggtttgccagtattttattgaggatttttgcatcgatattcatcaaggatattggtctaaaattctcttttttttgttgtgtctctgccaggctttggtatcaggatgatgctggcctcataaaatgagttagggaggattccctctttttctattgattggaatagtttcagaaggaatggtaccagctcctctttgtacctctggtagaatttggctgtgaatccgtctggtcctggagtttttttggttggtaggctattaattattgcctcaatttcagagcctgttattggtctattcagggattcaacttcttcctggtttagtcttgggagggtatgtgtccaggaatttatccatttcttctagattttctagtttatttgcatagaggtgtttatagtattctctgatagtagtttgttttttttgggatcggtggtgatatcccctttatcattttttattgcatctatttgattcttctctcttttcttccattagtcttgctagcaatctatctattttgttgatcttttcaaaaaccagctcctggattcattgattttttcaagggtttttttttttttttttttttgtctctatctccttcagttctgctctgatcttagttatttcttgccttctgctagcttttgaatgtgtttgctcttgcttctctagttcttttaattgtgatgttagggtgtcaattttagatcttgcctgctttctcttgtgggcatttagtgctaaaaatttccctctacacactgctttaaatgtgtcccagagattctggtatgttgtgtctttgttctcattggtttcaaagaatatctttatttctgccttcctttcgttatttgcccagtagtcattcaggagcaggttgttcagtttccatgtagttgtgcagttttgagtgagtttcttaatcttgagttctaatttaattggactgtcttctgagagacagtttgttatgatttctcttcttttacatttgctgaggagtgctttacttccaactatgtggtcacttttggaataagtgcaatgtggtgctgagaagaatgtatattctgctgatttggggtggagagttctgtagatgtctattaggtccgcttggtgcagagctgagttcaagtcctggatatccttgttaactctctgtctcgttgatctgtctaatgttgacagtgggatgttaaactctcccattattattgtgtgggagtctaagtctttttgtaggtctctaaggacttgctttatgaatctgggcactcctgtattgggtggatatatatttaggatagtgtgctcttcttgttgaattgatccctttaccattatgtaatggccttctttgtctcttttgacctttgttggtttaaagtctgttttattagtaaccaggatcacaacccctgcttttttttgtcttccatttgcttagtagatcttcctccatccctttattttgagcctatgtgtgtctctgcacgtgagatgggtctcctgaatacagcacactgatgcatcttgactctttatccaatttgccagtctgtgtcttttaattggggcatttagcccatttacatttaaggttaatattgttatgtgtgaatttgatcctgtcattatgatgttagctggatatgttgctcattagttgatgcagtttcttcctagcatcaatggtctttacaatttggcatgtttttgcagtggctggtaccagttgttccttttcatgtttagtgcttccttcaggaactcttgtaaggcaggcctggtggtgacaaaatctctcagcatttgcttgtctgtaaaggtatttatttctccttcacttatgaagcttagtttggctggatatgaaattctgggttgaaaattcttttctttaagaatgttgaatattggcccccactttcttctggcttgtagattttctgcggagagatctgctgttagtctgatgggcttccctttgtgggtaagccaacctttctctctggctgcccttaatattttttccttcatttcaaacttggtgaatctgacaattatgtgtcttggggttgctcttctcaaggagtatctctgtggcattctctgtatttcctgaatttgaatgttggcctgccttgctagattggggaagttctcctggataatatcctgaagagtgtttttccaacttagttccattctccccatcactttcaggtacaccaaacaaacatagatttggtcatttcacttagtcccatatttcttggaggctttgttcatttctttttactcttttttctcaaaacttctcttctctcttcatttcactcatttgatcttcaatcactgataacccttcttccagttgatcgaattggctactgaagcttgtgcatgtgtcacatagttctc

SEQ ID NO: 12442 - DNA, 5909 bp, Homo sapiens
ttttttttatttttttattttattttattattattatactttaagttttagggtacaagtgcacaatgtgcaggttagttacatatgtatacatgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatcagtaagaatatgcggtgtttggttttatgttcttgcgatagtttactgagaataacaatttccaatttcatccatgtccctacaaaggacatgaactcatcattttttatggctgcatagtattccatgatgtatatgtgccacattttcttaatccagtctatcattgttggacatttgggttggttccaagtctttgctattgtgaatagtgccgcaataaacatacgtttgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacaatgtaaaactgttcgtatttctccacatcctctccagcacctgttgtttcctgactttttaatgattgccattctaactggtgtgagatggtatctcattgtggttttgatttgcatttctctgatggccagtgatgaagagcactttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgtgcactctgatggtattttcttttgctgtgcagaagctctttagtttaattagatcccatttgtcaattttggcttttgttgtcattgcttttggtgttttagacatgaagtctttgcccatgcgtatgtcctgaatggtaatgcctaggttttcttctagggtttttatggttttaggtctaacgtttcagtctttaatccatctcgaattaatttttgtataaggtgtaaggaagggatccagtttcagctttctacatatggctagccagttttcccagtaccatttattaaatagggaatcctttccccattgcttctttttctcaggtttgttaaagatcagatagttgtagacatgcggcgttatttctgagggctctgttgtgttccattgatctatatctctgttttggtaccagtgccatgctgttttggttactgtagccttgtagtatagtttgaagtcaggtagcgtgatgcctccagctttgttcttttggcctaggattgacttggcgatgtgggctcttttttggttccatatgaactttaaagtagttttttccaattctgtgaagaaagtcgttggtagcttgatggggatggcattgaatctataaattgccttgggcagtatggccattttcacgatgttgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtccaatcaacacctaatttattgagagtttttagcctgaagggttgttgaattttgtcaaaggccttttctgcatctgttgaggtaatcatgtggtttttgtctttggttctgtttatatgctggattacatttattgatttgtgtatgttgaaccagccttgcatcccagggatgaagcccacttgatcatggtggataagcttttcgatgtgctgctggattcggtttgccagtattttattgaggatttttgcatcaatgttcatcaaggatattggtctaaaattctcttttttggttgtgtctctgcccggctttggtatcaggatgatgctagcctcataaaatgagttagggaggattccgtctttttctattgactggaatagtttcagaaggaatggtaccagttcctccttgtacctctggtagaattcggctgtgaatctatctggtcctggactctttttggtcagtaagctattgattattgccacaatttcagagcctgttattggtctattcagagattcaacttcttcctggtttagtcttgggagggtgtatgtgtcgaggactttattcatttcttctagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagcggtctatcaattttgttgatcctttcaaaaaaccagctcttggattcgttaattttttgaagggttttttgtgtctctatttccttcatttctgctctgattttagttatttcttgccttctgctagcttttgaatgtgtttgctcttgcttttctagttcttttaattgtgatctcagggtgtcaattttggatctttcctgctttctcctgtgggcatttagtgctataaatttccctctacacagtgctttgaatgtgtcccagagattctggtatgttgtgtctttgttctcattggtttcaaagaacatctttaattctgccttcatttcgttgtgtacccagaagtcattcaggagcaggttgttcagtttccatgtagttgtgcggttttgattgagtttcttaatcctgagttctagtttgattgcactgtggtctgagagatagtttgttataatttctgatcttttacatttgctgaggagtgctttacttccaactatgtggtcaattttggaataggtgtggtgtggtgctgaaaaaaatgtattttctgttgatttggggtggagaattctgtagatgtctatcaggtccacttggtgcagagctgagttcaattcctgggtatccttattaactctctgtctcgttgatctgtctaatgttgacagtgggatgttaaagtctcccattatttttgtgtgggaatctaagtctctttgtaggtcactcaggacttgccttatgaatctgggtgctcctgtattgggtgcatatatatttaggatagttagctcttcttgttgaattgatccctttaccaatatgtaatggccttctttgtctcttttgatctttgttggtttaaagtgtgttttatcagagactaggattgcaacccctgcctttttttgttttccattggcttggtagatcttcctccatccttttattttgagcctatgtgtgtctctgcacgtgagatgggtttcctgaatacagcacactgatgggtcttggctctttatccaacttgccagtctgtgtcttttaattggagcatttagttcatttacatttaaggttaatattgttatgtgtgaatttgatcctgtcatgatgatgttagctggttattttgctagttagttgatgcagtttcttcctagcctcgatggtctttacaatttggcatgtttttgcagtggctggtaccggttgttcctttccgtgtttagtgcttccttcaggatctcttgtagggcaggcctggtggtgacaaaatctctcagcatttgcttgtctgtaaaggattttatttctccttcacttatgaagcttagtttggctggatatgaaattctggattgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggtagttctcctggataatatcctgcagagtgttttccaacgtggttgcattctccccgtcactttcaggtacaccaatcagacatagatttggtcttttcacatagtcccatatttcttggaggctttgtttgtttctttttattcttttttctctaaacttcccttcttgcttcatttcattcatttcatcttccatcactgataccctttcttccagttgattgcatcggctcctgaggcttctgcactcttcatgtagttcttgagccttggctttcatctccatcagctcctttaagcacttctctgtattgattattctagttatactttcgtctaaatttttttcaaagttttcaacttctttgcctttggtttgaatttcctcctgtagctcggagtagtttgatcgtctgaagccttcttctctcaactcgtcaaaggcattctccgtccagctttgttctgttgctggtgaggagctgcgttcctttggaggaggagaggcgctctgctttttagagtttccagtttttctgctctgttttttccccatctttgtggttttatctatttttggtctttgatgatggtgatgtacagatgggattttggtgtggatgtcctttctgtttgttagttttccttctaacagacaggaccctcagctgcaggtctgctggagtttgctagaggtctactccagacactgcttgcctgggtaccagcagcggtggctgcagaacagcggattttcgtgaaccgcgaatgctgctgtctgatcgttcctctggaagttttgtctcagaggagtacccggccatgtgaggtgtcagtctgcccctgctggggggtgccttccagttaggctgctcgggggtcaggggtcagggacccacttgaggaggcagtctgcccgttctcagatctccagctgcgtgctgggagaaccactgctctcttcaaagctgtcagacagggacgtttaagtctgcagaggttactgctgtctttttgtttgtttgtgccctgcccccagaggtggagcctacagaggcaggcaggcctccttgagctgtggtgggctccacccagttcgagcttcagggctgctttgtttacctaagcaagcctgggcaatggtgggcacccatcccccagcctcgctgccaccttgcggtttgatcacagactgctctgctagcaatcagcgagactccatgggcgtaggaccctctgagccatgtgcgggatataatctcctggtgcgccgttttttaagcccaccggaaaagcgcagtattggggtgggagtgaccc

SEQ ID NO: 12443 - DNA, 5605 bp, Homo sapiens
tttttattttatttttaatttatttatatatatatacatatattttttattatagtttaagttttagggtacatgtgcacaacgtgcaggttagttacatacgtatacatgtgccatgttcgtgtgctgcacccattaactcgtcatttaacattaggtatatctcctaatgctatccctcccccctccccccaccccacaacaggccccggtgtgtgatgttccccttcctgtgtccatgtgttctcactgttcaattcccacctatgagtgagaacatgcggtgtttggttttttgtccttgtgatagtttgctgagaatgatggtttccagcttcatccgtgttcctacaaaggacatgaactcatccttttttatggctgcatagtattccctggtgtatatgtgccacattttcttaatccagtctatcattgttggacatttgggttggttccaagtctttgctattgtgaatagtgctgcaataaacatacgtgtgcatgtgtctttatagcagcatgatttataatcctttgggtatatacccagtaatgggatggctgggtcaaatggtatttctacttctagatccttgaggaatcaccacactgtcttccacaatggatgaactagtttacagtcccaccaacagtgtaaaagtgttcctatttctccacatcctctccagcacctgttgtttcctgactttttaatgattgccattctaactggtgtgagatggtatctcattgtgcttttgaattgcatttctctgatggccagggatgatgagcattttttcatgtgtctgttggctgcctaaatgtcttcttttgagaagtgtctgttcatatcctttgcccactttttgatggggttgtttgtttttttcttgtaaatttgtttgagttcattgtagattctggatatagcactttgtcagatgagtagattgcaaaaattttctcccattttgtaggttgccttttcactctgatggtagtttcttttgctgtgcagaagctctttcatttaataagatcccatttgtcaattttggcttttgttgccattgcttttggtgttttagacattgaagtccttgcccatgcctatgtcctgaatggtattgcctaggttttcttttagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatatgtggcattatttctgagggctctgttctgttccattggtctatatctctgttttggtaccagtaccatgctgttttggttattacagccttgtagtatagtttgaagtcaggtagcatgatgcctccagctttattcttttggcttaggattgacttggcaatgtgggctgttttttggttccatatgaactttaaagtagttttttccaattctgtgaagaaagtcattggtagcttgatggggatggtattgaatctataaattaccttgggcagtatggccattttcacgatattgattcttcctacccatgagcatggaatattcttccatttgtttgtatcctcttttatttcattgagcagtggtttgtagttccccttgaagaggtccttcacatcccttgtaatttggattcctaggtattttattctctttgaagcaattgtgaatgggagttcactcatgatttggctctctgtttgtctgttattggtgtacaagaatgcttgtgattttcgcacattgattttgtatcctgagactttgctgaagttgcctattagcttaaggagattttgggctgagacgatggggttttctcaatatacagtcatgtcatctgcaaacagggacaatttgacatcctcttttcctaattgaataccctttatttccttctcctgcctgattgccctggccagaacttccaacactatgttaaataggagtgctgagagagggcatccctgtcttgtgccagttttcaaagggaatgcttccaggttttgcccattcagtatgatattggctgtgggtttgtcataaacagcttttaatattttgagatacgtcccatcaatacctaatttattgagaggttttagcatgaagcgttgttgaattttgtcaaaggccttttctgcatctattgagataatcatatggttttgtcgttggttctgtttatatgctggattatgtttattgatttgcgtatgttgaaccatccttgcatcccagggatgaagcccacttgatcatggtggataagctttttgatgtgctgctagattctgtttgccagtattttattgaggatttttgcatcgatgttcatcagggatattggtctaaaattctcttttttttgttgtgtctctgccaggctttagtatcaggatgatgctggcctcataaaatgagttagggaggattccctctttttctatcgattggaatagtttcagaaggaatggtaccagctcctccttgtacctctggtagaatttggctgtgaatccatctggtcttggactttttttggttggtaagctattaattattgcctcaatttcagagcctgttattggtctattcagagattcagcttcttcatggtttagtcttgggtgggtgtatgtgtccaggaatttacccatttcttctagattttctagtttattttcataggggtgtttatagtattctctgatggtagtttgtatttctgtgggatcggtggtgatatcccctttatcattttttattgcgtctatttgatttttctctcttttcttctttattagtcttgctagcggtctatcaattttgttgatcttttcaagaaaccagctcctggattcattgattttttgaagggtttttttgtatctctatttccttcagttctgctctgatcttagttatttcttgccttctgctagcttttgaatgtgtttgctcttgcttctctagttcttttaattgtgatgttagggtgtcaattttagatctttcctgctttctcttgtgggcatttattgctataaatttccctctacacactgctttgaatgtgtcccagagattccgatatgttgtgtctttgttctcgttggtttcaaagaacatctttatttctgccttcatttcgttatgtacccagtagtcattcaggagcaggttgttcagtttccatgtagctgagcggttttgaatgagtttcttaattctgagttctagtttgattgcactgtggtctgagagacagtttgttataatttctgttcttttacatttgctgaggagtgctttacttccaactatgtggtcaattttggaataagtgtggtgtggtgctgtgaagaatgtatattctgttgatttggggtggagagttctgtagatgtctattagaaccacttggtgcagagctgagttcaatcctggatatcctcattaactttctgtctcgttgatgtgtctaatgttgacagtggggtgttaaagtctcccattattattgtgtgggaatctaagtctctttgtaggtctctaaggacttgctttatgaatctgggtgctcctgtattgggtgcatatatatttaggatagttagttcttcttgttgaattgatccctttaccattatgtaatggccttctttgtctcttttgatctttgttggtttaaagtctgttttatcagagactaggattgcgacccctgcatttttttgctttccatttgcttggtagatcttcctccatccctttattttgaacctatgtgtgtctctgcacgtgagatgggtttcctgaatacagcacactgatgggtcttgactctttatccaatttgacagtctgtgtcttttaattgggacatttagcccattacatttaaggttaatattgttatgtgtgaatttgatcctgtcattatgatgttagctggttattttgcttgttagttgatgcagtttcttcctagcctcgatggtctttacaaattggcatgtttttgcagtggctggtaccggttgttcctttccatgtttagtgcttccttcaggagctcttttaggtgaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagttactgccaagagatcagctgttagtctgatgggcttccctttgtgggtaacctgacctttctctctggctgccattaacattttttccttcatttcaactttagtgaatctgacaattatgtgtcttggagttgctcttctcgaggagtatctttgtggcattctctgtatttcctgaatttgaatgttggcctgctttgctagattggggaagttctcctggataatatcctgcagaatgttttccaacttggttccattctccccgtcactttcaggtacaccaatcagacgtagatttggtcttttcacagagtcccatatttcttggaggctttttttgtttctttttattcttttttctctaaacttctctcgtcatttcatttcattaatttgatcttccatcactgataccctttcttccagttgattgaattggctactgaggcttgtgcattcgtcatgtagttcttgtgccttggttttcagctccatcaggtcctttaaggacttctctcattggttattctagttagccattcatctaatttttttcaaggtttttaacttctttgccatgggttcgaacttcttcctttagctcggagtagtttcatcatctgtagccttcttctctcaactcatcaaagtcattctccatccagctttgttccattgctagtgaggagctgcgttcctttggaggaggagaggtgctctgatttttagagtttccagttttgctgctctggtttttccgcatcttttggttttatctacctttggtctttgatgatggtgacgtacagatggggttttggtgtggatgtcctttctgtttgttagttttccttctaacagtcaggaccctcagctgcaagtctgttggagtttgctggaggtccactccagagcctgtttgcctggatatcagcagtggaggctgcagaacagcagatattggtgagcagcaaatgttgctgcatgatcattcctctggaagttttgtctcagaggattacctggccatgtgaggtgtcagtttgcccctacttgggggtgcctaccagttaggctacttgggggtcagggacccacttgaagagggtccattctcagatctccagctgcgtgctgggagaaccactactctcttcaaagctgtcagacagggacatttaagtctgcagaggattctgctgccttttgt

SEQ ID NO: 12444 - DNA, 6499 bp, Homo sapiens
tttagttttttagttttttttttattattattatactttaagttttagagtacatgtacacaatgtgcaggttagttacatatgtatacatgtgacatgctggtgtgctgcacccattaactcgtcatttagcattaggtatatctcctaatgctatccctcccccctccccccaccccacagcagtccccagagtgtgatgttccccttcctgtgtccatgtgttctcattcttcacttcccacctatgagtgagaatatgcagtgtttggttttttgttcttgtgatattttactgagcatgatgatttccaatttcatccatgtccctacaaaggacatgaactcatcatttttttttttttttttttttttttttttttttttttttttgagacggagtctcgctctgtcgcccaggctggagtgcagtggcgggatctagggttactgcaagctccgcctcccgggttcacgccattctcctgcctcagcctcccaagtagctgggactacaggcgcctgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccagccgaactcatcattttttatggctgcatagtattccacggtgtatatgtgccacattttcttaatccagtctatcattgttggacatttgggttggttccaagtctttgctattgtgaatagtgccacaataaacatacttgtgcatgtgtctttatagcagcatgatctatagtcctttgggtatatacccagtaatgggatggctgggtcaaatggtatttctagttctagatccctgaggaatcaccacactgacttccacaagggttgaactagtttacagtcccaccaatggtgtaaaagtggtcctatttctccacatcctctccagcacctgttgtttcctgactttttaatgatcaccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttgtcttgtaaatttgtttgagttcattgtagattctggatattagcccttcgtcagatgagtagattgcaaaaattttctcccattttgtaggctgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctaatccatcttgaattaatttttgtataaggtgtaaggaagggatccagtttcagctttctacatatggctagccagttttcccagcaccatttattacatagggaatcctttccccattgcttgtttttctcaggtttgtcgaagatcagatagttgtagatgtgcggcgttatttctgagggctctgttctgttccattgatctatatctctgttttggtaccagtaccatgctgttttggttactgtagccttgtagtaggttgaagtcaggtagtgtaatgcctccagctttgttcttttggcttaggattgacttggcaatgtgggcttttttttggttccatatgaactttaaagtagttttttccaattctgtgaagaaagtcattggtagcttgatggggatggcattgaatctataaattaccttggtcaatatggccattttcacgatattgattcttcctacccatgagcatggaatgttcttccatttctttgtatcctcttttatttcattgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttatacattgattttgtatcctgagacttttggcttatcagcttaaggagattttgggctgagacaatggggttttctagatatacaatcatgtcatctgcaaacagggacaatttgagttcctcttttcctaattgaataccctttatttccttctcctgcctaactgccctggccagaacttccaacactatgttgaataggagtggtgagagagggcatccctgtcttggcgagttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaaaggccttttctgcatctattgagataaccatgtggtttttgtctttggttctgtttatatgctggattacatttactgatttgcgtatattgaaccagtcttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtgtcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattcgtctattcagagattcaacttcttcctggtttagtcttgggagggtgtatgtgtcgaggaatgtatccatttcttctagattttctagtttatttgcgtagaggtgtttgtagtattctctgatggtagtttgtatttctgtgggatcggtggtgatatccccttttatcattttttattgcatctatttgattcttctctcttttcttctttattagtcttgctagtggtcgatcaattttgttgatcctttcaaaaaaccagctcctggattcattaattttttgaagggttttttgtgtctctatttccttcagttctgttctgattttagttatttcttgccttctgctagcttttgaatgtgtttgctcttgcttttctagttcttttaattgtgatgttagggtgtcaattttggatctttcctgctttcttttgtgggcatttcatgctataaatttccctctacacactgctttgaatgtgtcccagagattctggtatgttgtgtctttcttcttgttggtttcaaagaacatctttatttctgtcttcatttcgttatgtacccagtagtcattcaggagcacgttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctggaaaaaatgtatattctgttgatttggggtggagagttctgtagatgtctattaggtctgcttggtgcagagctgagttcaattcctggatatccttgttgactttctgtctcgttgatctgtctaatgttgacagtggggtgttaaagtctcccattattattgtgtgggagtctaaatctctttgtaggtcactcaggacttgctttatgaatctgggtgctcctgtattgggtgcatatatatttaggatagtttgctcttcttgttgaattgatccctttaccattatgtaatggccttctttgtctcttttgatctttgttggtttaaagtctgttttatcagagactaggattgcaacccttgtcttttttttgttttccatttacttggtagatcttcctccatccttttattttgagtctatgtgtgtctctgcacgtgagatgggtttcctgaatacagcacactgatgggtcttgactctttatccaatttgccagtctgtgtcttttaattggagcatttagtccatttacatttaaagttgatattattatgtgtgaatttgatcctgtcattatgatgttcgctggttattttgctcgttagttgatgcagtttcttcctagcctcgatggtctttacaatttggcatgattttgcagtggctggtaccagttgttcctttccatgtttagtgcttccttcaggagctcttttagggcaggcctggttgtgacaaaatctctcagcatttgcttgtctgtaaaggattttatttctccttcacttatgaagtttagtttggctggatatgaagttctgggttgataattcttttctttaagaatgttgaatatcggcccccactctcttctggcttgtagagtttctgccaagagatccactgttagtctgatgggcttccctttgtgggtaacccgacctttctctctggctgcccttaacattttttccttcatttcaactttggtgaatctgacagttatgtgtcttggagttgctcttctcgaggagtatctttgtggcattctctgtatttcctgaatttgaatgttggcctgccttgctaggttggggaagttctgctggataatatcctgcggagtgttttccaacttggttccattctccccatcactttcaggtacaccaatcagatgtagatttggtcttttcacatagtcccatatttcttggaggctttgttcatttctttttattcttttttctctaaacttcccttctcgcttcatttcattcatttcatcttccatcactgataccctttctttcagttgatcgcatcggctcctgaggcttctgcattcctcacgtagttctcgagccttggctttcagctccatcagctcctttaagcacttctctgtattggttattctagttatacattcgtctaaatttttttcaaagtttttaacttctttgcctttgatttgaatttcttcctgtagctcggagtagtttgatcgtctgaagccttcttctctcaactcgtcaaagtcattctccatccagctttgttccgttgctggtgaggaactgcgttcctttggaagaggagaggcgctctgctttttagagtttccagtttttctgctctgttctttccccctctttgtggttttatcttcttttgttctttgatgatggtgatgtacagatgggtttttggtgtggatgtcctttctgtttgttagttttccttctaacagacaggaccctcagctgcaagtctgttggagtttgctagaggtccactccctaccctgtttgcccgggtaccagcagcggtagctgcacagcagcggattttcgtgaaccgtgaatgctgctgtctgatcgttcctctggaagttttttctcagaggagtacccggtcatgtgaggtgtcagtctgcccctactggggggtgcctcccagttaggctgctcaggggtcaggggtcagggacccacttgaggaggcagtctgcctgttctcagatctccagctgcgtgctaggagaaccactgctctcctcaaagctgtcagacagggacatttaagtctgcagaggttactgctgtctttttgtttgtctgtgccccgcccccagaggtggagcctacagaggcaggcaggcctccttgagctgtggtgggctccacccagttcgagcttcccggctgctttgtttacctaagcaagcctgggcaatggcgggcgcccctcccccagcctcactgccgccttgcagtttgatctcagactgctgtgctagcaatcagtgagactccgtgggcgtaggaccctccgagccaggtgcggcatataatctcctggtgcgccgttttttaagcccatcagaaaagcgcagtattcgggtgggagtgacccaattttccaggtgccgtctgtcacccctttctttgactaggaaagggaactccctgaccccttgcacttcccgagtgaggcaatgcctcgccctgcttcagctcgcacacggtgcgctgcacccactatcctgcacccactgtctggcactccctagtgagatgaacccggtacctcagatggaaatgcagaaatcacccatcttctgcgtcgctcacgctgggaactgtagaccggagctgttcctattcggccatctcggctcccacct

SEQ ID NO: 12445 - DNA, 5594 bp, Homo sapiens
ttttttgtttttctttttaattttattaatattatactttaagttttagggtacatgtgcacaacgtgcaggttggttacatatgtatacatgtgccatgttggtgtgctgcacccattaactcatcatttagcattaggtatatctcctaatgctatcccttccccctccccccaccccacaacagtccccggtgtgtgatgttccccttcctgtgtccatttgttctcattgttcaattcccgcccatgagtgagaacatgaggtgtttggttttttgtccttgcaatagtttgctgagaatgatggtttccagtttcatctatgtccctacaaaggacatgaactcatcctttttttatggctgcatagtattccatggtgtatatgtgccacattttcttaatccagtctatcattgttggacatttgggttggttccaagtctttgctattgtgaatagtgctgcaataaacatacatgtgcatgtgtctttataggagcatgatttataatcctttgggtatatacccagtattgggatggctgggtcaaatggtatttctagttctagatccttgagaaatctccacactgacttccacaatggttgaactagtttacagtcccaccaacagtgtaagagtgttcctatttctccacatcctctccagcacctgttgtttcctgactttttaatgatagtcattctaactggtgtgagatggtatctcattgtggttttgacttgcatttctctgatggccagtaatgatgagcattttttcatgtgttttttggctgcataaatgtcttcttttgagaattgtctgttcatatccttcgcccatttttgatggggttgtttgtttttttcttgtaaatttgttggagttcattgtagattctggatattagccctttgtcagatgagtaggttgcaaaaattttctaccattctgtaggttgcctgttcactctgatggtagtttcttttgctgtgcagaagctctttagtttaattagatcccatttgtcaattttggcttttgttgccattgcttttggtgtttcagacatgaagtccttgcccatgcctatgtcctgaatggtattgcctaggttttcttctagggtttttatggttttaggtctaacatgtaagtctttaatccatcttgaattaatttttgtgtaaggtataagaaagggatccagtttcagcgttctacatatggctagccagttttcccagcaccagttattcaatagggaatcctttccccatttcttgtttttctcaggtttgtcaaagatcagatagttgtagatgtaccgcattatttctgagggctctgttctgttacattggtttataactctgttttggtaccagtaccatgctgttttgtttactgtagccttgcagtatagtttgaagtcaggtagtgtgatgcctccagctttgttcttttggcttaggattgacttggcaatgcgggctcttttttggttccatatgaactttaaagtagttttttttttccaattctgtgaagaaagtcattggtagcttgatggggatggcattgaatctataaattaccttgggcagtatggccattttcacaatattgactcttcctactcatgagcatggaatgttctcccatttgtttgtatcctcttttatttcgatgagcagtggtttgtagttctccttgaagaggtccttcacgtcccttgtaagttggattcctaggtattttattctctttgaagcaattgtgaataggagttcactcatgatttggctctctgtttgtctgatattggtgtataggaatgcttgtgatttttgcaccttgattttgtatcctgagactttgctgaagttgcttatcagcttaaggagattttgggctgagacgatggggttttctagatatacagtcatgtcatctgcacacaggaaaaatttgacttcctcttttcctaattgaatgccctttatttccttctcctacctgattgccctggccagaacttccaatactatgttgaataggagtagtgagagaggacatccctgccttatgccagttttcaaagggaatgcttccagtttttgtccattcagtatgatgttggctgtgggtttgtcatagatagctcttattattttgagatgcgtcccatcaatacctaatttattgagagtttttagcatgaagggttgttgaattttgtcaaaggccttttctgcatctattgagataatcatgtggtttttgtctttggttctgtttatatgctggattacatttattgatttgcatatgttgaaccagccttgcatcccagggatgaagcccacttgatcattgtggataagctttctgatgtgttgctggattcactttgccagtattttattgaggatttttgcatcaatgttcatcaaggatattggtctaaaattctctttttttgttgtgtctctgcccggctttggtatcaggatgatgctggcctcataaaatgagttagggaggatttcctccttttccattgattggaatagttgcagaaggaatggtaccagctcctccttgtacctgtggtagaattcggctgtgaatccatctggtcctggactttttttggttggtaggctattaattattgcctcaatttcagagcctgttattggtctattcggagattcaacttcttcctggtttagtcttgggagggtgtatgtgttgaagaatgtatccatttcttctagattttctagtttatttgcatagaggtgtttatagtattctctgataatagtttgtatctctgtgggatcagtggtgatatctcctttgtcatttttttattgagtctatttgattcttctctcttttcttctttattagtcttgctagcagtctatcaattttgttgatcttttcaaaaaaccagctcctggattcattgatttttttgaagggttttttgtatctctatttccttcagttctgctctgatcttagttatttcttgccttctgctagcttttgaaggtgtttgctcttgcttctctagttcttttaattgtgatgttagggtgtcaattttagatctttcctgctttctcttatgggcatttactgctatacgtttccctctacacactgctttgaatgtgtcccagagattctggtatgttgtgtcttttttctcgttggtttcaaagaacatctttatttctgccttcattttgttatgtacccagcagtcattcaggagcaggttgttcagtttccatgtagttgagcagttttgagtgagtttcttaatcctgagttctagtttgatttcactgtggtctgagagacagttataatttctgttcttttacatttgctgaggagagctttagttccaactatgtggtaaattttggaataagtgtggtgtggtgctgagaagaatgtatattctgttgatttggggtggagagttctgtagatgtctattaggtcttcttggtgcagagctgagttcaattcctggatatccttgttaactttctgtctcattgatctgcctaatgttgacagtggggtgttaaagtctcccaacattattgtgtgggagtctaagtctctttgtaggtctctaatgacttgctttatgaatctaggttctcctgtattgggtgcatatacatttaggatagttagctcttcttgttgaattgatccctttaccattatgtaacagccttctttgtctcttttgatctttgttggtttaaagtctgttgaatcagagactaggattgcaacccctgcctttgtttttgatttgcttggtagatcttcctccatccctttattttgggcctatgtgtgtctctgcacgtgagatgggtttcctgaatacagcacactaataggtcttgactctttatccaatttgtctgtctgtgtcttttaaatggagcatttagcacatttacatttaaggttaatattgttatgtgtgaatttgatcctgtcgttatgatgttagctggttattttgctcattcgttgatgcagtttcttcctaaccttgatggtctttataatttggcatgtttttgcagtggctggtaccagttgttcctttccatgttttgtgcttccttcaggagctcttgtaatgcaggcctggtggtgacaaaatctctcagcatttgcttgtctgtaaaggattttatttctccttcacttatgaagcttaggttggctggatgtgaaattctgggttgaaaattcttttctttaagaacgttgaatattggcccccactctcttctggcttgtagagtttctgctgggagaccagctgttagtctgatgggcttccctttgtgggtaacctgacctttctctttggctacccttaccattttttccttcatttcaactttggtgaatctgacgattatgtgtcttggagttgctcttctcgaggagtatctttgtggcattctctgtatttcctgaatctgaatgttggcctgccttgctagattggggaagttctcctgggtaatatcctgcagggtgttttccaacttggttccattctccccgtcactttcaggtacaccaatcagacatagatttggtcttttcactagtcccttatttcttggaggctttgttcatttctttttattctttttttctctaaacttctcttcctgcttcatttcattcatttcatcttccatcactgataccctttcttccggttgatcgcatcggctactgatgcttgtgcattcatcacgtagttctcatgctgtggttttcagctccatcaggtcctttagggacttctctgcattggttattctagttagccattcgtctaatttttttcaaggtttttaacttctttgccattggttcaaacttactactttagcttggagtagtttgatcttctgaagccttcttctctcaactcatcaaagtcattctccatccatctttgttctgttgctggtgaggagctgcattcctttggaggaggagaggcgctctgatttttagagtttcctgtttttctgctctgttttttccccatctttgtggttttatctacctttggtctttgatgatggtgatgtacagatgggtttttggtgtgtatgtcctttctgtttgttagttttccttctaacagtcaggaccctcagctgcaggtctgttggagtttgctggaggtccactccagaccctgtttgcctgggtatcagcagtggtggctgcagaacagcagatattggtgaactgcaaatgctgctgcctgatcgttcctctggaagttttgtcttagaggagtacctggtcgtgtgagatgtcagtgtgcccctactggggggtgcctcccagttaggctgctcaggggtcagggacccacttgaggaggcagtctgtcttttctcagatctcaagctgcatgctgggagaaccactactttcttcaaagctgtcagacagggacatttaagtctgcagaggttactgctgccttttgt

SEQ ID NO: 12446 - DNA, 6053 bp, Homo sapiens
ttcttttttttttagtctttttttaaaaatttatttatttattattataatactttaagttttagggtacatgtgcacaatgtgcaggttagttacatgtgtatacatgtgccatggtggtgcgctgcacccactaactcgtcatccagcattaggtatatctcccaatgctatccctcccccctccccccaccccacaacaggccccagagtgtgatgttccccttcctgtgtccatgtgttctcattgttcaattcccacctgtgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggatatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatctctgaggaattgccacactgacttccacaatggttgaactagtttacagtcccaccaacagtgtaaaattgttcctatttctccacatcctctccagcacctgttgtttcctgactttttaatgattgccattctaactggtgtgagatggcatctcattgtggttttgatttgcatttctctgatggccagtgatggtgagcattttttcatgtgttttttggctgcataaatgtcttcttttgagaagtgtctgttcatatccttcgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataagctgtaaggaagggatccaatttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtactatgctgttttggttactgtagccttgtagtatagtttgaagtcaggtagtgtgatgcctccagctttgttcttttggcttaggattgatttggcaatgcgggctcttttttggttccatgtgaactttaaagtagttttttccaattctgtgaagaaagtcactggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggaattcactcatgatttggctctctgtttgtctgttgctggtgtataagaatgcttgtgatttttgtacattgattttgtatcctgagactttgctgaagttgcttatcagcttaaggagcttttgggctgagacaatggggttttctagatatacaatcatgtcgtctgcaaacagggacaatttgacttcctcttctcctaattgaataccctttatttccttctcctgcctaattgccctggccagaacttccaacactatgttgaataggagtggtgagagagggcatccctgtcttgtgccagttttcaaagggaatgcttccagttttggcccattcagtatgatattggctgtgggtttgtcatagatagctcttattattttgaaatacatcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttactgaggatttttgcatcaatgttcatcaaagatattggtctaaaattctcttttttggttgtgtctctgcccggctttggtatcaggatgatgctggcctcatgaaatgacttagggaggattccctctttttctattgattggaatagtttcagaaggaatggtaccagttcctccttgtacctctggtagaatttggctgtgaatccatctggtcctggactctttttggttggtaagctattgatcattgccacaatttcagatcctgttattggtctattcagagattcaacttcttcctggtttagtcttgggagagtgtatgtgtccagaaatttatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgttagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcctttaattgtgatgttagggtgtcaattttggatctttcctgctttctcttgtgggcatttagtgctataaatttccctctacacactgctttgaatgcgtccctgagattctggtgtgttgtgtctttgttctcgttggtttcaaagaacatctttatttctgccttcatttcattatgtatccagtagtcattcaggggcaagttgttcagtttccatgtagttgagccgttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagcctcccattattaatgtgtgggagtctaagtctctttgtaggtcactcaggacttgctttatgaatcttggtgctcctgtattgggtgcatataaatttaggagagttagctcttcttgttgaattgatccctttaccattatgtaatggccttctttgtctcttttgatctttgttggtttgaagtctgttttatcagagactaggattgcaacccctgcttttttttgttttccatttgcttggtagatcttcctccatccttttatcttgagcctatgtgtgtctctgcatgtgagatgggtttcctgaatacagcacactgatgggtcttgactctttatccaatttgccagtctgtgtcttttaattggagcatttagtccatttacattcaaagttaatattgttatgtgtgaatttgatcctgtcattatgatgttagctggtgattttgctcattagttgatggagtttcttcctagtcttgatggtctttacattttggcatgattttgcagtggctggtactggttgttcctttccatgtttagcgcttccttcaggagctcttttagggcaggcctggtggtgacaaaatctcttagcatttgcttgtctgtaacgtattttatttctccttcacttatgaagcttagtttggctggatatgaaattcggggttgaaaattcttttctttaagaatgttgaatattggcccccactctcttctggcttgtagggtttctgccgagagatccgctgttagtctgatgggcttccctttgagggtaacccaacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttagaggctttgctcatttctttttattcttttttctctaaacttcccttctcacttcatttcgttcatttcatcttccatcgctgataccctttcttccagttgatcgcatcggctcctgaggcttctgcattcttcacgtagttctcgagccttgcttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttccgttgctggtgaggaacttcatttctttggaggaggagaggcggtctgctttttagagtttccagtttttctgttctgttttttccccatctttgtggttttatctacttttggtctttgatgatggtgatgtacagatgggtttttggtgtggatgtcctttctgtttgtcagttttccttctaacagacaggacactcagctgcaggtctgttggagtaccctgccgtgtgaagtgtcagtgtgcccctgctggggggtgcctcccagttaggctgcttgggggtcaggggtcagggacccacttgaggaggcagtctgcctgttctcagatctccagctgtgtgctgggagaaccactgctctcttcaaagctgtcagacagggacatttaagtgtgcagaggttactgctgtctttttgtttgtctgtgccctgaggtggagcctacagaggcaggctggcctccttgagctgtggtgggctccacccagttcgagcttccaggctgctttgtttcagtaagcaagcctgggcaatggcgggcgcccctcccccagcctctctgccgccttgcagtttgatctcagactgctgtgccagcaatcagcgagactccgtgggcgtaggaccctctgatccaggtgcgggatataatctcctgatgcgccgttttttaagcctgtcggaaaagtgcagtattggggtgggagtgaccccattttccaggtgccgtccgtcacccctttctttgactcggaaagggaactccctgaccccttgcacttcctgagtgaggcaatgcctcgccctgcttcggctcgcgcacagtgcacgcacccactgacttgtgcccactgtgcggcactccctagtgagatgaaccccatacctcagatggaaatgcagaaatcactgtcttctgggtcgctcaggctgggagctgtagacctgagctgttcctattcggccatcttggctcct

SEQ ID NO: 12447 - DNA, 6040 bp, Homo sapiens
ttgacttttctttttttttttaatttaagttttagggtacatgtgcacattgtgcaggttagttacatatgtatacatgtgccacgctggtgcactgcacccactaactcgtcatctagcattaggtatatctcccaatgctatccctcccccctccccccaccccaccatagtccccagagtgtgatattccccttcctgtgtccatgtgatctcattgttcaattcccacctatgagtgagaatatgcggtgtttggttttttgttcttgcgatagtttactgagaatgatgatttccagtttcatccatgtccctacaaaggacataaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatgtctgggtcaaatggtatttctagttctagatccctgaggaatcaccacactgacttccacaatggttgaactagtttacagtcccaccaacagtgtaaaagtgttcctatttctccacgtcctctccagcacctgttgtttcctgactttttaatgattgccgttctaactggtgtgagatggtatctcattgcggttttgatttgcatttctctgatggccagtgatgattagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctcatggtagtttcttttgctgtgcagaagctctttagtttaattagatcccatttgtcaattttgtcttttgttgccattgcttttggtgttttggacatgaagtccttgcccatgcctatgtcttgaatggtgatgcctaggttttcttctagggtttttatggttttaggtctaacgtttaagtctttaatccatcttgcattgatttttgtataaggtgtaaggaagggatccagtttcagctttctacatacggctagccagttttccccgcaccatttattaaatacggaatcctttccctattgcttctttttctcaggtttgtcaaagatcagatagttatagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgccttggcaatgcgggctcttttttggttccgtatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacctcccttgtaagttggattcctaggtattttattctctttgaagcaattgtgaatgagagttcactcatgatttggctctctgtttgtctgttattggtgtataagaatgcttgtgatttttgtacattgattttatatcctgagactttgctgaagttgcttatcagcttaaggagattttgggctgagacaatggggttttctagatatacaatcatgtcatctgcaaacagggacaatttgacttcctcttttcctaattgaataccctttcttttcttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctgatagaattcggctgtgaatccatctggtcctggactctttttggttggtaaactattgattattgccacaatttcagctcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattaattttttgaagggttttttgtgtctctatttccttcagttctgctctggttttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtatccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccttttaccattatgtaatggccttctttgtctcttttgatccttgttggtttaaagtctgttttatcagacactaggattgcaacccctgcctttttttgttttccatttgcttggtagatcttcctccatctttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctctcattatgatgttagctggtgattttgctcgttagttgatgcagtttcttcctagtctcgatggtctttacattttggcatgattttgcagcggctggtactggttgttcctttccatgtttagctcttccttcaggagctcttttagggcaggcctggtggtgacaaaatctctcagcatttgcttgtctgtaaagtattttatttctccttcacttatgaagcttagtttggctggatatgaaattctgggttgaaaattctttcctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcaaggagtatctttgtggcgttctctgtatttcctgaatctgaacgttggcctgccttgctagattggggaagttctcctggataatatcctgcagagtgttttccaacttggttccattctccccatcactttcaggtacaccaatcagatgtagatttggtcttttcacatagtcccatatttcttggaggctttgctcatttctttttattcttttttctctaaacttcccttctcgcttcatttcattcatttcatcttccatcgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttgtcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagagatgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgctgtgggctccacccagttcgagcttccaggctgctttgtttacctaaggaagcctgggcaatggcgggcgcccctcccccagcctcgctgccaccttgcagtttgatctcagactgctgtgctagcaatcagcgagactccatgggcgtatgaccctctgagccaggtgcgggatataatctcgtggtgcgctgttttttaagccggtccgaaaagcgcaatattcgggtgggagtgacccgattttccaggtgcgtccctcacccctttctttgactcggaaagggaagtccctgaccccttgcgcttcccaagtgaggcaatgcctcgccctgcttcagctcgcgcacggtgcgcgcacccactgacctgcgcccactgtctggcactccctagtgagatgaacccggtacctctgatggaaatgcagaaatcacccgtcttctgtgtcgctcacgctgggagcggtagaccggagctgttcctattcggccatcttggctcctccccagcctt

SEQ ID NO: 12448 - DNA, 6050 bp, Homo sapiens
cttctttttttttttttttattatactttaagttttagggtacatgtgcacgttgtgcaggttagttacatatgtatacatgtgccacgctggtgcgctgcacccactaactcgtcatctagcattaggtatatctcccaatgctatccctcccccctccccccaccctaccacagtccccagagtgtgatattccccttcctgtgtccaggtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtttatcattgttggacatttgggttggttccaagtctttgctattgagaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgaaaagtgtctgttcatgtccttcgcccactttttgatggggttgtttgtttttttcttgtaaatttgtttgagttcattgtagattctggatattagccctttgtcagatgagtaggttgcgaaaattttctcccattttgtgggttgcctgttcactctgatggtagtttcttttgctgtgcagaagctcttgagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatacggctagccagttttcccagcaccatttattaaatagggaatcctttccccatttcttgtttttctcaggtttgtcaaagatcagacagttgtaggtatgcggcgttatttctgagggctctgttctgttccattgatctatatctctgttttggtaccagtaccatgctgttttggttactgtagccttgtagtaaagtttgaagtcaggtagtgtgatgcctccagctttgttcttttggcttaggattgacttggcgatgcgggctcttttttggttctatatgaactttaaagtagttttttccaattctgtgaagaaagtcattggtagcttgatggggatggcattgaatctgtaaattaccttgggcagtatggccattttcacaatattgattcttccgacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttgtcagcttaaggagattttgggctgaaacaatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatatatagctcttattattttgaaatacgtcccatcaatacctaatttattgagagtttttagcatgaagggttgttgaattttgtcaaaggctttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctctttttttgttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgcttattgccacaatttcagctcctgttattggtctattaggagattcaacttcttcctggtttagtcttgggagagtatatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctaattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttcttgttggtttcaaagaacatctttatttctgccttcatttcattatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattattgtgtgggagtctaagtctctttgtaggtcactcagaacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtactggttgttcctttccatgtttagcgcttccttcaggagctcttttagggcaggtctggtggtgacaaaatctctcagcatttgcttgtctgtaaagtactttatttctccttcacttatgaagcttagcttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttcccacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgacaccctttcttccagttgatcgcatcggctcctgaggcttctgcattcttcacgtagttctcgagccttggttttcagctccatcagctccttaaagcacttctctgtattggttattctagttatacattcttctaaatttttttcaaagttttcaacttctttgcctttggcttgaatgtcctcccatagctcagagtaatttgatcgtctgaagccttcttctctcagctcgtcaaagtcattctccatccagctttgttctgttgctggtgaggagctgcgttcctttggaggaggagaggtgctctgatttttagagcttccagtttttctgttctgttttttccccatctttgtggttttatctacttttggtctttgatgatggtgatgtacagatgggtttttggtgtggatgtcctttctgtttgttagctttccttctaacagacaggaccctcagctgcaggtctgttggaataccctgccgtgtgaggtgtcagtgtgcccctgctggggggtgcctcccagttaggctgctcaggggtcaggggtcagggacccacttgaagaggcagtctgccggttctcagatctccagctgcgtgctgggagaaccactgctcccttcaaagctatcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgctgccgccttgcagtttgatcacagactgctgtgctagcaatcagcgagattccgtgggcgtaggaccctctgagccaggtgtgggatatagtctcgtggtgcgccgttttttaagccggtctgaaaagcgcaatgttcgggtgggagtgacccgattttccaggtgcgtccgtcacccctttctttgactcggaaagggaactccctgaccccttgcgcttcccaggtgaggcaatgcctcgccctgctttggctcgctcaccgtgcgcgcacccactggcctgcgcccactgtctggcgctccctagtgagatgaacccggtacctcagatggaaatgcagaaatcaccgtcttctgcgtcggtcacgctgggagctgtagaccggagctgttcctattcggccatcttggctcctccccctcaaggcttcttt

SEQ ID NO: 12449 - DNA, 5159 bp, Homo sapiens
attctttttttttattattatactttaagttttagggtacatgtgcacaatgtgcaggtttgttacatatgtatacatgtgccatgttggtatgctgcacccattaactcgtcacttagcattaggtatatctcctaatgctatccctcccctatccacgcaccccacaacaggctccggtgtgtgatattccccatcctgtgtccatgtgttctcattgttcaattcccacctatgagtgagaacatgcagtgtttggttttttgtccttgcaatagtttgctgagaatgatggtttccagcttcatccatgtccctacaaaggacatgaactcatccttttttatggctgcatagtactccatgatgtatatgtgccacattttcttaatccactctatcattgttggacatttgggttggttccaagtctttgctattgtgaatagtgccgcaataaacatatgtgtgcatgtgtctttataggagcatgatttataatcctttgggtatatacccagtaatgggattgctgggtcaaatggtatttctagttctagatccctgaggaatcatcacactgacttccacaatggttgaactagtttacagtcccaccaacagtgtaaaagtgttcatatttctccacatcctctccagcacctgttgtttcctgacattttaatgatcgccattctaactggtgtgagatggtatctcactatggttttgatttgcatttctctgatggccagtgatgatgagcattttttcatgtgttttttggctgcataaatgtcttcttttgggaagtgtctgttcatatccttcatccacttgttgatggggttttttgtttttttcttgtaaatttgtttgagttcattgtagattctggatattagccctttgtcagaggagtagattgcaaaaattttctcccattctgtaggttgcctgttcactctgatggtagtttcttttgctgtgcacaagctctttactttaattagatcccaattgtcaatttttgcttttgttgccatggcttttggtgttttagacatgaagtccttgcccatgcctatgtcctgaatggtattgcctaggttttcttctagggtttttatggttttaggtctaacatttaaatctttaatccatcttgaattaattttagtataaagtgtaaggaagggatccagtttcagctttctacctatggttagccagttttcccagtagcatttattaaatagggaatcctttccccattgcttgtttttgtcagggttgtcaaagatcagatagttgtagatacgtggcattatttctgagggctctgttctgttccattggtctatatctctgttttggtaccagtaccatgctgttttggttactgtagccttgtagtatagtttgaagtcaggtagtgggatgcctccagctttgttcttttggcttaggattgacttggcaatgtgggctcttttgtggttccatatgaactttaaagtagttttttccaattctgtgaagaaagtctttggtagcttgatggggatggcattgaatctataaattaccttgggcagtatggccattttcacgatattgattcttcctacccatgagcatggaatgttcttccatttgtttgtatcctctcttatttcattgagcagtggtttgtagttctcattgaagaggtccttcacatcccttctaagttggattcctaggtattttattctctttgaagcaattgtgaatgggagatcattcatgatttggctctctgtctgttattagtgtataagaatgcttgtgatttttgtacattgattttgtattctgagactttgctgaagttgcttatcagcttaaggagattttgggctgagacaatggggttttctgatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtattatattggctgtgggtttgtcataaatagctcttattattttgagatatgtcccatcaatacttaatttattgagagtttttagcatgaagggctgttgaattttgtcaaaggccttttctgcatctattgagataatcatgtggtttttgtcgttggttctgttgagatgctggattacatttattgatttgcgtatattgaaccagccttgcatcccacggatgaagtccacttgatcatggtggataagctttttgatgtgctgctggattcggtttgccagtattttattgaggatttttgcatggatgttcattagggatattggtctaaaattctctttttttgttgtgtctctgcccggctttggtatcaggatgatgctggcctcataaaatgagttagggaggattccttctttttctattgattggaatagtttcagaaggaatggtaccagctcctccttgtacctctggtagaattcggctgtgaatccatctggtcccagacttttttttggttggtaagctattaattattgcctcaatttcagagcctgttattggtccattcagagattcaacttcttcctggtttagtcttgggagggtgtatgtgtccaggaatttatccatttcttccagattttctagtttatttgtgtagaggtgtttatagtatgctccgatggtagtttgtatttctgtgggatttgtggtgatatcccctttatcattttttattgcatctatttgattcttctctcttttcttctttattagtcttgctagtggtctatcaattttgtttatcttttcgaagaaccagctcctggattcattgattttttgaagggtttttttgtgtctctatttccttcagttctgctctgatcttagttgtttcttgccttctgctagcttttgaatgtgtttgctcttgcttctctagttcttttaattctgttgttagggtgtcaattttatatctttcctgctttctcttgtgggcacttagtgctataaatttccctctacacactgctttgaatgtgtcccagagattctggtatgttgtctctttgttctcgttggtttcaaagaacatatttatttctgccttcatttcattatgtacccagtagtcattcaggagcaggctgttcagtttccatgtagttgagaggttttgagtgagtttcttaatcctgagttctagtttgattgcactgtggtctgagagacagtttgttataatttctgttcttttacatttgctgcggagtactttacttccaactgtgtggtcaattttggaataggtgtggtgtggtgctgaaaagaatgaatattctgttgatttggggtggagagatctgtagatgtctattaggtccgcttggtgcagagctgagttcaattcctggatatccttgttaactttctgtctcattgatctgtctaatgttgacagtggggtgttaaagtctcccatcattattgtgtgggagtctaagtctgtttctaggtctctaagcacttagtttatgaatctgggtgctcctgtattgggtgcatatatatgtaagatagttagctcttcttgttgaattgatccctttaccattatgtaatggccttctttgtctcttttgatttttgttggtttaaagtctgttttatcagagactaggattgcaacccctgccttttttgttttccgtttgcttggtagatcttccccccctcctttattttgagcctatgtgtgcctttgcatgtgagatgggtttcttgaatacagcacactgatgggtcttgactcttcatccaatttgccagtctgtgtcttttaattggagcatttagcccatttacatttaaggttaatattcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcatgagccactgcgcccggccaggttaatattcttatgtgtgaatttgatcctgtcatcatgatgttagctggttattttgctcattagttgatgcagtttcttcctagcctagatggcctttacaatgcggcatgtttttgcagtggctggtaccggttgttcctttccatgtttagtgctttcttcaggagctcttgtagggcaggcctggtggtgacaaaatctctcagcatttgcttgtctgtaaaggattttatttctccttcacttatgaagcttagtttggctggatatgaaattctgggttgaaaattcttttaagaatgctgaatattggcccccactctcttctggcttgtagagtttctgccaagagatcagctgttagtctgatgggcttccctttgtgggtaacccgatctttctctctggctgcccttaacattttttccttcatttcaaccttggtgaatctgacaattatgtatcttggagttgctcttctcgaggagtatctttgtggcgttctctgtatttcctgaatttgaatgttggcctgccttgctatattggggaagttctcctggataatatcctgcagagtgttttccaacttggttccattctccctgtcactttcaggtacaccaatcagacacagatttggtcttttcacatagtcccatatttcttggaggctttgttcgtttctttttttttttctctaaacttttcttcttgcttcatttcattcatttgatcttccatcactgatacgctttcttccagttgattgaatcagctactgaggcttgtgcattcatcatgtagttctcgtgctgtggttttcagctc

SEQ ID NO: 12450 - DNA, 27473 bp, Homo sapiens
ttcttttttttattattattatactttaagttctagggtacatgtgcacaacctgcaggtttgttacatatgtacacatgtgccatgatcgtgtgctgcacccattaacttgtcatttacattaggtatatctcctaatgctatgcctcccccctcccccaccaaacgacaggccccagtatgtggtgttccccaccctgtgtccaagtattctcattgttcaattcccacctatgagtgagaacatgtggtgtttggctttctgtccttgtgatagtttgctcagaatgatggtttccagcttcatccatgtccctacaaaggacaagaactcatccatttttatggctatatagtattccatggtgtatatgtgccacattttcttaatccagtctatcattgatggacatttgggttggttccaagtctttgctattgtgaatagtgtctcaataaacatacgtgtgcatgtgtctttatagcagcatgatttacaatcctttgggtatatacccagtaatgggatggctgggtcaagtggtatttctagttctagatccttgaggaatagccacactgtcttccacaatggttgaactagtttacagtcccaccaacattgtaaaagtgttcctatttctccacatcctctccagcacctgttttttcctgactttttaatgatggccattctgactggtgagagatggtatctcattgtggttttgatttgcatttctctgatggccagtgatgatgaacattttttcatgtgtctgttggctgcataaatgtcttcttttgagaagtgtctgttcacatcctttgcccactttttgatggaattgtttgattctttcttctaaatttatttaggttctttgtggattctggatattagccctttgtcagatgagtaggttgcgaaaattttctcccattctgtaggttgcctgttcactctgatggtagtttcttttactgtgcacaagctctttagtttaattagatcccatttgtcaattttggcttttgtagccattgcttttggtgttttagacatgaagtccttgcccatgcctatgtcctgaatggtactgcctaggttttctcctagggtttttatggttttaggtctgacatttaagtctttaatccatcatgaattaatttttgtataaggtgtaaggaagggatccagtttcagctttctacatataggtagccagttttcccagcatcatttattaaatagggaatcctttccccatttcttgtttttgtcaggtttgtcaaagatcagatggttgtagatgtgtggtattatttctgagggctctgttctgttccattggtctatatctctgttttggtaccagtatcatgctgtcttggttactgtagccttgtagtgtagtttgaagtcaggtagggtgatgcctccagctttgttattttggcttaggattgacttggcatgcaggctcttttttggttccatatgaactttaaagtaattttttccaattctgtgaagagagtcatttgtagcttgatggggatggcattgaatctataaattaccttgggcagtatggccattttcacgacattgattcttcctacacatgagcatggaatgttattccatttgtttgtatcctcttttatttcattgagcagtggtttgtagttctccttgaggaggtccttcacatcccttgtaagttggattcctaggtattttattctctttgaagcaattgtgaatgggagttcactcatgatttggctctctgtttgtctgttattggtgtataggaatgcttgtgatttttgcacattgatttggtatcctgagactttgctgaagttgcttatcagcttaaggagattttgggctgagacgatgaggttttctaaatatacaatcatgtcgtctgcaaacagggacaatttgacttcctttttttctatttgaataccctttatttccttctcctgtttaattgccctggccagcacttccaacactatgttgaataggagtggtgagagagggcatccctgtcttgtgccagttttcaaagggaatgcttccagtttttgcccattcagtatgatattggctgtgggtttgtcatagatatctcctattattttgagatacatcccatcaatacctagtttattgagagtttttagcatgaagggctgttgaattttgtcaaaggccttttatgcatataatgagatattcatgtggtttttgtctttggttctgtttatatgctggattatgttcattgatttgcgtattttgaacctgccttgcatcccatggatgaagcccacttgatcatggtggataagttcttgatgtgctgctggattcggtttgccagtattttattgaggatttttgcgttgatgtttatcaaggttattggtgtgaaattctcttttttggttgtgtctctgccaggctttggtgtcaggatgatgctggccttatgaaacgagttagggaggattccctctttttctattgattggaatagtttcagaaggaatggtaccagctcctctttgcacctctggtagaattcagctgtgaatgcatctggtcctggactttttttggttggtaggctcttaattattgcctcaatttcagagcctcttattggtctattcagagattcaacttcttcctggtttagttttgggagggtgtatgtgtcgaggaatttatccatttcttctagattttctagtttatttgtgtagaggtgtttatagtattctctgatggtagtttgtatttctgtgggattggtggtggtatcccctttatcattttttattgcgtctatttgattcttctctcttttcttctttattagtcttgctagcagtctatcaattttgttgatcttttcaaaaaaccagctcctggattcattgattttttgaagggatttttgtgtctctatctctttcagttctgctctgatcttagttatttcttgtcttctgctagcttttgaatgtgtttgctcttgcttctctagttcttttaattgtgatgttagggtgtcaatttcggatctttcctgctttctcttgtgggcatttagtgctataaatttccctctacacgctgctttgaatgtgtcccagagattctggtatgttgtgtctttgttctcgttggcttcaaaaaacatctttatttctgccttcattttgttatgtacctagtagtccttcaggagcaagttgttcagtttccatgtagttgagcggttttgagtgagtttcttaatcctgagttctagtttgattgcactgtggtctgagagacagtttgttataatttctgttgtttcacatttgctgaggagtgctttacttccaagtatgtggtcaattttggaataggtgtggtgcggtgctgaaaaaaatgtgtagtctgttgatttggggtggagagttctgtagatgtctattaggtccacttgatgcagagctgagttcaattcctgagtatccttgttaactttctgtctcatggacatgtctaatgttgacagtgtggtgttaaagtctcccattattatcgtatgggagtctaagtttctttgtaggtctctaaggacttgttttatgaatctgggtgctcctgtgttgcatgcatatttatttaggatagttagctcttcttgtctaattgatccctttaccattatgtaatggccttcttcgtctcttctgatctttgttggtttaaagtctgttttatcagagactaggattgcaacccctggttttttttgttttccatttgtttggtagatcttcctccatccctttattttgagtctatgtgtgtctctgcacatgagatgggtttcttgaatacagcacatggatgggtcatgactctttatccaataaactagaaaatctagaagaaatggataaattcctcgacacatacaccctcccaagactaaaccaggaaaaagtccaattcctgaataggcctataacaagttccgaaactgaggcggtaattaatagcctaccaacaaaaaagcccaggaccagatggattcacagctgaattctactggaggtacaaagaggagctggtaccattccttctaaaactattccaaacaacagaaaaagaggaacttctccgtaactagttttctgaggccagcatcatcctgatatgaaaacctggcagagatacaacaacaaaaaagaaaatttcaggccaaaatccctgatgaacattgatgcgaaaatcatcaataaaatactggcaaaccgaatccagcggcaaattcaaaaggttatgcaccatgatcaagttggctttatccctgggatgcaagggtgattcatcatacacgaatcagtaaatgtaatccatcacataaacagaaccaatgacaaaaaacacatgattagctcaatagacgcagaaaaggccttagacaaaattcaacaccccttcacgctaaaaacacttaataaactaggtattgatggaacatatctgaaaataataggagatatttatgacaaacccacagccaatatcatactgaatggacaaaagctggaagtattccctttgaaaactggcacaaaactaggatgccctctgttaacactcttattcaacacagtattggaagttctggccagggtaagcaggcaagagaaaggaataaagggcattcaaataggaagagaggaagtcaaattgtctctgtttgtagatgacataattatatatttagaaaaccccatcatctcagtacaaaaactccttaagctgataagcaacttcagcaaagtgtcaggatacaaaatcaatgtgcaaaaatcacaagcattcctatacaccaataacagacaaacagagagccaaatcatgagtgaactcccattcacaattgctacaaagagaataaaatacctagggatccaacttacaacagatgtgaaggacctgttcaatgagagctacaaaccactgctcacagaaataagagagggcacaaacaaaaggaaaaacagtccatgctcatggatagaaagaatcaatatcgtgaaaatagtgatactacccaaagtaatttatagattcaatgctattcccatcaggctaccattgattttcttcacagaattataaaaaactgctttaaattttatatggaaccaaaagagagcctgtatagccaagacaatcctaagcaaaaagaacaaagctggaggcatcgcactctcaaaagaagacatttgtgtggccaataaacatatgaaaaaaagctcatcatcactgaccattagagaaatgcaaatcaaaaccacaatgagagaccatctcactccagttagaatggtgatcattaacaagtcaggaaacaacagatgctggagaggttgtggagaaacaggaacacttttacattgttggtatgagtgtacatgagttcaatcattgtggaagacaatgtggtgatttcccaaggatctagaaccagaaataccatttgatgcagcaatcccattactgggtatatacctgaaagattataaagacccatgcatatgtatgtttattgcggcactatttataatagcaaagacttggaaccaacccaaatgcccatcaatgatagactggataaagaaaatgtggcatatatataccatggaatactatgcagccataaaaaacaatgagttcatgtcctttgaagggacacggatgaagctgaaaaccatcattctcagcaaactaacacaggaacagaaaaccaaacacagcatgttgtcactcataagtgggaagtgcacaatgagaacacatggacacagggaggagagcatcacacaccagggcctatcggggggtggggggcaaggggagggatagcattaggagaaatacctaatgtagatgacgggttgatgggtgcagtaaaccaccatggcacgtgtatacctatgtaacaaacctgcacattctgtacatgtatcccataacttaaagtataataaaaaaaaaataacataaaaaatagagagtgtgatttttgttggggaatattttataagtattgctcttctgtccagagtgcaacattccatagttatctcctagcgatataaaggatgtgaaaaaaactataatccactggctgtttcagtcattactgagctgctcttttaagatcttttgttctgagaagaatcaaaggagctgctttgagtcagacactatggaaaacaatttttttaagtcactgctgatttgaaagtttgttgttcactttcctgaattctgtgttctgaattgcagttatatgaaagcagagctgtacaatggtagtttatttttcctttataatatgtggatggtatacgtcctatacatatatttggtttaaacaaatagccttaaaagttattaccagagtgactgcctgtgggacggctttctcttttggtgttttctatgcaaatgtttccttgacccagctcttggctctgggggttaatctgggcaaaagtggacctgcacaatggcatgggttcatgcaggaaagtgtccagtcaaggaatgatagaagacttttcaggtctgttggcttaggtagtgacccattctgctgggttccatcctaactcactgttttcctcctctgactgctataattctccagatgtgctgatgtagtctggtccagctttgcctccatggattaatttatttaataaatatttatgggactctctatgacattgggcatgattctagattcttgggaatgtagcagggagcaagacggtttaaggtccctatgcaggtacagataaacaacaaaatagacaactgataagttagttgcaggttgtggtaacagctaggaggggagaaacagggtgatgtgatgagtgaagcagagcgtattcaggagaggatggtcagggatgtctcacctcatccttaacagttcagctgagatctacatgtcaacagagagccaatcatgagatatgaggaataccattttatgttaagggaatgataaatgtgaagatccaaaggcaagaaagatttgcttgtttatggaatataagggaggtcaatctggctcaggcatcatgagtgaaagggagagtgatgaggaaatgcgttggaaggatgagcagatcatgcagtgcccaggagagctggagatcagtttagagcgtatagtaaatggatcgggaagccacagaaaggttttaaataggtggggcataggatttgaatttacttaaaaacatgtctcaggctgttgtatggagaacagagtgtggcaagtagcaaaagatcatggggattccagtgctgacattattcatttagacattcttttttttctctaaccttttttccttttttattgttttcttattttctgacagcgtcttgctctgtcactcagagtactggagtgcagtggcatgatcctcaacttcccaggccaagtgattctactaccttagccttgggagtggctgggaccacaggtgcacaccaccaagccctgattggcttttgatacatttttaattttgtaaagatggagtctccctatgttgcccagggtgatcttgaaattctaggctcaagtgatccttctgccttggcctcccagaattctgggattatagacatgagccttagtgcccagctatctctagctttgctgttaatgcttattcccctgtctccctgtcacaacctcaagtgccatgcagattgcagttttctgctgccagactgcagtgtcaaggtcatctctgctaacccaaagcacattccaatggatttcaattgccagctgttcccctgagatccaggccatctctgctaacccaaagcacattccaatagatttcaattgccagctgttcccctgagatccaggccatctctgctaacccaaagcacattccaatggatttcaattgccagctgttcccctgagatccaggccactgttctcagtgctctctatatccagctggtgccctgcctcattccagcagccaggaatgctcagctttggaagccaatgaggtgggcagcaagttgttctgtatcccatgtttccctctgtttaagaaatttgaaaaaggtataagtgtacatgctgtgttcaagctggcattcccatacatatatttgaagaatgttcaacactagtaaaaggactgacagagttcagttcctggagaccagggattcattgaaagtagttcaatgcattctttttattcactgaagacactccactgagatgcttttctggacctactatagctgaagtagggagtggttctgcctgggtgttctgataccatctgtgtatggctggccttccccgggccccaaggctgtgtctcattgagagcagagcccctgggaagttcacccctcagctgagtgggcaagtgccgggtatagtgctcaacgctagggagacatatatgagagaggtacagatgcttacacattccaacaccatttaagggtgaaggtgaaggttggttttgttccctgtctgcccaatctgcttgtggtgaattattttgccaactataagtatgactttaggaattttgggccaggggctgcagggggtgggaggtagacagagggaatgtcttcatatgaaggcttcgcatgttatgctagggcaagatggcacattcagcaaaagctcaggctgtactggctagcgctttcattcattcttgtgccaggtaccttgcagagccacccagctggagaaaaggaacccaaaattccctaccaggtcaggcttccttgttcttccctcggagccttttcagccccccatgtggtgcatcaggtgaggtgcagcagggcttggtgcaggagctctgcccgcctggcacctgcaggtgtaataagggatggcacattttgttagccacaagactctgaggccttcgtgcttgttcagttgagaccattggccaatccagtcttctattctcttacttcaaacacccctcactgcctgttggagataaatcctttttcttcccttgcctgtgaaaattgccctggtggattcataggtgtggggtttcactaggcagaaaaacaaggaggaagggcccttttccaagattccaccaccctcctttcctttcactgctattttgcattaacatatacatggtgtgcatgcctttcaagagctgaacagatgctggttcttgcattttgtgcagtgccagggaaggatgggtgttccattttccatgttaccctactgcctggggccactccatgctgatgctggtgctgatcatctgtctcttggggtgttgatggtggtggaaacctgttcttctggaccagaatgtgcttaccttttcccttcagaatgaatactgaaactacctctttgcagtaatcaaattcaactgattaataatctgtaaattccccatgtaagaagcaagccatcttgaagttgggtgtgactcctatcatggctgtgatacacccaggtccagagggagataattttcccctccccacactctggacccacagcaacttcctcacccacttcagttcaactctgtcactgatgcccctgagagtattttttatttgactgttgctcctttggttggttaatgactatgtcatcatcgaagtccccaagcttgtcttgattagcctcctttcctcagggaaattgagaagaatgagagagccagtgatttaaggggatttggagggaaggaaagaggctaaggagatgaaagaataaaggaggaaaagatatgatctcaagaagagaaggagaatgaagagagaggcagttaaatctggggatgtgggacagtagacttacttcttgggctgaatagaaggcacattttgggggaagtttaaacttgttccctttacttgcccaggaacccatggtgtggcttcactgtgtgatttgaaagggtgaaatgcagggttatgtatgatcagaatgactaacacacatatagccaggtgtgttctagagaccttcaaggaaattggcattgaaggtggaggctggaggcatttttgcttcactcacccctgctcagggccatttgttaaggcattcaaacccttccagatgctccccagggattctcctgggttctagagagtcccctgcatgggactgggcaagaaggaggtaacccaacggagatgggtctcttccacgtatcggcactgcatgctccagtgctctgctgtaccactgacaagaccagttcaggctgcgtgattccgtggaaagataaggactttcaaggccaactccctggtagcaggcatagccactaatcagttagtgtgactgtgaacaagtttcctcagtggtaaaatgggattagtcacccccaccagataggtttctgatgagtattaaataagataatatatgtcatatgtaggtcatgttgtacatgcctgaaaggtagtagagcttattcagtcttcatccgcccttcctggccctcccactactctgccctctccccaacccaggttttatgctactcttctaaattggagatggcaatacctggaaaagaaggagaaaggaggaaagtatgtattaacataactcacacctccctccacattaaacattcaaacatttattgatctttttatcaaactatgtgaaggaatggaagattaaaaagaaaggaaatcctttctcatttaagagtagaaatggagctctagtagtcaaaacgaccctcaagttaaaagagtccctaaattgttcagaatcagctactgagatttggtaacagcaaaccacatggtctttcctctggtatatgattaggacagaaaccttcttgttgggccaatgactgcgcaggttttgatgacatgaggaatacaataagttggccattgtatgaaagggaggcagcaggacctgagcttgtgcccttgtcactttctgtatgaggccaggagggtggagcttgatgacatctcctaacaatacccacatgcacatctctgtcatccttaaatcactgagtcttggacttcagggtctccttgtgccggtccacaagggaaccaacccactccaccgttttctgcttggcttcctcccagctgtagagtggcttatacgccagatctcgctgagccttcttataagagaaggtgaatacgctatttgacaatgtgactatgtggcggttgaagggcggtcgataggtgtaaattggcctgagtaggaagctcactatttccagcaggaagccaatccaatacatcagggataaaggaaagctccatctggaatcaaggcggaggccgaactctttgctcagggtgtaattaaggttatcatagctttggtgaggcgtgtcatctgagatatagtagaactgtcctcggatgcttggggccttcttggggtcctgcagggccctcaaggccagaatgtgggcccaggccacattgccaacatagactgggttaacagtggagaactttccaacacttgacaggatcccattgttgttcagggcctcgtttatactagcagaaaggaatcggcttccttccccatagatatacatgggtcgtaaggcacaagtgtacagggtgccgccgtttttcagattccacccgttagccgccagtacagccttctcagcaagctttttgctgtgtgggtatggagcgggccatgtgttttccagaggctcttcttcatggccattctggatgatttccttgtaggagttgggcccggctacctctatgctactggtgtagatgaagactggcacactagcttggacacaggcctctaacaggagctgggtacctgtccatgaagagcatattgtcactgtcaggatatatccctaagaggtgccaaccacgaacacagatctatgtgccccaccccccactcccaaatatggtggttgtaacagactcagggtacattcttctgtggttctgtctgagatttggtcgtactacagccataagaaaaataccaaaatgaagagaaactgacatgtgggttctggagagtaagaatttctagacttttgggtttcatggatgtgtgtgtgtgtgtactttaattttggaaagggacctagggttatcactttttattttgccaagtaagggtattgacaaattatgatttgtaatcagtaccattaaagtcagatcatttaaaatctaaaaaatcaggaggctatactctgtgaatatggacagttccagtccttaggcaaaatgggcagttgaagaattcacatcacacacacacatacaccattgtatataggcaatataaactcttcaatatatatgaaattgttggtacttttctcattttgctgggctctaataaaactttgtcacaaggaccatcctggagtcactgagcaagcagtgggttgtggggagatgctggaaacccacactcttcctgattgtgcattccctgggaaagctgcttccaattctggctgtgactctgtttacctggttatgtaaagtggaggtgataaaccttcttttaaaccctgccctggcatttcctgtggagcctggtggagggctggggagagaagtgtgtcctctgctggtaacacctgcagtgggaggaccttgcagcctcccctgagctgtgtagaagcaaagctcatggaggtacccatagtgccttcccttgaagaaggaaggaatttcctagggaaaggatcatttttatttacaaatttttgtattcttagcccttttaatgtctctgtgcaatttgagtttctggaaagacagcctcatgtgttcaaaaattaatcttgtggcagagaaaatttggagttagtttaccttcaagggggaaatgaccaacattgtgaagtattttctaagcttgggagttataatggttttagcaaacagatgcctctaacacttcccctgtcatttcatatcccctccttttgggagctgttgaagtagtaattaaaactggttactcttagcaccctccttgcacagcaggggtacttagaagtatgggtaagtagaaactggaagttgtttttttttttcttttatggtgctggagactcaaaagcaattggttgctttggaaaaagagtcagagtagactaaatgcggagggccaggccggggtttggggtgctatggtgctgaagagactggactctggagatcagagggtgagatttctgagaagattccttaaggaaatgtgtctgaatttaaggtagttggaaagccatactttgaaaggaaacgccaagcatttaagggatgaagattaaatgagggtgcactttgggcacctggctgaaaacggctctggaatagtaggccctgtggtgagctgaagagactgtattcttgatactggaaaaatctcactgttaaaaaaatattgtgggaaggcatgtgctggataattctgtcctgacagaccttgtgaaccagctttgctagttctctcgagaggactttttgtttgaggtgggcaggagggctctgaatgttttcatcagcctacacacaaggttcaaaatggtgactacagtggcacctgcaaggtctgcttctggcctgggaggcaaggggtgtctgggtatcaagagtctgaagtcagaaattagttgacttttgattggaaccacagtagaaagagcttttggagtcacagtagaaagagcctttggagtcacacagggatgagtttaaagtctaactctcctacctgcttacttacctgggggaccttggacaagttacttgccctctctcagtcctagttttatcatctaaaaaactaaagttagcagtcttgaactctcctattcgtagtgatcagcaaaggcacttggcccagagcacagcaggtgttcagtggagggacttctcttcccttcctgcccttctttgtgatccttaattccccaccttgctgcatctcctccccagcctaccatacctttcacattgacattcatgatagactctctgtgagtgacaccgaagacatcaatgatacaggcggtgtggatgatgaccgagacgtcctggcaggctctcttcaggaatggctcatccagaatgtctccttccagcactgtcagcttggtcttgttctggagttctgtgtgaacacaggtcaggtcattggaatgatttctgtatctggctgagaagttttctgataaaggtgatgttacataggtgttcaaggatggttagagtagggtgttagagtggagggtgtacattctacggaaagaacaagtaaaaaaggcacagaaatcagcatgtgtatcaatttcttggaaagagcaaacatctgtttctctcccatctcattttagaaaagtaatctgagcagtgagctgtcaggtatgcctggaatataagcattgctagagtcatgggaagcccatcaaattttctaaggagagtagtgtgattgtagagagtatgagggaaaagtttgaagttaattctgtaagtaatgagaaatcatgtatagaatcataattttgggactccagcatcatgttaaagaaaaccccttatttatatttggaataaaatgacaaaaaggccaagccccgtggctcatgcctgttattccagcactttgggaggctgtgatggatggatcactggagcgcaggaggttgagaccagcttggacaacatggggaaatcccatttctattaaaatacatgaaatagctgggcatggtggcatgtgcctgcctgcagtcccagctactctgcagactgaggtgggaggataaatggaggctggggtctctggttcctggcagtgagccaagatcacacctctgcactctagcctgggtggtagagcaagaccaccttgtctcaaaaaaaaaaaaaaaaaaaaaaaaaaaaaaaaaaaaagaaaaccacacaagcaacaacaaaaaaaggaacaaaagcagggttgtggtgtaggaagttaatcttggcttgaggatataaaatggactggtataggggatttgagaaagactgatgatcaagtgattaatcagaatgtctgtgccaaagtttcgatgaggactggaagcagggtccagcagtggaagcagaggaggggagagatataccaggtttgaatttcagaccttaccttgaaggtcctggtacctattggatctgagctgataggaaaaggagaagataaaatcacccctacagtttcctgcttgggcaactgggaggagagtggagtcattactcaggaattgtgggtgggcttcaatgatgaatttccctggaaaactattatcagatatcatcaaaagcaggtagcaatgctgaaaatgagttaaccaccaatgaactaacatcgcagctgtctagctggaggcagtggttacaacatcaatgtcttcaggttcctctgaaatccacaggaagtgacgctgccagtaaggttgtcacctggaattagcccacaaaatgaacaccatgctacatggagcttggataaatactctacacttgtttgtgctttatcatctgtatgcaacttacaggatatttatttctttttacagctatctcatgaggtaggtattctgagtcccactttatcagtgaggaaactgagtctcagagaggttaagggacagatctaaggtcacgtttctagtgaaggcttaaacacgcccaccctgcctccaagcttgtaccctgtacaccaggtgcaggactggctgtttaatatcaacttttctgttgtttaatatcattcttttccaaagaataagccagtttaactgaaattggcaacaaagaccaaagaccagtgagagcaaaattcagagtgaaaaattcgaagctggagaaattccttcctggggtacaagcaggaccacttgctctcctgatgcctctgccatgttttgtctactcccaacctcttcccgttgtcaggcaactccaagaaggtcctggagtgggggagtcagggaagaggctgctggtggtgatgtgggtaacagcctgagagtgggatgttctctggttctagttccacctctgcccttcctgctgccttcctctgcttcttctttgctgccacttcagacagactggctcaaaggagtgtcaaagtggaagaagtccaaagctgagagaaaaggactcttccccagtgagttcccagggatctagagggactaggaaaaggtactttgttgatgaagtcatggctcccttcttctccaaggcactgtagacttggcaagtgttttatgtagactaaatggagttgcttttatggtgtaagttgggctagaggaaggcctaaaggagctgtaagacaaactactgcttaagagcacagatgctgcactagtctgtctgggttcaaatctagctttgccatatgctaactgtgggaccttcaaaaagttaactaacctctctgtttctatctcctcatctttaaaaaaggaggataatattaccgatctcatagggttgttatgaggagcaaatgagttggcaaacctttggccaagtgcctggcacaaaaagaacactgaatgctttctctgtttttatcttcatacagatccctgcctgtctattatatgatctgcatttttaccataggggaacaatacctctaggctgagcattgcttttttctggcttcagatgttaaattgcaaatattgctgagacacaggcaaggattataagcatttcatatttgtttatcaaagacaacattaaaacagagggtggaagaaatcgaacatttcaagaggtcagagaagagcaaaagtagagtgttgggtgtggtccctgagtgctgtcaagtgggggattctctgtgggcagggcaggaccctctgggcagccagagcccacatgtagacacacagtcccccaaatcccctgggttggggaggaggacagggaattgttttggggcacaccaaggagcaaagggagagactgaagatccactttgccaagcatcagctctggggccaggtgaaatagcctatggataaagctctggtctgagctctgctacgcatcaatcagatggccttagcatgttgctttgtgattccggaccttgatgcgttcattgtcctgttggatgtgatgccttttctacctgcctcttggggccatttgtacaaggagttgccacagaaaattctgcagtcaatttctttttgatgatgagcaacagaggtaaatgttttgtttttttttttttaaaaaaaagccatatatgcaaaatctaaatgaggcatgtctggccttatactgcctcttactctgtctctgctctgtgctgtgcactgtgcacacacattctctcactgatgctctctctctcactatatatttttcattatttctctgtctttctcattgtctctctctctgagtctctctccccgactctctctccccgactctctctcccccttattgttttcctctctctctgtcacacacacccacttatacactcatctttaccttaacttccttttattttgccctcacaaaggatactaaggaagctgcaaaacaaaacacagcctggcacgttctagagagacaatgacccattggtgaggtctccagggtaatagtgtcctttatgaatgttgtacagcaattgccaagacaaaagcttcagaacataaaagagttgcagacaagacaaagaactgatgtgggattttctagatgagaagaaaagaggcctggaggctgaggtggctgcttctcaagttctgggtcagggccagaatctagtctctggaaatcccacccagtatctttcatactatgccattttatactatttaatatttatttcttgatgactttggatgtgagattggcttagatttggctacaaatttcaataacttgctagacaaggtccatctccccccacatacatgcagtgtttaagatggaaccacacacccatgacccaagtttacttactagaaaattcctctctcaattctggtccgaaggccttgtccaagaccctgatctccttcagctccttctccttcaccaagaggcggatgatcctctgtcccagaaaccctcctgctcctgtcacaaggcagctccagcccgtcatggccatccaaagtagcaggaatcactcaccaggaaacagaagatgctggggagcagatctgattctagggtgaccctggagagggctaaaaagagatgtcaaatggttatatactcacacagatgcctcattttcctccaccccattttttttgcaaacattctgtgtccccaccactgcaggagtagctgaaagaaaatgaaaaatctctaaccattagttagattgttaaaagctggacagaagagtggacgtacttctcacctcatttcctgtggcaagtctgaagctttatgcactgtggcttctggcccaacccttatcactttgatctctggccatgtactcattgctctctcctcctatgggatccttatctcagaaaaatagtgacctttgggttacatctctaattcttcccaggaacaggaagagaagtcccatcctaatgctgcagtgtggcaaagagtcttgggtttagccttaacaggacactagtcagttgataccagctgtctgggatccacaatctgtgaacttaaactagaccaggagaaatctgcaagtgcaatttgaattgtgcccttgttcagtaaatccatctggagggaaatccatgtaagcccattatctcctctctcagactatcatttgaaatgttgctgctgtcttacaaaatttagaaatttgcaatggtgacagctccaatcacttagttttatgtgaggtgactttctttcctacccaatatatctgaaacctcaatggtcatttgcccctggagagccctgggttcctagatgaacaacatcattgaaggaaagctatctggtgataaccacttaatgatatggcctgtatcacaagagtggggatttgtggttgtatgccccaatgactcttatcataggtgttcgaacttatccatatttttggctgcaaaacgattctcagcaaattcttgaactggacatactgtgaatgcttctgaagcctatgccccagaactgcccaaatatcaccgccataagcttcccaagacactttactcaaaaaaattgaaatataatttacatgcattaaaatgcccaggtcttcagtgttcagttcagtggaacttgacagttatatatgcccatgtaagtagcaccccaaaaaagatatagaccatttccgtcactccagaaagttgttttctgcctgttccctgttaattccctgaccttcccccaatctacctcataggcaactacttcctgatttttattcccacagttctcattttatttctatatttctctaattttttcttctaagatctctgtggttctggatatatatttaaatataaaattattttgaaatgaagttttgtgcagggagtacagaaaaattgaccgttgattgtctctgttgtttatttttctatttcatgattttcattatttttattattggcttacatttattaattttgtttttttttttcactcgtttttcacattttttttttttttttttgagatggagtcttgctctgtcacccaggctgaagtgcaggggcaccatctcagctcactgcaacctctgcctcccgggttcaagcaattctcccacctcagcctccgaagtagctgggattacaggtgcccgccactgcaccgggctaatttttgtattttcagtagaggtggggtttcatcatgttgaccagctggtatcaaactcctgactttgtgatctgcacgcctcagcctcccaaagtgctgggattacaggcgtgagccactgcacccagccccgtttttcaggatcctgataataaaagcatagaaaattgtttttctttactcctttcctatttccactataggcattaaaagttgtaaatttctctttaagcactgtgtgagctgtacccaacattttgatgtattgggttatcatcattcagttaataatatttaaagttttgtcttgtggtttcttctctgacccaagtgttattcagaagtgtgttgcttgttttctaaaagtgaggattttctagatatctcattgttatggatttctaattaaatactactgtggccagagcatatgcactgtatgattttgattcttgaatatttagtgagatttgttttatggtccagcatatggtctacattggtgaacatgccataagcacttgaaaagaatgctttctgcagttgttgaaagtaatactctacaaatgatttagtttgacaccccactctgggtcttgccctcctccatgttgtagacattcatcttctactttggacctcactaccaatgcttcaaaaccacttgcctaggaaaggttggccttgtgctacaagatgtagcagcttgttctctgaaactatcagaactatttacaggccctgggtcttgctgagacttgtggagtactatctgaaactacccaggtgcatcgcatgcctttgcctgctgtagcagtgctggagagcaccttaaagatcccccatcgccttcagtgtggggctggactttctttcagctgttgaacgttctggaggctcgtagatttcagctcatgtgtcttggagtctctgagtggaagcaataaatataagccctaaagaaagggagaaataaaacaaaggtccagagtgattgggaaccatactaccaactttcttttatttttaaataggtttactgaggtataattgacatcacatttgcttgttttaagtgtacagttcaattatttttagtaaaattttatacttgtgtggaccatcactgtaatcctgttttccaacatttctatcattcctaagaaatccctcgtgctcatcagtcaccattccttactcttactcacagctcaaggcaacctttaattgactcactgactttacagatttgccttttctagacattatataaatggaatcatagaatatttggtctttgtatttctattctttcacttagcttaatatacttttttttttttttgagacagagtcttgctctgttgcccaggctggagtgcagtggtgcgatgttggctcacttcaacctccacttccgggttcaagtgattctcctgcctcagcctccaggcacctgccaccatgcctgggtaatttttgtatttttagtagaggcgggatttcatcatgttggccaggctgatctaaacttttgaccccaaatgatccacccaccttggcctcccaaagtgctgggattacaggtgtgagtcaccacacctggccagcttaatgttcttttgtggttcatctatgttgtagcacgtatcaatattttactccttttaggtgccaaaccctattaaattgtatggatggctcccatttgtttattcattcatcaattgatcgatatttgatgtgtttccactttatggactattatggataaagctgctatgaatattcacattcatgtgttgtgtggacataggtttctgtttctttggggtagacagctaggagtgaaagtgctagatcataaggtaaatgtatatttaacattttaaggaactggcaatctgttttccaatgtggctgcatgtcccatcaacactgcaagagtagttcaatttttcacatcattgtttttcacttctttcaattgtttatttatttatttattttattattattatactttaagttttagggtacatgtacacaatgtgcaggtacatgtgacatgttgatgtgctacacccattaattcggcatttagcattaggtatatctccaaatgctatccctcccccctccccccaccccacaactgtccccggagtgtgatgttccccttcctgtgtccatgtgttctcattgttcaattcccacctatgagtgagaacatgcggtgtttggttttttgtccttgcaatagtttgctgagaatgatggtttccagcttcatccacgtccctacaaaggacatgaactcatcattttttatggctgcatagtattccatggcgtatatgtgccacattttcttaatccagtctatcattgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttccagttctagatccctgagaaatcaccacactgacttccacaatggttgaactagtttacagtcccaccaacattgtaaaagtgttcctatttctccacatcctctccagcacttgttgtttcctgactttttaatgattgccattctaactggtgtgagatggtgtctcattgtgcttttgatttgcatttctctgatggccagtgatgatgagcattttttcatgtgttttttggctgcataaatgtcttcttttgagaagtgtctgttcatatcctttgcccacttttttatggggttgtttgtttttttcttgtaaatttgtctgggttcattgtagattctggatattagccctttgtcagatgaggaggttgtgaaaattttctcccattttgtaggttgcctgttcactctgatggtagtttctcctgctgtgcagaagctctttagtttcagtagatcccatttgtcaattctggcttttgttgccattgcttttggtgttttagacatgaagtccttgcccatgcctatgtcctgaatggtattgcctaagttttcttctagggtttttatggttttaggtctaacatgtaagtctttaacccatcttgaattaattttcatataaggtgtaaggaaggaatccagtttcagctttctacacatggctagccagttttcccagcaccatttattaaatagggaatcctttccccatttcttgtttttgtcaggtttgtcaaagatcagatagttgtagatatgtggcattatttctgaggtctctgttctgttccattgatctatatctctgttttggtaccagtaccatgctgttttggttactgtagccttttagtatagtttgaagtcaggtagcgtgttgcctctggctgtgttcttttggcttaggattgacttggcgatgcaggctcttttttgtttccatatgaactttaaagtagttttttccaattctgtgaaaaaagtcattggtagcttgatggggatggcattgaatctataaattaccttgggcagtatggccattttcaagacattgattcttcctacccatgagcatggaatgttattccatttgtttgtatcctcttttatttcattgagcagtggtttgtagttctccttgaggaggtccttcacatcccttgtaagttggattcctaggtattttattctctttgaagaaattgtgaatgggagttcactcatgatttggctctctgtttgtctgttattggtgtttaggaatgcttgtgatttttgcacattgattttgtatcctgagactttgctgaagttgcttatcagcttaaggagattttgggctgagacgatggggttttctagatatacaatcatgtcacctgcaaaaagggacaattagacctcctctttttctatttgaataccctttatttccttctcctgcttaattgccctggccagcacttccaacactatgttgaataggagtggtgagagagggcatccctgtcctgtgccagttttcaaagggaatgcttccagtttttgcccattcagtatgatattggctgtgggtttgtcatagataactcttattattttgagatacgtcccatcaatacctaatttattgagagtttttagcatgaagagttgttgaattttgtcaaaggccttttctgcatctattgagataatcatgtggtttttgtctttggttctttttatacgttggattacatttattgatttagcgtatgttgaaccagccttgcatctcagggatgaagcccacttgatcatggtgggtaagcttttttatgtgctgctggattcggtttgccagtattttattgaggatttttgcattaatgttcatcaaggatattggtctaaaattctcttttttggttgtgtctcttcccagctttggtatcaggatgatgctgacctcataaaatgagttagggaggattccctctttttctattgattggaatagtttcagaaggaatggtaccagctcctccttctacctctggtagaatttggctgtgaatccatctggtcctggactccttttggttggtaaactattgattattgccacaatttcagagcctgttattggtctattcagagattcaacttcttcctggtttagtcttgggagggtgtatgtgttgaggaatttatccatttcttctagattttctagtttatttgtgtagaggtgtttatagtattctctgatggtagtttgtatttctgtgggattggtggtggtatcccctttatcattttttattgcgtctatttgattcttctctcttttcttctttattagtcttgctagtggtctatcaattttgttgatcttttcaaaaaaccagctcctggattcattaattttttgaagggttttttgatgtctctatgtccttcagttctgctctgattttagttatttcttgccttctgctagcttttgaatgtgtttgctcttgcttttctggttcttttaattgtgatgttagggtgtcaatttcggatctttcctgctttctcttgtgggcatttagtgctataaatttccctctacacgctgctttgaatgtgtcccagagattctgatatgttgtgtctttgttctcgttggtttcaaaaaacatctttatttctgccttcattttgttatgtacctagtagtccttcaggagcagattgttcagtttccatgtagttgagcggttttgagtgagtttcttaatcctgagttctagtttgattgcactgtggtctgagagactatttgttataatttctgttgtttcacatttgctgaggagtgctttacttccaagtatgtggtcaattttggaataggtgtggtgcggtgctgaaaaaaatgtatattctgttgatttggggtggagagttctgtagatgtctattaggtccacttgatgcagagctgagttcaattcctgggtatccttgttaagtttctgtctcgttgatctgtctaatgttgacagtgtggtgttaaagtctcccattattattgtgtgggagtctaagtctctttgtaggtcactaaggacttgctttatgaatctgggtgttcctgtattgggtccatatttatttaggatagttcttcttgtctaattgatccctttaccattatgtaatgtccttctttgtctcttttgatctttgttggtttaaagtcggttttatcagagactaggattgctacccctgcctttttttgttttccatttgcttggtagatcttcctccatccctttattttgagtctatgtgtgtctctgcacatgagatgggtttcctgaatacagcacactgatgggtcttgactctttatcctatttgccagtctgtgtcttttaattggagcatttagcccatttacatttaaagttaatattgttatgtgtgaatatggtcctgagattatgatgttagctggttattttgctcattagttgatgcagtttcttcctagccttgatagtctttacattttggtatgtttttgcagtggctggtaccagttgttcctttccatgtttagtgcttccttcaggagctcttttagggcagacctggtggtgacaaaatctctcagcatttgcttgtctgtaaaatattttatttctccttcacttaagaagcttagtttggcagatatgaaattctgggttgaaaattattttctttaagaatgttgagtattggcccccactctcttctggcttgtagagtttctgccgagagatgtgctgtaagtctgatgggattctctttgtgggtaacccgacctttccctctggctgcccttaacattttttccttgatttcaactttggtgaatctgacaattatgtgtcttggagttgctcttctcaaggagtatctttgtggcattctctgtatttcctgaatctgaatgttggcctgccttgctaaattggggaagttctcctggataatatactgcagagtgttttccaacttggttccattctccccatcactttcaggtacaccaatcagacgtagatttggtcttttcacatagtcccatatatcttggagactttgtttgtttctttttattcttttttctctaaacttcccttctcacttcatttcattcatttcatcttccatcactgataccctttcttccagttgatcacatcggctcctgaggcttctgcattcttcatgtagttcctgaaccttggctttcagctctgtcagcccctttaaggacttctctgcattggttattctaggtatccattcgtctaattttttttcaaagtttttaacttctttgccattggtttgaatttcctcctgtagctcggagtaatttgatcatctgaagccttcttctctcaactcgtcaaagtcattctctgtccagctttgttccattgctggtgaggagctgcgttcctttggaggaggagaggtgctcttctttttagagtttctagtttttctgctctgttttttccccatctttgtggttttatctatttttggtctttgatgatggtgatgtacagatgggtttttggtgtggatgtcctttctgtttgttagttttctttctaacagacaggactgtcagctgcaggtctgttgaaatttgctagaggtccactccagaccctgtttgcctgggtatcagcagcggtggctgcagaacagcggtggctgtagaacagtggatactggtgaacggaaaatgctgctgcctgatcgttctggaagttttgtctcagaggagtacccggccgtgagaggtgtcagtctgcccctaatggggggtgcctcccagttaggctgctcgggggtcagagacccact

SEQ ID NO: 12451 - DNA, 6186 bp, Homo sapiens
tttttgtttgttttttttgttttgttttgttttgttttaatttattttattattattatactttaagttttagggtacatgtacacattgtgcaggttagttacatatgtatacatgtgccatgctggtgtgctgcacccactaactcgtcatctagcattagttatatctcccaatgccatccctcccccctacccccaccccacaacagtccccagagtgtgatgttccccttcctgtgtccatgtgatctcattgttcagttccccactatgagtgagaatacgcagtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacacttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtcttcctatttctccacatcctctccagcacctgttgtttcctgactttttaatgatcgccattctaactggtgtgagatggtatctcattgtggttttgatttgcatttctctgatggccagtgatggtgagcagtttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttgttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttggattgatttttgtataaggtgtaaggaagtgatccagtttcagctttctacatatggctagccagttttcccagcaccatttattaaatagggaatcctttccccattgcttgtttttctcaggtttgtcgaagatcagatagttgtagatatgcggcgttatttctgagggctctgttctgttccattgatctatatctctgttttggtaccagtaccatgctgttttggttactgtagccttgtagtgtagtttgaagtcaggtagcgtgatgcctccagctttgttcttttggcttaggattgatttggcgatgcgggctcttttttggttccatatgaactttaaagtagttttttccaattctgtgaagaaaggcattggtagcttcatggggatggcattgagtctataaattaccttgggcagtatggccattttcacgatattgattcttcctacccatgagcatggaatgttcttccatttggttgtatcctcttttatttcattgagcagtggtttgtagttctccttgaagagttccttcacatcccttgtaagttggattcctaggtattttattctctttgaagcaattgtgaatgggagttcactcatgatttggctctctgtttgtctgttattagtgtataagaatgcttgtgatttttgtacattgattttgtatcctgagactgctgaagttccttatcagcttaaggagattttgggctgagacaatggggttttctagatatacaatcatgtcatctgcaaacagggacaatttgacttcctcttttcctaattgaataccctttatttccttctcctgcctgattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcccctattgagataatcatgtggtttttgtctttggctctgtttatatgctggattacatttattgatttgcgtatattgaaccagccttgcatcccagggatgaagctcatttgatcatggtggataagctttttgatgtgctgctggattctgtttgccagtattttattgaggatttttgcatcaatgttcatcaaggatattggtctaaaattctcttttttgattgtgtctctgcccggctttggtatcaggtatgaggcggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcgacttcttcctggtttagtcttgggagggtgtatgtgtctaggaatttatccatttcttctagattttctagtttatttgcgtagaaatgtttgtagtattctctgatggtagtttgtatttctgtgggatcagtggtgatatcccctttatcattttttattgtgtctgtttgattcttctctcttttcttctttattagtcttgctagcggtctatcaattttgttgatcctttcaaaaaaccagctcctggattcattaattttttgaagggttttttgtgtctctatttcctacagttctgctctgattttagttatttcttgccttctgctagcttttgaatatgtttgctcttgcttctctagttctcttaattgtgatgctagggtgtcaattttggatctttcctgctttctcttgtgggcatttagtgctataaatttccctctacacactgctttgaatgtgtcccagagattctggtatgttgtgtctttgttctccttggtttcaaagaacatctttatttctgccttcagttcgttatgtacccagtgcaggttgttcagtttccacgtagttgagcggttttgagtccgtttctgaatcctgagttctagtttgattgcactgtgttctgagagacagtttgttataatttctgttcttttacatttgctgaggagtgctttacttccaactatgtggtcaattttggaatagttatggtgtggtgctgaaaagaatgtatattctgttgatttggggtggagagttctgtagatgtctattaggtccacttggtgcagagctgagttcaattcctgggtatccttgttaactttctgtctcgttgatctgtctaatattgacagtggggtgttaaagtctcccattattattgtgtgggagtctaagtctctttgtaggtcactcaggacttgctttatgaacccgggtgctcctgtattgggtgcatatatatttaagatagttagctcttcttgttgaattgatccctttaccattatgtaatggccttctttgtctcttttgatctttattggtttaaagtctgtattatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttaccagtcgatgtcttttaattggagcatttagtccatttacatttaaggttaatattgttatgtgtgaatttgatcctgtcatgatgatgttagctggttattttgctcgttagttgatgcagtttcttcctagtctcgatggtctttacattttggcatgattttgcagcagctggtaccatttgttcctttccatgtttagtgcttccttcaggagctcttttagggcaggcctggtggtgacaaaatctctcagcatttgcttgtttgtaagggattttatttctccttcacttatgaagcttagtttggctggatatgaaattctgggttgaaaattcttttctttaagaatgttgaatattggcccccaatttcttctgacttgtagagtttctgccgagaaatccgctgttagtctgatgggcttccctttgtgggtaacctaacctttctctctggctgcccttaacattttttccttcatttcaactttggtgaatctgacaattatgtgtcttagagttgctcttctcgaggagtatctttgtggcgttctctgtatttcctgaatctgaacgttggcctgccttgctagattggagaagttctcctggatagtatcctgcagggtgttttccaacttggttccattctccccgtcactttcaggtacaccaatcagacgtagatttggtcttttcacatagtcccatatttcttggaatctttgttcgtttctttttattcttttttctctaaacttcccttctcacttcatttcattcatttgatcttccatcactgataccctttcttccagttgatcacttcagctcctgaggcttctgcactcttcacgtagttctcgagccttggctttcagctccatcagctcctttaagcacttctctgtattggttattctagttatacattcttctaaatttttttcaaagttttcaacttctttgcctttggtttgaatttcctcttgtagctcagagtagtttgatcatctgaaggcttcttctctcaattcgtcaaagtcattctccatccagctttgttccgttgctggtgaggaactgcgttcctttggaggaggagaggcgctctgctttttagagtttccagtttttctgctctgttttttccccatctttgtggttttatctacttttggtctttgatgatggtgatgtacagataggtttttggtgtggatgtcctttctgtttgttagttttccttctaacagacaggaccctcagctgcaagtctgttggagtttgctagaggtccactccagaccctgtttgcctgggtatcagcagcggtgtctgcagaacagcagattttcgtgaaccacgaatgctgctgtctgattattcctctggaagttttgtctcagaggagtacccggccgtgtgaggtgtcagtctgcccctactggggggtgcctcccagttaggctgctcgggggtcaagggtcagggacccacttgaggaggcagtctgcccattctcagatctccagctgcatgctgggagaaccactgctctcttcaaagctgtcagatgggggcatttaagtctgcagaggttactgctgtctttttgtttgtctgtgccctgcccccagaggtggagcctacagaggcaggcaggcctccttgagcagtggtgcactccacccagttcgagcttcccagctgctttgtttacctactgaagcctgggcaatggcgggcgcccctccccccgccttgctgctgccttgcagtttgatctcagactgctgtgctagcaatcagcgacactccgtgggcgtaggaccctccgagctaggtgcggaatataatctcctggtgtgccatttcctaagcccgttggaaaagcgcagtattcgggtgggagtgacccgattttccacgtgccgtctgtcacccctttccttgaccatgaaagggaactccctgatcccttgcacttcccgagtgaggcaatgcctcaccctgctttggctcatgcacggtgcgctgcacccactgtcctgcgcccactgtctagcacttcctagtgagatgaacccagtacctcagatggaaatgcagaaatcacccttcttctgcgtcgctcacgctgggagctgtagactggagctgttcctattcggccaccttggctcctcc

SEQ ID NO: 12452 - DNA, 4908 bp, Homo sapiens
tttttttctttctctttatgtatttattgagttacttacttgtttttgatatctttttttattatactttaagttctaggttacatgtgcacaacgtgcaggtttgttacgtatgtatacatttgccatgttggtgtgctgcacccattaactcgtcatttacattaggtatttctcctaatgcttatccctcccacctctccccaccccacaacaggacccagtgtgtgatgttccccttcctgtgtccaagtgttctcattgttcagttcccatctatgagtgagaacatgtggtgtttggttttctgtccttgcaatagtttgctcagaataatggtttccagcttcatccatgtccctacaaaggacatgaactcatccttttttatggctgcatagtattccatggtgtatatgtgccacaatttcttaatccagtctatcattgatggacatttgggttggttccaagtctttgctattgtgaatagtgccacagtaaacatacgtgtccatgtgtctttatagcagcatgatttataatcctttgggtatatacccagtagtgggatggctgagtcaaatggtatttctactctagatccttgaggaattgccacactgtcttccacaatggctgaactagtttacagtcccaccaacggtgtaaaagtgttcctatttctccacatcctctccagcacctgttgtttcctgactttttaatggtcaccattctaactggtgtgagatggtatctcattgtggttttgatttacatttttctgatggccagtgatgatgagcattttttcatgtgtcttttggctgcataaacatcttcttttgagaagtgtctgttcatatcctttgcccactttttgatggggttgtttgattttttcttgtaaatttgtttaagttctttgtagattctggatattagccctttgtcagatgcgtagattgcaaaaattttctcccattctgtaggttgcgtgttcactctgatgatagtttcttttgctgtgcagaagctcgttagtttaattagatcccatttgtcaattttggcttttgttgccattgcttttggtgttttagtcctgaagtccttgcccatgcctatgtcctgaatggtattgcctaggttttcttctagggtttttatggttttaggtctaacatttaagtctttaatccatcttgaattaatttttgtataaggtataaggaagggatccagtttcagctttctacataaggctagccagttttcccagcaccatttattaaatggggaatcctttccccatttcttgtttttgtcaggtttgtcaaagatcagatggttgtagatgtatggtattatttctgagggctctgttctgttccattggtctatatctctgttttggtaccagtaccgtgctgttttggttactgtagccttgtagtatagtttgaagtcaggtagcgtgatgcctccagctttgttcttttggcttaggattgtcttggcaatgtgggctcttttttggttccatatgaactttaaagtaattttttccaattctgtgaagaaagtcattggtagcttgatggggatggcattgaatctataaattaccttgggcagtatgaccattttcacgatattgattcttcctatccatgagcatggaatgttcttccatttatttgtgtcttcttttattccaatgagcagtggtttgtagttctccttgaagaggtccttcacatcccttgtaagttggattcctaggtattttattctctttgaagcaattgtgaatgggagttcactcatgatttggctctctgtttgtctgttattagtgtataggaatgcttgtgatttttgcacattaattttgtatcctgagactttgctgaagttgcttatcagcttaaggagattttgggctgagacaatggggttttctaaatatacaatgatgtcatctgcaaacggacaatttgacttcctcttttcctaattgaataccctttatttctttctcctgtctgattgccctggccagaacttccaacactatgttgaataggagtggtgagtgagggcatccttgtcttgtgccagttttcaaagagaatgcttccagtttttgtctattcaggatgatattggctgtgggtttgtcataaatagctcttattattttgagatacgtcccatcagtacctagtttattgagagtttttagcatgaagggctgttgaattttgtcaaagcccttttctgcatctattgagataattatgtggtttttgtcattggttctgtttatatgatggattatgtctattgatatgtgtatgttgaaccagccttgcaacccagggatgaggccaacttgatcgtggtggataagctttttgatgggctgctggattcggtttgccagtattttattgaggatttttgcatcgatgttcatcagggatattggtctaaaactctctttttttgttgtttttatgccaggctttggtatcagaatgatgctggcctcataaaatgagttagggaggattccctctttttctatcgattggaatagtttcagaaggaatggtaccagctcctctttgtacctctggtagaattcggctgtgaatccatctggtcctggactttttttgtttggtaggctattcattattgcctcaatttcagagcctgttattggtctattcagggattcaacttcttcctggtttagtcttgggagggtgtatgtgtccagtaatttatccatttcttctagattttgtagtttattttcatagaggtgtttatagtattctctgatggtagtttgtatttctgtaaaattggtggtgatatccccattatcattttttatcgtgtctatttgattcttctctcttttcttctttattagtcttgctagtggtctatcagttttgctgatcttttcaaaaaaccagctcctggattcattgattttttttttgaagggtttgttgtgtctctgtctccttcagttctgctccgatcttagttatttcttgccttctgccaacttttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttcttctcattggtttcaaagaacatctttatttctgccttcatttcgttacgtacccagtagtccattgttcagtttccatgtagttgagtggttttgagtgagtttcttaatcctgagtctagtttgattccactgtggtcagagagacagtttgttgtaatttctgttcttttacatttgctgaggagtgttttacttgcaactatgtggtcaattttggaataagtgcaatgtggtgctgagaagaatgtgtattctgttgatttgggatggagagttctatagatgtctattaggtccacttggtgcagagctgagttcaattcgtggatatccttgttaactttctgtctcgttaatttgtctaacattgacagtggggtgttaaagcctcccaatattattgtatgggagtctaagtctctttgtaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgccttttttttgttttccatttgcttggtagatcttcctccatccctttattttgagcctatgtgtgtctctgcccgtgagatgagtctcctgaatacagcacacttactggtcttgactctctatccaatttgccagtctgtgtctttcatttggagcatttagcccatttacatttaaggtgaatattgttatgtgtgaatttgatcctgtcattatgatgttagctggttattttgcttgttagttgatgcagtttcttcctggcatcaatggtctttacaatttggcatgtttttgcaatggctggtaccggttgttcctttccatgtttagtgcttccttcaggagctcttgttcagcaggcctggtagtgacaaaatctgtcagcatttgtttgtctgtaaaggattttatttctccctcacctatgaagcttagtttggctggatatgaaattctgggttgaaaattcttttctttaagaatgttgactattggcccccactctcttctggcttatagagtttctgctgagagatccactgttagtctgatgggcttccctttgtgggtaacccgacctttctctctggctgcccttaacattttttccttcatttcaactttggtgaatctgacgattatgtatcttggagttgctcttctcgaggagtatctttgtggcgttctctgtatttcctgaatttgaatgttggcctgcgttgctaggttggggaagttctcctggattatcctgaagagggttttccaacttggttccattctctccatcactttcaggtacactaatgagatgtagatttggtcttttcacatagtcccatatttcttggagtctttgtttctttttactcttttttctctaaacttctcttcttgcttcatttcattcatttgatcttcaatcactgataccctttcttccacttgatcaaatcagctactgaagcttgtgcatgtgtcacgtagttcttgtgccatggttttcagctccatcaggtcatttaaggtcttctc

SEQ ID NO: 12453 - DNA, 5708 bp, Homo sapiens
tgctcatttcctttcttttttttttcattatactttagttttagggtacatgtgcactacgtgcaggttaattacatatgtatacatgtgccatgttggtgtgctgaacccagtaactcgtcatttaacattaggtatatctccaaatgctatccctccccacttccctcaccccacaacaggccctggtgtgtgatgttcccattcctgtgtctatgtgttctcattgttcaattcccacctatgagtgaggacatgtggtgtttggttttttgtccttgcaatagtttgctgagaatgatggtttccagcttcatccatgtccctacaaaggacatgaactcatcattttttatggctgcatagtattccctggtatatatgtgccacattttcttaatccagtctatcattgttggacatttgggttggttccaagtctttgctattgtgaatagtgctgcaataaacatacgtgtgcatgtgtctttatagcagcatgatttataatcctttgggtatatacccagtaatgggatggctgggtcaaatggtatttctagttctaactgggtcaaatggtatttctagttctagatccctgaggaatcaccacactgacatccacaatggttgaactagtttacattcccaccaacagtgtaaaagtgttcctatttctccacatcctctccagcgtctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatccgttgcccactttttgatgggattgtttgtttttttcttgtaaatttgtttgagttcattgtagattctggatattagtcctttgtcagatgaatagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccttgcctatgtcctgaatggtattgcctaggttttcttctagggtttgtatggttttagatctaacatttaagtctttaatccatcttgaattaattttagtataaggtgtaaggaagggatccagtttcagctttctacatacgggtagccagttttcccagcaccatttattaaatagggaatcctttccccatttcttgtttttatcaggtttgtcaaagatcagatggttgtagatatgcggcattatttctgagggctctgttctgttccattggtctatatctctcttttgataccaataccatgctgttttggttactgtagccttgtagtatagtttgaagtcaggcagcgtgatgcctccagctttgttcttttggcttaggattgactttgcaatgcgggctctcttttggttccatatgaactttaaggtagttttttccaattctgtgaagaaagtcattggtagcttgatgggaatggcattgaatctataaattaccttgcgcagtaaggccattttcacaatattgattcttcctacccatgagcatggaatgttcttccatttgtttgtatcctcttttatttcattgagtagtggtttgtagttctcctcgaagaggtccttcacatcccttgtaagttggattcctaggtattttattctctttgaagcaattgtgaatgggagttcactcatgatttcgctctctgtttgtctgttattggtgtataagaatgcttgtgatttttgcacattgattttgtaccctgagactttgctgaagttgcctatcagcttaaggagatttggggctgagacaatggggttttctagatatataatcatgttatctgcaaacagggacaatttgacttcctcttttcctaattgaataccctttatttccttctcctgcctaattgccctggccagaacatccaacactatgttgaataggagtggtgagagagggcatccctgtcttctgccagttttcaaagggaatgcttccagtttttgcccattcagtatgatattggctgtgggtttgtcatagatagctcttattttgagatacgtcccatcaatacctaatttattgagagtttttagcatgaagtgttgttgaattttgtcaaaggccttttctgcatttattgaaataatcatgtggtttttgtcgttggttctgtttatatgctggattacgtttattgattttcgtgtgttgaaccagccttgcatcccagggatgaaacccacttgatcatggtggataagctttttgatgtactgctggatttggtttgccagtattttattgaggatttttgcattgatgttcatcagggatatcggtctaaaattctctttgtttgttgtgtccctgctaggcttttgtatcaggatgatgctgatctcataaaatgagttagggaggattccctctttttctattgattggactagtttcagaaggaatggtaccagctcctccttttacctctggtagaactcggctgtgaatccatctggtcctggactttttttggttggtaagctattaattattgcctcaatttcagagcctgttattggtctattcagagattcaacttcttccttgtttagtcttgggagagtgtatgtgtccaggaatttatccatttcttctagattttctagtttatttgtgtagaggtgtttatagtattctctgatggtagtttgtatttctgtggaattggcggtgatatcccctttatcattttttattgcgtcgatttgattcttctctcttttcttctttattagtcttgctagtggtctatcaattttgttgaccttttcaaaaaaccaggtcctggattcactgattttttgaagggttttttgtgtctctgtttccttcagttctgctctgatcttagttatttcttgccttctgctagcttttgaatgtgtttgctcttgcttctctagttcttttaattgtgatgttagggtgtccattttagatctttcctgctttctcttgtgggcatttagtgctataaatttccctctacacactgctttgaatgtgtcccagagattctggtatgttgtgtgtttgttctcgttggtttcaaagaacatctttatttctgccttcatttcgttatgtacccagtagtcattcaggagcaggttgttcagtttccatgtagttgagcagttttgagtgagtttcttaatcctgtgttctagtttgattgcactgtggtctgagagacagtttgttacaatttctgttcttttacatttgctgaggagtgctttacttccaactatgtggtccattttggaataagtgaggtgtggtgctgagaagaatgtatattctgttgatgtggggtggagagttctgtagttgtctattaggtccacttggtgcagagctgagttcaattcctggatatccttgttaactttctgtctcgttgatctgtctaatgttgacagtggggtgttaaagtctcccagtattattgtgtggtagtctaagtctctttgtaggtcactcaggacttgctttacgaatctgggtgctcctgtattgggtgcatatatatttaggatagttagctcttcttgttgaattgatccctttaccattatgtaatggccttctttgtctcttttgatctttgttggtgtaaagtctgttttatcagagactaggattgcaacccctgcctttttttcttttccatttgctcggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattgtgctcgttagttgatgcagtttcttcctagtctcgatggtctttacattttggcatgattttgcagcggctggtaccggttgtttctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatatcggcccccactctcttctggcttgtagagtttctgccgagagatctgctgttaagtctgatgggcttccctttgtgggtaacccgacctttctctctggctgcccttaacattttttccttcatttcaactttggtgaatctgacaattatgtgtcttagagttgctcttctcgaggagtatctttgtggcgttctctgtgtttcctgaatttgaatgttggccttccttgctagattggggaagttctcctgggtaatatcctgcagagtgttttccaacttggttccattctctccatcactttcagttacaccaatcagacatagatttggtcttttcacatagtcccatatttcttggaggctttgttcgtttctttttattcttttttctctaaacttctcttcttgcttcattttattcatttgattttccatcactgataccctttcttccagttgattgaatgggctactgaggcttgtgcattcgtcacgtagttctcgtgcattggttttcaccaccatcaggtcctttaagaacttctctgcattggttattctagttagccattcgtctagttttttttcaaggtttttaacttctttgccatgggttagaacttcctccttcagctcagagtagtttgatcatctgaagacttcttctctcaactcatcaaagtcattctccatccagctttgttccgttgctggtgaggagctgcgttcctttggaggaggagaggcactcgatttttagagtttccagtttttctgctctgttttttccccatctttgtggttttatctacctttggcctttgatgatggtgacgtacagatggggttttggtgtggatattctttctgtttgttagttttccttctaacggtcaggaccctcagctgcaggtctgttggagtttgctggaggtccactccagaccctgtttgcctgggtatcagcagcggaagctgcagaacagcagatattggtgagcagcaaatgttcctgcctgattgttcctctggaagttttgtctcagaggagtagtcggctgtgtgaggtgtcagtctgcccctactgggaggtgcctcccagttaggctacttgggggtcagggacccacttgaggaggcagtctgtctgttctcagatctccagctgcgtgctgggagaaccactactctcttcaaagctgtcagacagggacatttaagtctgcagaggattctgctgccttctgtttggcaatgcgctgcctccagaggtggagtctgcagaggcaggcaggcctccttgagctgtggtgggctccacccagttggagcttcctgg

SEQ ID NO: 12454 - DNA, 6198 bp, Homo sapiens
tttctattccattatttttttttattgttttattttttattttttattttattattattctactttaagttttagggtacatgtgcacaatgtgcagtttagttacatatgtatatatgtgccatgctggtgtgctgcacccattaactcgtcatttagcattaggtatatcttctaatgctatccctcccccctccccccaccccacaacagtccctagagtgtgatgttccccttcctgtgtccatgtgttctcgttgttcaattcccacctatgagtgagaacatgcggtgtttgggtttttgtccttgcgatagtttactgagaatgatatttccaatttcatccatgtccctacaaaggacatgaactcatcatttttttgtggctgcatagtattccgtggtgtatatgtgccacatttttttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggcatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatctcatttgtcaattttggcttttgttgccattgcttttggtgttttagacatgaagtccttgcccatgcctatgtcctgaatggtactgcctaggttttcttctagggtttttatggttttaggtctaagtttaagtctttaattcatcttgaattaatttttgtataaggtgtaaggaagggatccagtttcagctttctacatatggctagccagtttccccagcaccatttattaaatagggaatcctttccccattgcttatttttctcaggtttgtcaaagatcagatagttgtagatatgcagcattatttctgagggctctgttctgttccattgatctatatctctgttttggtgccagtaccatgctgttttggttactgtagccttgtagtatagtttgaagtcaggtagtgtgatgcctccagctttgttcttttggcttaggattgacttggcaatgtgggctcttttttggttccatatgaactttaaagtacttttttccaattctgtgaagaaagtcattggtagcttgatggggatggcattgaatctataaattaccttgggcagtatggccattttcatgatattgattcttcttacccatgagcatggaatgttcttccatttgtttgtatcctcttttatttcattgagcagtggtttgtagttctccttgaagaggtccttcacgtcccttgtaagttagattcctaggtattttattctctttgaaataattgtgaatgggagtttgctcatgatttggctctctgtttgtctgttgttggtgtataagaatgcttgtgatttttgtacattgattttgtatcctgagactttgctgaagttgcttatcaacttaaggagattttgggctgagacaatggggttttctagatatacaatcatgtcatctgcaaacagggacaatttgacgtcctctttcctaattgaataccctttatttccttctcctgcctaattgccctggccagaacttccaacactatgttgaataggagtggtgagagagggcatccctgtcttgtgccagttttcaaagggaatgcttccagttattgcccattcagcatgatattggctgtgggtttgtcatagatagctcttattattttgagatacgtcccatcaatacctaatttattgagagattttagcatgaagggttgttgaattttgtcaaaggccttttctgcatctattgagataatcatgtggtttttgtctttggttctgtttatatgctggattacatttattgatttgcgtatattgaaccagccttccatcctggggatgaagcccacttgatcatggtggataaggtttttgatgtgctgctggattcggtttgccagtattttattgaggatttttgcatcaatgttcatcaaggatattggtctaaaattctttttttcggttgtgtctctgcctggctttggtatcaggatgatgctggcctcataaaatgagttagggaggattccctctttttctattgattggaatagtttcagaaggaatggtaccagctcctccttatacctctggtagaattcagctgtgaatccatctggtcctggactctttttggttggtaagctattgattattgccacaatttcagagcctgttattggtctattcagagattcaacttcttcctggtttagtcttgggagggtgtatgtgtcgaggaatttatccatttcttctagattttctagtttacttgtgtagaggtgtttgtagtattctctgatggtagtttgtatttctgtgggattggtggtgatatcccctttatcattttttattgcgtctatttgattcttctctcttttcttctttattagtcttgctagcggtctatcaattttgttgatcctttcaaaaaacaagctcctggattcattaattttttgaagggttttttgtgtctctatttccttcagttctgctctgattttagttatttcttgccttctgctagcttttgaatgtgtttgctcttgcttttctaattcttttaattgtgatgttagggtgtcaattttggatctttcctgctttctcttgtgggcatttagtgctataaatttccgtctacacactgctttgaatgtgttccagagattctggtatgttgtgtctttgttctcgttggtttcaaagaacatctttatttctgccttcatttcgttatgtacccagtagtcattcaggagcaggttgttcagtttccatgtagttgagtggttttgagtgagtttcttaatactgagttctagtttgattgcactgtggtctgagagatagtttgttataatttctgttcttttacatgtgctgaggagagctttacttcgaactatgtggtcaattttggaataggtgtggtgtggtgctgaaaaaaatgtatattctgttgatttggggtggagaattctgtagatgtctattaggtccacttggtgcagagctgagttgaattcctgggtatccttgttaactttctgtctcgttgatctgtctaatgttgacagtggggtgttaaagtctcccattattattgtgtgggagtctaagtctctttgtaggtcactaaggacttgctttatgaatctggatgctcctgtattgggtgcacatgtatttaggatagttaattcttcttgttgaattgatacctttaccattatgtaatggccttctttgtctcttttgatctttgttggtttaaaatctgttttatcagaggctaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattgaagcatttagtccatttacatttaaagttaatattgttatgtgtgaatttgatcctgtcattatgatgttagctggttattttgcttgttagttgatgcagtttcttcctagcctcaatggtctttacaatttggcctgattttgcagtggctgataccggtttttcctttccatgtttagtgcttccttcaggagctcttttagggcaggcctggtggtgacaaaatctctcagcatttgcttgtctgtaaagtattttatttctccttcacttatgaagtttagttggctcaatatgaaattctgggttgaaaattcttttctttaagaatgttgaatattggcccccactctcttttggcttgcagagtttctgccgagagatctgctgttagtctgatgggcttccctttgtgggtaacctgacctttctctctggctgcccttaacattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgttcgtttctttttattcttttttctctaaacttcccttctcgcttcatttcattcatttcatcttccatcactgataccctttcttccagttgatcacatcggcccctgaggcctctgcattcttcatgtagttctcgagccttggctttcagctccatcggctcctttaagcacttcactgtattggttattgtagttatacattcatctaaatttttttcaaagtttttaacttctttgcctttggtttgaatttcctcctgtagctcggagtagtttgatcgtctgaagccttcttctctcaactcgtcaaagtcattctccgtccagctttgttctgttgctggtgaggaactgcattcctttggaggaggagaggcactctgctttttagagtttccagtttttctgctctgttttttccccatctttgtggttttatctacttttggtctttgatgatggtgatgtacagatgggtttttggtgtggatgtctttctgtttgttagttttccttctaacagacaggaccctcagctgtaggtctgttggagtttgctagaggtccactccagaccctgtttgcctgggtaacagcagcggtggctgcagaacagcggattttcatgaaccacgaatgctgctgtctgatcgttcctctggaagttttgtctcagaggagtacccggccgtatgaggtgtcagtctgcccctactggggggtgcctcccagttaggctgctcgggggtcaggggtcagggacccacttgatgaggcagtctgcgtgttctcagatctccagctgcgtgctgggagaaccattgctcccttcaaagctgtcagacagggacatttaagtctgcagaggttactgctgtctttttgtttgtctgtgccctgcccccagaggtggaacctacagaggcagtctggcctccttgagctgtggtggtctccacccagtttgagcttcccggctgctttgtttacctaagcaagcttgggcaatggcaggcgcccctcccccagcctcgctgccgccttgcagtttgatctcagactgctgtgctagcaatcagtgagactccgtgggcgtagaaccctctgagccatgtgcgggatataatctcctggtgcgccgttttttaagcccgtcagaaaagcgcagtattagagtgggagtgacccgattttctaggtgctgtctgtcacccctttctttgactaggaaagggaacttcctgaccccttgcacttcccgaatgaagcaatgcgtcgccctgctttggctcgcgtacggtgcgctgcacccactgtcctgcgcccactgtctggcactccctagtgagatgaacccggtacctcagatggaaatgcagagatcacctgtcttctgcatcgctcacgctgggagctgtagaccagagctgttcctattcagccatattggctgcccc

SEQ ID NO: 12455 - DNA, 44239 bp, Homo sapiens
atgttctttttttttttctttttctttttgttttttatactttaagttctagagtacatgtgcacaacatgcaggtttgttacatatgtatacatgtgccatgttggtgtgctgcacccattaactcgtcatttacattaggtatatctcctaatgctatccctcccccctccccccaccccacaacaggccccggtgtgtgaggttccccttcctgtgtccatgtgttctcattgttcaattcccacctatgagtgagaacatgggatgtttggttttttgtccttgcgatagtttgctgagaatgatggtttccagcttcatccatgtccctacaaaggacatgaactcatccttttttatggctgcatagtattccatggtgtatatgtgccacattttcttaatccagtctatcattgatggacatccgggttggttccaagtctttgctattgtgaatagtgccgcaataaacatacgtgtgcgtgtgtctttatagcagtatgatttataatcctttgggtatatacccagtaatgggatggctgggtcaaaaggtatttctagttctagatccctgagcaatcgccacactgtcttccacaatcgttgaactagtttacagtcccaccaacagtgtagaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtatcttttggctgcataaatgtcttcttttgagaagtgtctgttcatatactttgcccactttttgatggtgttgtttgtttttttcttataaatttgtttgagttctttgtagattctggatattagatagccctttgtcagatgagtagattgcaaaaattttctcccattctgtaggttgcctattcactctgatggtagtttcttttgctgtgcagaagctctttagtttaattagatcccatttgtcaattttgacttttgttgccattgcttttggtgttttggacatgaagtccttgcccatgcctatgtcctgaatggtattgcctaggttttcttctagggtttctatggttttaggtctaagacttaagtctttaatccatcttgaattaatttttgtataagttgtaaagaagggatccagtttcagctttctacataaggctagccagttttcccagcaccatttattaaatagggaatcctttccccatttcctctttttgtcaggtttgtcaaagattagatggttgtagatgtgtagtattatttctgagggctctcttctgttccattggtctacatctctgttttggtaccagtaccttgctgttttggttactgtagccttgtagtatagtttgaagtcaggtagcatgatgcctccagctttgttcttttggcttaggattgacttggtgatgcgggctcttttttggttccatatgaactttagttttttccaattctgtgaagaaagtcactggtagcttaatggggatggcattgaatctataaattaccttgggcagtatggccattttcatgatattgattctacctatccatgagcatggaatgttcttccatttgtttgtgtcctcttttatttcgttgagcagtggtttgtagttctctttgaagaggtccttcacatcccttgtaagttggattcctaggtattttattctctttgaagcaattgtgaatgggagttcactcatgatttggctctctgtttgtctgttattggtatataagaatgcttgtgatttttgcacattgattttgtatcctgagactttgctgaagttgcttatcagcttaaggagattttgggctgagacaatggggttttctaaatatacaatcatgtcatctgcaaacagggacagtctgacttcctcttttcctaattgaataccctttatttctttctcctgcctgattgccctggctagaacttccaacactatgttgaataggagtggtgagagaggtcatccttgtgatgtgccagttttccaagggaatgcttccagtttttgcccattcagtatgatattggctgtgggtttgtcataaatagctcttattattttgagatacgtcccatcaataccaaatttattgagagtttttagcattggagggctgttgaattttgtcaaaggccttttctgcatctattgagataatcatgtggcttttgctttggttctgtttatatgctggattacgtttattgatttgcatgtgttgaaccagccttgaatcccagggatgaagcccacttgatcatggtggaatagctttttgatgtgctgctggattcggtttgccagtattttattgaggattttttcatcgatgttcatcagggatattggtctaaaattctctttttttgttgtgtctctgccaggctttggtatcaggatgatgctggcctcataaaatgagttagggaggattccctctttctattgattggaatagtttcagaagtaatggtaccagctcctccttgtacctctggtagaattctgctgtgaatccgtctgatcctggactttttttggttggtaagctgttaattattgcctcactttcagagcctgttattggtctattcagggattcaacttcttcctggtttagtcttcggagggtgtatgtgtcgaggaatttatccatttattctagattttctagtttatttgcgtagaggtgtttatagtattctctgatggtagtttgcatttctgtgggatcggtggtgatatcccagttatcattttttcttgcgtctatttgattcttctctcttttcttctttattagtcttgctagcagtctatcaattttgttgatcttttcaaaaaaccagctcctggattcattgattttttgaagggttttttatgtctctatttccttcagttctgctctgatcttagttatttctcaccttctgctagcttttgaatgtgtttgctcttgcttctctagttcttttaattgtgatattagggtgtcaattttagatctttcctgctttctcttgtgggcatttagtgctgtaaacttccctctacatactgctttaaatgtgtcccagagattctgatatgttgtgtctttgttctcattggtttcaaagaacatctttatttctgccttcatttcattgtgtacccagtagtcattcaggaacaggttgttcagtttccatgtagttgagcggttttaagtgagtttcttaatcctgagttctagtttgattgcactgtgttctgagagacagtttgttataatttctgttcttttacatttgctgaagattgctttagttctaactatgtggtcaattttggaataagtgctgtgtggtgctgagaagaacgtatattctgttgattttgggtggagagttctgtagatgtctattaggttggcttggtgcagagctgagttcaattcctggatatccttgttaagtttctgtctcattgatctgtctaatgttgacagtggggtgttaaagtatcccattattattgtgtgggagtctaagtctctttccaggtctctaaggacttgctttatgaatctgggtgctcctgtattgggtgcatatatatttaggatagttagctcttcatgttgaattgatccctttaccattatgtaatggccttctttgtctcttttgatctttgttggtttaaagtctgttttatgagagactaggattgcaacccctgccttttttttgttttccatttgcttggtagatcttcctccatcctttattttgagcctatgtgtgtctctgcatatgagatgggtctcctgaatacagcacactgatgggtcttgactttttatccaatttgccagtctgtgtcttttaattggagcatttagcccatttacatttaaggttaatattgttgtgtgtgaatttgatcctgtcattatgatgttagctggttattttgctcgttagttgatgcagtttcttcctagcctcgatggtctttacaatttggcatgtttttgcagtggctggtgccggttcttcctttccatgtttagtgcttccttcaagagctcttgtagggcaggcctggtggtgacaaaatctctcatcatttgcttgtctgtaaaggattttatttctccttcacttatgaagcttagtttggctggatatgaaattctgggttgaaaattctttcctttaagaatgttgaatattggtccccactctcttctggcttgtagagtttctgctgagagatcagctgttaatctgctgggcttccctttgtgggtaacccaacctttctctctggctgcccttaacattttttccttcatttcaactttggtgaatctgacaattatgtgtcttggagttgctcttctggaggagtatctttgtggcgttctctgtatttcctgaatttgaatgttggcctgccttgctaggttgggaagttctcctgaataattccctgcagagtgttttccaacttggttccattctccctgtcactttcaggtacaccaatcagacgtagatgtggtcttttcacatagtcccatatttcttggaggctttgttcatttctttttactgttttttctctaaacttctcttctcgcttcatttcattcatttgatttcaatcactgataccctttcttccagttgatgaaatcagctactgaagcttgtgcatttgtcacgtagttcacgtaccatggttttcagctccatgaggtcatttaaggacttttctacactggttattctagttagccattcgtctaatcttttttcgaggtttttagcttctttgtgatgagttcgaatttcctcctttagcttggagaagtttgatcatctgtggccttcttctctcaacttgtcagtcattctccatccagctttgttccattgctggtgaggagctgtgttcttttggagggggggaggtgctctgatttttagaattttcagcttttctgctctgttttttccccatctttgtggttttatctacctttggtctatgatgatggtgatgtacagatggggttttggtgtggatgtcctttctgttttttagttttccttctaacagtcaggaccctcagctgcaggtctgttggagtttgctggaggtccactccagaccctgtttgcctgggtgtcagcagcggaggctgcagaacagtgaatattgctgaacagcaaatgttgctgcctgatcattcctctgcaagcttcgtctcagaggtgtacccggccagttgacgtgtcagtctgcccctactgggaggtgcctcctggataggctactcgggggtcagggacccacttgaggaggcagtctgtctgttctcagatctcaaactccgtgccgggagaaccactactctcttcaaaggtgtcagacatggacgtttaaatctgcagaggtttctgctgccttttgttcggctatgtcctgcccccagagttggagcctacagaggcaggcagtcctccttgagctgtggtgggctccaccctgttccatcttccaggccgctttgtttacctattcaagccttggcaatggcgggcgcccctcccccagcctcgctgctgccttgcagttggatctcagcctgctgtgctagcaatgagcgaggctccatgggcgtgggatcctctgagccatgcgcgggatataatctcctggtgtgccgtttgctaagacccttggaaaagtgcagtattagggtgggagtgaccggattttccaggtgctgtctgtcatggcttcccttggctaggaaagggaattcccttaccccttgtgcttcctaggtgaggtgatgcctcgccctgcttcagctctcgctcagtgggctgcacccactgtcctgcacccactgtccaacacgccccagtgagatgaacccggtacttcggttggaaatgcagaaatcacccatcttctgtgtcactcacactgggagctgtatactgcagctgttcctatttggccaccttgccttagaattcaaaagtatgttcttatatgaatctgtttggcttcctttgttcataggtgttttttcacagataacaaagaaaaactagatgatatatctaatgatgaaaaaaatgaattcctgaacaagataaaacaggtaagaaggcagaagtcatgacttttacattataattacatttcatttttagttaatgtttaaaatatgtgagaaatatagaatttttcaaaaggatgtttttcattgaccaataatatggttgtttgtagtaatttaaaaaattttatctcctcccaaagtactttaattatatcaaagagcaaaggttgtccatgtacagaggaactgttttttggtaacttttcatgtgagtatgggtaccttaggactatccatgattaatggattaatggatatttttgatgtgaattatttagaaagttagaatcttcttgctgttgtgtgctacgcctgtgaagtgcagcaacctgctctacacttaagaatattctaaatattatatatcatattgtgatggttaatactgagtgtcaacttgactagatcaaaggatgcaaagtattgatcttgggtgtgtctgtgagggtgttgccaaaggagattaacatttgagtcagtaggctgggaaaagcagacccacccttaatctgggtgggcagcatctaatcagctgccagtgcggccaggatataaagcaggcagaaaaacgtgaaaagactagaccagcttagcctcccagactacatctttctcccatgctggatgcttcctgctctcgaacaccagattccaggttcttcagctttggtacttggactggcttcctggctcctcagcttgcagatggcctattgtgggaccttgtgattgtgtgagttaatactccttaataaactcccctttatgtatacatctatcctgttagttctgtccctctagagaaccctgactaatacacatattataatataatattctaaatacttatttagaagtatttgagtcagatttagcccccaggaaaattcactagacatttttcaaacttaggttaaaaaaaaatcatatcataagtagataatcatgtgagtaaaccaagatttagcctcaaaatattcaatgaagccttcattaggatagtgaaaaattgggggtgagggtgagtaatacaattaaaattcaaccaaaaggccttggttaaataagtatcagtattgctcataatacgttattgagtgacaaatactatattataaaacagtaggctagtcatggtggctcacgcctgtaattccagcactttgggaggcctaggtgagtggatcacctggggtcaggggtttgagatcagcctgaccaatatggtgaaaccccatttctacaaaaataaaaaattagctgggtgtggtggtgtgcacctgtagtcccagctgctcaggaggctgagacaggagaattgcttgaacctgggagacagaggttgcagtgagctgagatcgcaccactgcactccagcctgggggcagagcaagagtccctctaaaaaagagaaacaacagtatgtatgatatgatcccatttaattacttatacacacaaatatacatacacactagacataactgaaattcttcttgtcccttgtattgaaggagaaatatccttagtatctcttcccaacacctcatatatccaaacttaatttcctttcttttctttcttttttttctttttctttttctttttttttttgagacatagtctcactctatcacccaggctggagtgcagtggcatgatctcagctcactgcaacctctgcctctggggttcaagcgattctcctgcctcagcctcccaagtggctgggattacaggcttgtgccatgacacctggctaatttttgtacttttaatagagacagggtttcattatgttggtcaggctggtctccaactcctgacctgaaatgatccacccaccaggctggaatgcagtggcatagtcacaaatcactatagcctcaacctcccaggcctaggtgatcctcctgctgcagcctgctgaatagctgagactacaggcactcaacaccatgcccagctaatttttaaattatttgcagagacaggtcgctttatgttgcctcggctggttgtgaactcctcagttcaagcaatcctcctgccttggtctcccagaatgctggggattacaggcgtgagccaccacccctagccacacatacttaattttaattgttcaggacttgggtcaggtactctctgtctacatcctctatctttgttttgcccaagtcaaccaggatataaaattcacatttttcactagtttctaaaacaaatttaattacactaagcatttcatgatctattgcaaactctgttggaaattttagtggtcatggggagaaatcctgttgcagagcacaaagccatcttgttcaccaccttttctttctctcacagttcctcatctatcttcttgctgtaggataccaccccacatccaaattcttctccctcttttacaaagcataatatctgcctctgtacccatgccctgaggctcatcagggatatcaaaggcagctccctcccagaagaatgatttgtaccaattaaatgctttccatttttgcttttgtgagctatcagcatgagagatggcttcccctctgggctactgtgattcttttatttgcaaggatacctaacaacagacagaaaccagacaaggttggtttgttggctggttggttggtttcgaatttgtctttcattttgtgagcaaaatattatttttcctcccatttgtttcctactgcagaagctagtagacaactttctgacaataactccacattttctagcccacatgattttctgaacagtctaggacccctaaactggcatggcttacttggtcaaagagttttcctttaatccatagcccttagccaaattccatggttataagtgagtgatcacttcaaagaatgcaaggctcttgcttatttattattttcactagggtagaaactatgggctcttagtgacatccaatcataattctcatgagttattggaggaacattcaaagattgacattcaactcaaactttacctttttttcccagcatctcccctccctcaccttcccttgcaaccaccattctactctctacttctgagttcagtttttttttagattttgcgtataattgggatcatgtaatatttgtttttctgtacctgaattatttcacttaacatgatgtcctccagttcatccatgtgtcacaaatgacaagaatttcttcttttttaaggctgaatatattcaattgtgcatgtatacattttctttatccattcatcggctgatgaacacctaggttgattctacatcttagctactctgaatagtgctgcaatgaacatagaagtacagatatctctttgccatactgatttcatttccttgggatatatacccagcagtggcattgttggatttagctttgttattataaaatattacacattacagaacaatacataaaccataaatatacaatatttatgtacatatttttgatgaatataatttattaattttaatgaagtccagtttatcaatctttttagttaatgttctctatgtcctatgtcatgagactattctcttctgttaccattgagaagctttgttgtttgacctttcacatttaagactacgaaccatctggaatttatgtgtatgtgctttgagatagtggtcaagattcatatttttccataaggttgtccaattaaccagcaccatttactgaaaatacaatcctttccttcactacattgtggtcatactattgtcataaatcaagtatagatcataaatgtatatgtggattgttgactctattcatttgaactattcatctctcctcacactaaaacaatattgtcttaattagtacctttaaaatgagtttttatggccagtggtataaatccttcacctttgttcttcaaaagtgttccagctattcttgaccttttcaattttgtcacgttcttccaaaaaacctgtttggattttgattgggattgtgttaaatctgtaaatcagtttgaagagggtttcacattttcacagtattgaggcttccaatccgttaacatggcatatgtcttttgttttagatcttctttgttccctttgccttagctgttcagttgcactatgatgtgtccaaattttcttttcatttttcctccttgggatttatttggcttcttaaatctgagaatttctatatttcataagttctgcaaaattttcagccattatgtcctcacctgtttcttttgtcctattctccctgtgttgcccaggctggtctctaactcctgggctcaagtgatcctcccacctccgcctctcaaagtgctaggattacaggcacgagccaccacacctggcctatagtagattttgattgctttgttttacagtattgattttactcaaatgttgagaagctctagatatttgttcatcttttaattgtgcattcttttttatttatttatttatttatttttgagacaggatctcactctgtcacccagactagagtgcagtggtatgatcatggctcactgcagcctcggacctcccagtctcaagcaatcctcctgcctcagccttccaaagggtgaagctctttggaatcccagactaaaatagtgggaggtttatgtaggctcaacacctggatgagcattacatgttggcttttgttccacttgccatgcaaaaaaacccaaaacttggttttcaagtggtttcttctatgttagtaagtgttttcaaggcagaggaattttaagtgctagccttaccgctctggattcttcattctcctagaattaggcctagcaatcacctattatcctttattttttatttttatttttttagattcaagcacatgtgcaggtttattacaagggtatattgcataatgctgagatttgggctgctaatgatcccgtcacccaagtagtgaacataatacccaataggtagttttccaacccttccccacttcttccctccatctttttggagtcccagtgtctattgttcccatctttgggtccatgtatacctaatatttagctcctacttataaatgagaatatgcagtatttcattttctgcttctgcattaatccacttaggataatggcctctaggtgcacccatgttgctagaaaggatatgatttcattcttttttatggctgcataatgttccatggtgtattattaccacattttctttatccaatccactgttcatgggcacctgggttgattccatgtctttgctattctgaatagtgcagcaataaacatgagcacaggtatcctttcggtagattaatttattttcctttgggtatatactcagtaatgggattgctgggttgaatagtaattctatttttgttttttgaataattctttgttatcttgtgagttcttcaacacttctacaaatattttttcatgtagctattttagttgtcctcagatagaaggttgttttgaactattcagcccattgtttccgctaaacttgactttcttacctcgtttgaagcaatttaataagcaaaaaattctgatctcatgtagaacactggtgggtactattttttgtcctcaaatagaaatatttcacaagaagcaagcataatatcaactcaaaaatgttttgaggaagagcttctgaggatgttacattttctatagtttatattctggaaaaggacatactaacgttgctcagcagtcacagtttattcatcccattttgcatttcaatatggattattactctatggttttgcagcagggtttactatttttctatacttaaaaaaatttatagtagaggtctcaaaatatacagttgtatgtttgctatagaattaaatcactcggcatttatggcatattcacggtgggctaagcaatatcccaggtgctctccgagttgccacctgatgcagatggcctcagaggagcagtgaagccagtcctctcattcacctcctttgtttttctctagctggttgaaacactgcatgctgctcgtatggaatacaaagacctacgagagaaaatgaaaactcttgccagacaatataagattgttttaagtgaggaagaaaaagcttttttgcaaaaacaaaagattcatgatgagtatgtctttacccacacgtgtgattcaacatgccatcattatggggtgcttttcttgctatcaaagtggtggctctccacttaaacttatcctagttttaaaatctattgacaaaaatgaaaacatttgctatcattactggtttctgtctcagcagctcaggctgccataacaaaataccatagactggctgcttaagcaacagaaattgattttctcacggttctggaggctggaagtctgagtgagggcccttttctagcttacagccacccagccgctttctctctgtgtcttcacagggtggagagagaacatgctgtctgtctggtgtctttcttttataaggtcccaccctcatgtcctcatccaaacctaatcacttccccaaaggccccatctttataatatgctcgagcattatcacgacactaatgccccacaatgttcctttctgccattctaaagcactttaaattttaattttttctcatgaaaaaagcaatgcctgtacttgatttttaaattcaaatatagaaatgtatagcttagagagtaaaaattacccaaatctctctatttcttcatcatgttgggggttagcatttcaacagataaattctggagatgggggaggcacaattcagtccacagcagtttggaagatgagtcacttagataaaatactttctgatacaggcagcttcctatcaatagctgggcatttgaacaagactataaacttctctgagcctcattattttctcctgcaatttgagacaaaaaaataactacttgaaaccccatctctactaaaaatacaaaaaattagctgggcatggtggcgggtgcttgtaatcccagctactctgaaagctgaggcaggagaatcgcttcaacccaggaggcggaggttacagtaagctaagatcataccattgcactctggcctgggcgacaagagccagactccgtctcaaaacaaaacaaacaaaaaaaacccttatcaatccacacgctgagaggagcactttacatcttattaaattcattcatccgttgagctaggcattgtaattctcattttatagctggtgaaactgaagcttattcacaggtgaagctaattgttagcttaagatcacactcttattaaaaggtagagccaatatgcaaaattaatctgactgactccttcaccttccatggaagaacatgacagaattgataagcacgttaggagagacacacccactcagagacatggagcactacacaactgttcttgttgttttgtggttactattgtggtgaatattctttcagtggcttgggaattttcataaattttatgaaaatcctatgtgtatgctgggcacagtggctcacgcctgtaatccagcactttgggaggccaacatggaccaatcgcataagaccaggcatttgataccagcctgggcaacacagggaaaccccatctctacaaaagtacaaaaatcagctgggaaaaaatttgaaaaaaagaaaatcctttgcataaatttagatctagctaccactagcaaaaagacttgctttctattttttaataatttatgtagcaaatagctcatgatctgaactttcaaaactatttttgaaattcttatttgtgtttgcatatttatgtcagccttcaacaaataactctgtttttcatgatagaaatcagaaacagctgacatttatttctcagaaagaatactttctgtcacaaaagagagtagacatcaaaaatatggaagaaggactcatcacactccaggaacttcaacagtatgtttgttgcctttgaaattttttatctttactttctctgcatttattttttaataaatgatagcagtaaatctatgttgatttctaacatactacagaaaaggaagtttagaactagctctctctgtttcacagtctggaagtcactctcatggactttttcattgaaaggataaacaggttctgaattctatgggagctcctgggccccaggaatggaccagttggggtgcagtgacaagaatgtgcctgaacattatcacaacactgagtcccattgatgttcatttctgcattctaagtcattttaattttaatttttttctgattaaaaaataatacctgtacatgattttaaaattcatatataaaatgcataacttagagaataaaagttaccctaaaatctccatctctccacaggcataatcactgttaacagtttacaatatatgctttcaaatatatatttatatgtatgtatccaaaaattggattatactctactataactgaatttgttccacttaaaattatacctaggaggatgataaaacaaataaggtaaaatgttaacagttggagaatttggtgaaggatatatgggaattctttgtactatttttttatgcttacctgttgagtttaaaactatttcaaaacaaagagaatatatatatattctcaatatatctcaatcttttctctaactgcatagtattctatgcagattatagtataatacacattatactatactgtatttaaccagcactctattgatggagatttacttttgtctgttgcctatattacaaatatttgaagttaacatatctctctctacccatatgactttttttttgtaataaagtcctaaaagttgaagtgctggatcaaaggaggatgcatatttttcacttttataatgattgtcaaaatgacctatgtaaatattctaccattgtacacattaagactgagcataaggagcttatagttcagttgggcagagaagcaagactaacacatatgaaataattaatgaaccacatatgatggtgaaaaataaaccatgtatgacagtgaattatataaaacagtcgggcatgaaagtgaaatcaaggagtccttcgttatataggatttaaaatttgaactagacctttaaaagcaagtcagatttttctgtgctcattgtatgggagaatgatatcaccacacaaagggagacacatgatttaaatataggacaatcaagaagccagcttatagaactaaggtagggggtgatgaaaattcaagcacataccaacagatatctggaatgtgacaggaagcataggttccttgcttgaatggttgtccccatattgttaaataatatattcaaacatctgtttccaattatgtcagcttcataaggaaaactacgaactactaataaaagaggaggaagatcgatttggactgaatcaggttttatgttcctcatgaataatgcaaattttatagtcagttactgtgcataattgctctggtcaccaggaatctcaaagccaaatttgtggcccaatgttattatccatttaggatttttttatattattgttgctttattttaaactggttcaagttctttatggattacattaaatatgtaaataaacaaaatcagtaaggttggggtgaattgtgaagacccttagagatccagaggaggatattagatttattttggtaggaaattgagagtccatactacagtttcaaacagacaaagaaacacgagaacaggtatgtttctagtttatttaagagtgtttcctattctaagtttcatttgtgaatatttctttcaaaagatataaagcagcattttacttatgtggctttcaattcatttctgtccaagaatcacttaatagggaaaaggcggggctggggataaaaataaaggcttctgttacctatgttggaatcttcacatttccatccatcctaccacaagaaaatcttctatccttagttagtacttttccccagttcaagaaactatattggctttctgaattgtatattatatcaaatcagagctcaatctagggtctggagttcctcaacaatgtgttgaccttacttcctcttgtgtcatagggttattctttccttcatgtcctctgtatacagcaagcctaacttaagtcatagcagaggcctgacttgctgttccttccctctgtatttgcaaatgatgacaccctttccttggtaagattgcacctccattctggcaatccacattcctccctctgagaaacattaacctctagtaacccttcatcagttgcctccccagaaatctcttctctatccttggctattcaccacaaccgttgcagaatcagtttgcactaacatagaattgcaattgtctatcagtctgccactgaaatgtttagttgtttcacaaggcttattttgtctcccaattagactatagccttactgagcatacaaattatgcgtatagagtctattgtatattctaacagctcccataaatgcaaaatccaatatgtttttctttttagagcaacaaaaacagtgtatcagcaacaaatcaaaatcctgagtgctaacctggaaagagaaagtcagagatggtaaaaaaaaaaaaaaaaaaaaaaaagtttatttgtgttttgtgttatcagcagtatatgttatcttaatgaacagtgcagagtacttgttgttactagaacccaagggaatgattttcctaaattatgtgtaaattctctcggatctagatgtattggttaatttgatttttttttttttggcattgaacagaatcaaagttttccatttcaatcaagtgcggtcaccaaagagtaaaattgctaatatttgtgcaatgccttttgctcatccaggcctctttgtgaaccagtaggggaggtgacaggtatggtaagagaggaaggtggcgtgaaggctactggctctgcagatggcctgctttggttgctgtccttattagctctgtgaccaaggctaagttatttaatcacttctctttgctcccatccctataaagtggggaaggataacagtatctaccttataaagtagctgtgaatgtaaatgagatgatacatgtaaaatactgtatttagatcagtgcagctaaaaagctcttgcttatacttagctgtattttattatcgttgttgttattgttagtattattattattattttgagacagagtcttgctctgtcgcccaagatggagtgcagtggtgccatctcggcacactgcaacctctgcctcccaggttcaagcgattctcatgcctcagccaccagattagctaggactaccggcacgcactaccactcccagttaattttgtttgtttgtttgtttttgagacggactctcactccattgcccaggctgaagtgcagtggagtgatctcggctcaccacaacctccgcttcccaggttcaagcaattctcctgatagctgggattacaggcatgcactatcatgcccggctaatttttgtatttttagtagagatggggtttcactatgttggccacgctgctctcaaactcttggcctcaagtgatctgcccaccttggcctcccaaagtgctgggattacaggcatgagccaccatgcctggccaatgttattattgaatgtgcacttaaagactctaattgcacttttttttttgagacagagtttcactctttttgcccaggatagagtgcaatggcacaatctcagctcaccgcaacccccacctcccaggttcaagtgattctcctgcctcagcctcccaagtagctgggattacaggcttgtgccaccacacctggctaatttgtttgtatttttagtagagacagggtttctccatgttgggcaggctggtcttgaatgcctgacctcaggtgatctgcccgcctcggcctcccaaagtgctgggattataggcgtgagccactgcgcctggccctaattgcacatttttaccattcttcaaatatgtagctttttaatgttgtggtggagaaaaatttgagaaagcagaagtttgaaatctatcagtagcacatccggtaatttaggtaattctattactatttctgcctgggcctcattttccacttgccccaagccttcctcatttctatcctttacctgaaggaggcaagctgccaggtgtgctttgttcgctgttctattggaagtgtagatgtaacttcttactctgaagcaacttgcagagacagaattgaggcagttaatgttttgtcttactttttcatgcaatgtgtgtagtctgcaacactaatagcacaaacaattttgtgtagtcatagtatgacttgttttgctttgaatttcttcatctttttagtaaactgctatgtcaatttaatggcaattctttttgctctaatctctagtgttataactcagtggaaaatggcttgcttgagaaaaaagcatgcacgttggacagccaagataaaagctgaaatacaagctattacagaaaaaattcagaatgcagaagttagacgaattgaattacttaacgaggtaagagaactgaaagaacttagaattagtcccctacattgcatatcagcaattctcctttaatatttaattaaatcctatcttattaaaaagtattttcctttctgctgatttcatgtttagagtgagttatttgattttcttaggaaatgtattcacttgctgtatattaactagagagaattagcaaatacagtagaatatgcttttgaagcatgtaaccagaaacttacttgaggttagtctttaggggaattacctctaaaaatatgagcccatgtatcatttctttaagcttttatagttaccctctgctcactcactgtcctctaccctccccactcctcatgtcatatttataaaaatatcacttggtgaagaacttaatttctggaggaaaaaaatattcctctcagtggttgctgagaaattatatgaactgaaatcagaagcaggcctcctgcaaagagatattaatttcctggctattcgaaaatgtaaggctgatcactacaagagaaatgacaaattcttatttttctctaattagaccagtttcagacaacaggagatcagtggatttgtggcacagattgaaaaacttacaacagaattaaaagaagaggagaaagcatttgttaacaaagaaaaaatgttaatgaaagagttaagcaagtatgaggtaaattttattttgcatctaagaatacttttggatgactacatgagggggagggggaataatatttcatgctattctaatcagttaaatgtaaaataaatattctagtatgaaagaggctacaatttcattctggatctttcttcttttcctgaagaggaagcagagcaataagaaatattttttcagaaaaaataataataataatcacacttcaaattatgtagaactgttggcaatggccttagagacaggtggagttgtgtaggaagccatttggagctggcttgaaaatagctggggcaagggagattagtaaagtcagtctcagatgtgctctttaaaaagagggtatcatgctgtcttgagaactgccaaaagccaacctgagatagaacagggcatggatgctgggggaggtggagagaaaagccactgaaagtacccagaagtgccaggtccacagaaacacaataaaaaaatgcaccttcccaaggcgatgatattaccctggaggcagccattagcagagcagctgagaacagggatggtggtagaagccttcctgaacttgatcaggtttgaaaatgaagaagaggtcttggccacaccaaagaggggctttatttgaaggaaataaccccatactgcaggatgaaaatagggagcttggaaatttcctaatttagagtctttacctgatccaagttgtcttcccccaccccatcccatcctgccacatcctgcagaaaccctctgcagatgactggcccaaggacagccagttctttctattaataatattaataaccaaaagaaagtagtcacatttttcatacaaaaatactaggagaaaaactactgaaaagaggagcaaactttcctacaaatgaagaacactcagaaaaaatggtggcatggaacaaataaaaactatgatcaggccaggtgcagtggctcaggccagtaatcccagcactttgggaggccaaggtaggtggatcacgatgtcaggagttcaagatcagcctggccaagatagtgaaacctcgtctctactaaaaatacaaaaaaattagccaggcatggtggcatgcccctgtaatcccagctactcgggaggctgaggcagagaattacctgaacccagcaggcagaggttgcagtgagccgagatcacaccactgcactccagcctgggcgacagagcgagactccatctcaaaaacaaacaaacaaaatactatgatcaaacattcttctatgaatttaaaaaaataatttaatagcagtacaaaggaaaattattagcatggaaatgtagacacttagggaagagatgtcagaaggtgagggccagaaaataggaagaggtgaaacagaaaccggtgcaactcggggaacaaacgaaggaaagatgacacaaatgactacaatgttagaagaaacggggtgaggggggagaggaggcggggtggaaagcattagtctaggtgcctggcattcttctaaatgctgaaaaacaggcaaaaactctgcctttatggagctttctatctagcacgggggaatgaaaataaatgagatgaacaagtagtatattggatggtgataaatggcatagagaaaaatcaagcagggaagtgggatagggagagtgcacgtgatatggtctgtgtgctgttgtaaataggggtagtcagagaagggtccagctctgaatataaggcagggtgccctgcagatgtctgcaggagatggctccgggcagagggcatgctaggcaggaagggcctgaggcaggaccctcctatctaaggaatcacaagggggtggggttgctgaataagagctggggagtgccaggggtggtgggagtcatgttcatgaagcagatgctgagatggaattaggagtgataaggtatattagggagaagtatctatgacaagattgggcagggaaagctgtcaggccattatgtagcctgacaaactctctctggggagctctggagcaaggattgcctgttagaagaggactgccttgggcagaaatggcttcctgcatccttgtaccacctccttgcttagtcactgactgggactgccccaaaggagcatgatattggctagatagctgagctgaccctgaaggagccaactattggatgtgtgagctaaacacattcctcacaatggtgtggcgagtccgccttcaaggggagatccaagtggagcatcaggcacacccttataggccatcataagtactttgtcctttgttgtgtctgggctagaaagccattggagggttctgagtggagagctgaaataatctgagtttttcctttaattaggatcattctagcttctatgttgagtggaatttaggaaagaaaagggtggacataggaagaacaattagggagctaaagcaataacccaagttagaaatgaaggtagcttgaacaaaaatggtaaccaaagaggtgttaagaagcggtcagtatctcagatatttttgataattttaccatcatgcctactggtaaaacaatgagggcaatcccctttgagtcatgaacaggataaggaataaggatcctatttaactttttactcaagtttatacagtgcaattaggcaagatacataaaatagaagcataagacttggcagatgagatgatcagtagatcgcaaaactcaagaaaatcaactgcaaaaccactacacacaagcctccagcctgcactcggcttgccaggctgtgtgcccactgcaggactgtgtccacccatgcctaattcacacaaagggatgggccaatgacagcctgtgcaccattattatatagcaataacccaatttcccctcgataatcagcaccaataacctcaggcacattgtaatcccatttctgcctttgattcagtggcatgaggagcccaaaattagaaggaagcaacctcacattgtggtttatgaaactattgttgtgcccctggtggaaccatttttctccccactagtatctctaaatcaacagaacccaaagtcacacggaggaaaagcaaaatcattaggtttaatagtgagaagtcccactaccatttgggtctctgacccatacattctaaggaaaacagccctgaatattaattagattagtcactggttcataatataaacatcccagtgttgggatgtgttgtcgacagggcagtgctgtggctgacttttccataggcctgactctgataccggaccctccgttgtaaatcttctatcagagcttgccacagatttttcacatcatcctgataaagcatggacaagcccaggccaaggaccattcacttttctgggtcctacagccccgtatatggcagaatttgatcagagaagcagagctgccaggaaaagggtttattataggacttgaccttctgcaactgtgatatctagttacacagtctggtgaggctgtcagctttacatctggtgctggggcctgaagtcagcagggcaggtacttgggatggaaagaccaacaggaagtgaatggaagcaaaaacaaactagaactcacaggatgagcgagggtggactggaatctgcattggtctctcttttccaacgctccaccttcagggagatgggggacctggatcagaaactggagcctgtcatcactgatctataaatatgcatgtggcttaggaatcagagacaatgagaaaggatctagaaggatctgaagaccgtgtgaaccttactggctgccccactccaacaacctgagcccacaggcaagcaacttgctacactgaacctagtaccccacagtctctttcagagaacggaacaagagaatggcttcttatcacagcagccctgggaacctgagctgcatacaggcaatggaatgaattaatgcatgcacatacaaacttgtatttacaggctattcttgtttaaaaaacctagtatggataatacaggattgcgtttctttttttttttttttttttaaaaggggtctcaccctgttgcccaggctggagtgcagtggcgcgatctaggctcactgcaacctccgcctcccgggttcaagcgattctcctgcctcagcctcccaagtagctgggactacaggtgcatgccaccaggcctggctaatttttttgtatttttagtagagacggggtttcaccatgttagccaggatagtctcgatctcctgaccttgtgatctgcccgcctctgcctcccaaagtgctgggattccaggtgtgagccaccatgcctggctggattgagtttcttaactcaacctgcttaaatgttgcagtctggagaaatgtactcctgcttctgcattatgatatttttgaattatggtatttttctatgcattttagcttctttgtatttattcataaggatgctaatggcaatttgggaggagacatatcagccagcatatcggtgtattagttaaggtgcaagaaaactactctatcaaagatatgctaaaacacagtgaacataagcaagatgtgaaaagggttaacaaccctctttcctttttcattgggaaactggccctgggttaaccactttctggctccttcccctaatagcctgatgaaggtagaatatcagctatattatgaagcaacattgcttgtataacaatgactcctgatttgtatgctgcatcttgactggaaaaataacccatgggaaactgtggcattgggcttccctgggtttggtggctctcttaagtgggtatgccctttgaaatctggaagatacgtccaagagatattagttcctatatgaacatggggtttctaagccagggagactataaccccacctgtgtgagtctctctgtctctcttgcatctgaagtatcactttggtgggcttgaaggaaacagccactggtctgctgtcttgtgcagacacctcccaataaggaagcatgcctggcactgccctgctaaaacttagcatttccttccaattatgtgtgcatacaacttggataaaaatgaaaaccaaaactaaaagtttttaagagtaaactgggacaagtgtagcctaatcaaattttgtgagtctgaacatctagtcgggaagatgctcaaaggggtcattacagcaagagagatgtttgtttctctttcccagtccaggccatagggaaggggtccagggctggcagggtggctctgccatcctcagcatgagcctaacatctgtgcgtcaaggagtagcttccattctcattctcctctggccaggggagggaggaaaggaacaggggagcacacagctgttcctgttgcaggagcagagcccagaagtggcacacatgacttccatgcacaaactccttggtcacacccacccacaagggaaggccagaaaccacactctagccagaagccatgtgctcagctgaaactcaggagccctaatattgaaggagaagagaacaaacattaaatgtcagctggtggtctctgccttagtcaccatttaaaatccatcctgatttgctaagaaaggtccaactattattccatttgaaactaaacaaaacttgagtttgaataagtaggcaggcatcttcatgttttgctttgggcactttttactcatttattttaacattatatccaattacttctatctttttcccatttctcacatccaacatttcttagaagtgtattctgtttatctgcctctttttggtaaaatattactgaaggaaattttctcagatatgtttttgggctgtatacatggtagtgttcatagagatatagcagaagaggtttaaagcagaagggatctttagagaaccaattgaatctaatctccttactttgtggattgtcagagtgtcagtgagtcagggaacaaatatttattaaaagattagtatatgccatatgtctttctatgtacctcaggataggagaccaagacagatgaaactctttccctcaaaaaacttatattctactttaaattgttgtgtgaattatccaaaattatatttctcaattgattttattttctttaaaggaaatatttgttaaggaaacacaaattaacaaagaaaaggaagaagaactagttgagtatcttccacaacttcaggtggcagaacaagagtataaagagaaaagaagaaagttagaagagctcagtaatattattacaggtacatatgaagcatttagtaattaaactcaatcccaggtaaggatttcactgtcatcttctaacacaaggaggtcatcagttacaagccaatggtgaaactcaccaaactttccccattacctttagccctctgttctctagtttttgcttcacctactaatttctcctccacactaccatcttaccattgctattgtcaaaattttccttttctcttttaaaaactatttaagacttagtcctttaccatattattttctttctctccatacttgggaaaggtagaactaactcatttgtttgctaccatgtggaattttttttgtattttcttaccgtgaatttgcaaattatatctcttttcctgctatgattttaaccatttattgagtaagcactcctcagattttttttttcactaacttcctcctgaggcacagataggtaagagcttgtctcagatctgagagttagtagaggacgtgaaatatgtccgaaagtatgcatattttaaattatattacatggtataatcatgcatgtttaatataaaaataattattttctccacaaaaaattggatgtaatcattcaaccctgtgcccaaggtccaaagtttatatatccagaatctttttttttttttaaacaaaaccaaaaacacacagggtctcactatgttgcccaggctaatctcaaactcctgggcttaggagatccttctgccttggcctcccaaagtgctgtgcctggcccagaatcatctttttgggttttgagtcttgtattgcatttggtgagtagagggtcattatctaaggaatccgcccaggtctttaagcaggaacaacttccagaatttgtatcttctagatgatgaaagaagagacatgggaatcagaaggccaggaccaaaagttacagaaaggactacaatgggaacaaaaattgtctactggttagcaaagacaaatatggggataggaattaaaatcgcctgtgtcaaaatgggacattcatatggaaccccaatatgttcaaatgtagaataaaaaaatattcagaagtgaatagtgattattgccaaggagggtggatttttaaaaatgtaagaatgttataataataatacatgggtaattggcctggtacccactcctcagatgattttccactttcttgtcaggttttcatttagtcaacttaagtaggttttcttggcctcttatcacttttacccagacttacaatacatatgtctcttattcccaattttcttttcttttcccttccctcccctcccctcccctcctctcccctccccttcccttcctttcctttccttttctttctttctctctctctctgtctctttcttttttgctttctttctttctttttttgagatggagtctcactctgttgtccaggctggagtgcaatggtacaatctctgctcactgcaacctccacctcctgggttcaagcgattctcctgcctcagcctcctgagtagctgggattacaggtgtgcgccaccatgcctggccaatttttgtatttttagtagagatggggtttcaccatgttggtcagggtggtcgtgaactcctggcctcatgaggtccacctcagcctcccaaagtgctgggattataggcatgagccaccacacccagcctagtcccaattttctactttcccagccattcttcctatccctttgtttactaggtagaggatgtaagaaacagtaggagtataaaagtaagcaaaaacattgcaagtactaaatctcttaatgtaaacaaaggggagaaaatgctgaagaaagtagataaaagagaggaagacaggagaaaagaagtaaaaggaacataagagtgggaaagttgacctgccagcagttacgcttgcagagaatggcatgcatgggctccatacacagaaagcttttagttaaatctgatggataaagcatgtacatatatctttgttccctcataaaactcccaaatatgtatataaaggtttttttttctgaaaaagatacaaatccataagtaccaagacactggaagagataagacatttgctatctgctgatttattatttatttattacctgataatatcaacaaattttgggaagatgtaattggatagaggcagaaagagaaatataaacaccaaaagcctgccaaaaagggcacgatgaaggcaaaaagttctttcccccaaagctgtaaagtcataggcagtggcatcccctgaaactatgacagctgagatgagtcacagggctaaaggttggttgaaagtctttataaagagcaattagagctccaggtcaaatccccttcttgtgcagttagctgagtgactcctcctcctcaatgctggcaaaagaaactggaccagatggcttcagaccgcaaggcatcagatatggctgagagcagaagacaggtactgtactgagatccccactgagatcccctctgagctcagtttgctgaatgctgccagccagtggtgttgtgaactcttccataatcccttaccccaacctgaggaaggagactaacatattcttccttaaaggaaactgaacaattcagagaaaagccccacaacagcaccgacattcgatggtcccctcaaatggctggttccttcctgatcactgtatattgaagctcacccaggactattaaatgggatcagacaaagatctgaagcatccagtgtgaaagagaaactgaaatggacagaacaagagaacttgatggaaacagagaaaatgcaaagagcataagcatacttttaaagagtatattcttagagaaataaatatattgcatttttgaaaaaagaaaatgatgcttaaagattagagaacagaaagagctctcagaaattaaaagtataataacaaatgttaaaattcaataggaaaattataagaaaagttaagaaaatctctgtaaaaatagagcaacaacaacaaaaagagatgaggaaaaggagagaaaggcaagaaaatttaaaaactattctgagatgccaaatatctaccaaacaagaccagaaaaaaatcagtgaataatgcttacattattataatgatctaaagagttaaaatttatttaaacgaaaactataactttataggaaggttagggatgaaatgtagaggttgtgggtgtgggtgggggatgtgggaatgggagtaagcatgctaaaatctcctctactatatatgacgaataagtagaaactgcctgacaatgataaatcaagatatagccatatattcatgtttttaaagaactaataaaattatcaaagaaataatacaaaaatatttcttataactagagaatatagatttccatttttaaatgtccaagcaaatccccaaaacaatatttaaaagaaaagactaagccatattagtgtggaatttcagaaggaaaaatggaaagagaggatcctaaaagctcctagagagaaaaatcagatctcacacaaaatattagaaatcagaatcatttcaaacttcttaacagcaatattatagtagaagttataagacaatgccttcaaaatttgagagaaaataatttccaacattagatacccagctaaactatcaagaatatagaatagaaacatattgagatatacaagatctcaaaacatttatcccatttactctttttcctgaagatgtctagaatttgcttcaacaaatagaataaatgaatcaagaaaaagagtataagaaatttaggaaacaggaggtccgacataagaataatacaaagggttctggttgaataaaacctttaaaaaaagaaaaagaaaaatgcaaaaggaagtccaaagaagtcagctgcaaagcaagcacaaagaaagaaaagattccagaaggcatatctcagagggaggttctgagggagaggggagaaatgaaactcacagatatgttaatgtgtttgactatatgtgaaataaaatttgaaaggttgtacagttctgttgtagatttggtatgaattaattatatgtacatgaaacactgagcaattttttaaacaaagcaatctttaactccaagaaaaaacaaaaattatactaaaaagaaaatctaatcatattataccatttggctcatcggggataatccttattgccataatgatctaaatggttacaatttatttaaacaaaaactataactttataggaaggttagggatgaaatatagaggttgtaggtgtgggagaaggatgtgggaatgggactaagtaaatggaaaatgcctgaaaatgataaatcagaaaataggcatatatgcatatttttaaagaaaattgagctaaatggaagaggaaacaactaaaaagagttaaaaatgtttgattctgaggagtcagacaggagtaaacatagcattgtggagtgcctgacagttggtttttgttataaaccttgtgagataatttgatttttaaaactaggtacttctttgattaatattttttaactaaatttttgaggtagttatttttttctttgttttaatagcacaaagacaggaggaagatttactgaacaatcacatttttctgtttacaagggacttttcaagatacattagcaacatggtaaaagatcaatgcattaattcttttttttattattattagaatagtggtatatacagatggtagtatttacctggcattgaagttttcatgaaatccacatttgttaaacttacccattcaatatcaatgtttaacaatctttgttataacacatatatatgcacatgtatacacatacacctgtacacatatgctatgtatgtatgtgtatatatgtatacttatgtgtatatgtatacagagaaagagggagagagactagaaccaactaacatgtacttgtggaacagtcattgagtggacctcggttttcttatttataagttagaaacttgattctgctttttaagggtgagtgaacaaaggttgcagtgggggagtggatgaattagcagcaggtaaagagatgtttagtgcctttttaaaatttacaatcaacagttggtgataagcatatgcatgtggaattggttaattaaaaatggaaacattctctgagatgcattgatatcaaaatgtaacttttttttttttttgagatggagtctcactctgttgcccaggctcgagtgcagtggcacaatctcggcttactgcaacctcagcctcccaggttcaagcgatttctggctaatttttgtattttttagtagagatgaggtttcaccatgttggccaggctggtttcgaactcttgatctcaagtgatccgcctgcctcggcctcccaaagtgccgggattataggtgtgagctactgcaccaggcttcaaaatgtaacttttaatacgttataaaatatgaaggaatatataggaaaatatgaaggagaaaattacaagtatagtgtatatacagttccattttcttaataagatgcttctggtgatgattatgtaataataaatatcatgcaacttataatagtataataatagagaactgaatagagaattcaatagagaaaacattagagaattctgaaaaaattcataatcttcttctttcttcaagaaacattaagtcctcctttaaaagcctcaatacatttccccttctctatttttgctggacaattgtttatatatcaaagtacagtcatcccttgatatctatgggggattggttccaggaccaacatgactatcaaaatccacggatgctcaaatcccttgtatgacatgatgtagtatttgcatataacctacccacattctccaatatactttaaattatttctagattactgataatatctaatataatgtaaatgctatgttagtagttgtcatactgtattgtttattatttgtattatttgttgttgttattatttttatttttgtgaatgtattctattcatgtttagtcaaatccacaaatgcggaacccacggatacagagggctgactgtatattttattttgtgaagttgtctcaaggtctggggttcttatcttgaagtccacagacccccttcctagagtccatgaataaatgtggggttgataggtttttctaaggaagaatatctatcctctgctggatacttcagaaattaatttagaatctggctccaaatgtgacctaggcagtataataccctcgtgccctactgtttgaactcagagataatttggggttttctgtttgagcaggaagatgtaaaacaagaattacaacaattacgagatcaagaaagcaaaaaaaacaaagatcattttgaaactctaaagaacttagaaaatggattctatataaatgaccaaaaagcagatcttctgctcctggaaaataaaaaattaaaagaagtaagtttaagagcaccatccttttcatgatggctttgattaattgactagacctgtaatagttataagagaaaagaagagaatagctcttgaaaaatgtttaatggagcataaagtacacacagaaaagtgcccagattgcaagtgtacagccccatgaacacacttgtgtaccaggacccacatcaagaaacaaagcattatcagtatccagatatcctctatgccccttctagtcactaaccagccccactaagggtaccaccatgctaacaccataggctagttttccctggtttggaacattataggtatagaacaatacagtgtaggttcttttgctcaacattatgtttgtgaggttcagccttattgttgagtgtagtttgttattcttagttctgtatagtattgcactgtatgactactactacaatgcatttatacactcgactattgatggatattcagagagtttctagtttttggctattacaaatagtattgctgtgaacattctagttcatgtttttttggtgaacatacatacatatttctgttgagtgtacatctcaagtggaattgcagagccatagggatgtgtatctccaactttagtacatactaccagtctcccaaaggagttgcaccaattgccactcccaccagcaatgcatgagagcaccagttgctccacactctcacaaaactgtctttttcaatttaaccattctaatgggtgtgtagtggtgccccactaatttgtgttttcctgatcactgttgaagcacctattctatgttgctggcctcttggatatcctttttttgtgaagtgactgttcaagtcttttgcccgttttttaaaaagtaggttgtctatttcatactgattatagctctttttatagcagaggaatttgttcatccaacccctaaaattaaagtctatttatacttaaaatgtattcgttttaacattttaaatgttatatttaataattagatatttataagatactgatttttaatgcccagaactgttgcattcaaagcatatttttaaagtgtatagagtccaacattttatatactgtgacaaaacagtaacaacaaaaatttacataatattctttagtttgaaagacctggattagagtctgtcattcaccagtgacactgtgtgactttgggcagatcactgaacttgtaagcttcattttggcctcttaaaatgggaataactgctactcacaggttgaatgtgactttttttttttcttttttcttttttgagacggagtcttgctctgtcgcccaggctggagtgcagtggcacgatctcggctcactgcaagctccgcctcccaggttcacgccattctcctgcctcagcctcccgagtagctgggactacaggtgcccgccaccatgcccggctaattttttgtatttttagtagagacggggtttcaccgtgttagccaggatggtctcgatctcctgaccttgtgatccgcccgcctcggcctcccatagtgctaggattacaggcttgagccaccgcgcccggctgaatgtgacttctttataaactgaaaaggcaaaagaaataccatttctaaaatcctttttttccagccatccataatgacctcatggtcaagatctgttatcaatgtaccccaagtgttttgcacaatgcctgtaatgttagagggattcagtctcatttgacgtttaagactgtaaccttaaaaagtggataatacattgtgtcccttttatagatgtgtaaattgaagctgtattttttttagaagttttaatagctagaaaaaaatcagtgactagtccaatggcatgaagaaaatccttcacctcgctgggtaatttttttcatctgttaaatggcaatagttatcccaccactctcatgggtttttttataaactaaaatggcataataggtactaatgtactttgaaaaggtaattgtgctccaaagagcctagatacataccatcattgataaccctcacacatgcaatgcaccttcattcttctagaccttgagacaaactgatttgttccactagactgtcttcctatcaagatatagattatttcttaaaagaattggaatatgtattgctattttggcagtaggtgagcagatggatgtgtggatgaaagactgattatgaaagtcctgttttttttaaattcagtgtccatctgctagtcaccgaatgactctgtgctgttttcttattcactcaccactcagttttgctggttgcatctctttactctaaacatgcactgagtcccaagcactgggcaagacacagtaaatacagagataagtaagatactgccgcagccctttggaagctcatggtctagctgaagagatgcacatagaaacagatcattacaattcagtatgttaagtgcaacaatctgaacaagacacatacagtgccccagagcaagggaaccttgccacaccaggtgaagaacacaaaggagaactctcactgtgtatcattaatgtagaggcaggatttacacctgggagatggatgagtctcttcagggacagtgtgttaagtgagaagattaggggctgtgaacagaatcctggagaaaaacaactttgaaggagtgagctgtggagaggagataaaaagagagactgaaagaaaatagagagtttgggagaagcacaagagtccagctgaactaggaaagtctgcagacccatggtcaaagaggggcaagaatgtggccttgcggttggcttaaggtggcttttacttttgtttactataatatcagaaaacaagctatgaaaaggctgacacaacatcaaagatacatgagtagaccctataatacacgcttagaaacagtctacgtaacagtcccatgtctacctcatctgtagcactgaacacaatttcaaagatttttatggatagtttatagtatttgtttctttcttgaaactggaccagttttatgtcccaaagcccatatttccagagttcctgggactttagagtttctgggcattgggtggtcagaacagaaagccatgactgtaatactcaaagtcacctgtcactactgccaccactggcacccaacccagtgaacatctgacttgagtaagtaattccatgcagtctcctgactcaattaatcatctctctgaggtcttacactgaatgccagtctggcagcattactgctttgtgacatctactgtacacacattttgcataaggaacatttttgttgtggacatattgcattcagacagaacaccttctaatttcttttggtggaaaattatactcagaatgccatgtttatttaaatgctgaagtgaaatgcttcataggaagcagaatcctttatctcctttcccaggatggaatcctgaccaaggtatgttttattccccactgttacccctgtacctagaatagtgggtggcgcagaggaggaatttatacatgtttgctgaatgactacatgataatttatctatagtaactaaactgctaaaagcaatcacatgcttttaattttcagtatattttatacttgaagaataacatagagaaatacagagaaggacaagaagccctcatgcacacctcaagcgacttgtctcggcaactaatagctcaggagggtaagtaatgtgtgggtgcttgtattagtcagggttctttagcgggacagaactaataggatatatgtatatatgaaagggagcttattaaggagaactgactcacatgatcacaaggtaaagtcccatgataggtcttctgcaagttgaggagcaaggaatccagtggtggatccgtcagagtcccaaagcctcacaagtagggaagccaacagtgcagccttcagtctgtggccaaaggcccaagagcccctgccaaaccactggtgtaaatccaagagtccaaaagctgaagaacttggagtccaatgttcgagggcaggaagcatctagcacaggagaaagaggaatcttggaagactcagccagtctagccacgctggcagctgattagacggttcccacccagattgagagtgggtttgcctctcccaatccacagactcaaatgtgaatctcctttggttaacaccctcatagacatacccaggaacagtactttgcatctttcaatccagtcaagttgacaatattaaccattacagtgttctttacatataaagtttttacttcatttaaatccagtttattgatttgcatacaaaaaatgcacccattttcaggttagtgaatttgacaaatgtacatgctattgtaaccactatcaccacaagcaagatatagagcattttcatgactacaaaattttctctgtatccctttgccgtcgatcacctaccccatctctagttcctggaaaccattgatctgctttctgtcattaataatgagatataaatgaaatgacagggtgcacacttttatacctggcttctttcactcagcaaattgttttaagattcatctaagttgttgcatgtctcactagtttgctcctttttatagctgtacagtagaatcccattgtatagatataccatattttatttattcattcaccagtcgaaagacatttagattatttccagtttgggataattatgaatgaagctattgtgaacatttgtttacaagtgtttttatggccatgttttcatttctcttgggtaaatacctataatggaattgctgaattatatagcaattagtgtatgattaactttataggaaatatatatggttagtgtatgattaactttataagaaaccgccagacaaatttgccagagtggttgttaagtgtctcatcccactaacaatggagaagagttcccattgctctacatcctcatcaacacttaaaatggtgaaaacgctttaaattgttaatattttggtcattttaataggtatgtaatggcatttcattgtgattgtaacttgtacttctctaatgagtaatgttgttgagtatactttttcatgtgtttcttggccatttgaatattatcttttgtgacaaatattgcaaacatggtagctgaagacaaattatttactttgctcacaaaatggcaatttgatcagagctcgttgaagacaactaaatgtctgctctgcatggcatcagccagggcaacttgaaggctgagggtaattcaacagccgggaactgaaatcatctgaagactcactcattcctgtgtctgaagttgatgctggccctcagctggatctcgagggaggccattggccagaacacctcctcatggcctctccatgtagcagtttggcctgctgggttccaaaagcatcccaagagaacgaagtggaagttcatggcgtcttatgacctagcttcagtcacagtgttattttcacaatacgctaatggttgaggcagtcactcaggtgcaaggggaggggtcatagccaccacctctcaatggaagaagtgtcagcatcatgtcagggaaaaaaacttgtggaatggaatatactgtggggatatctttggaaaatacaatctgtcacatgtctgtccaaatcttttactcattgctttgtgttgttttcctattatccagttaaaatctttacgttttctggaaatgagtcctttttctgtctgaagcttgacttttcattttcttcatggtgtctcagaaagagtaaacattttttcatttgaacgaagcccatctatcgattttgtcttttaaggtagtactttttgtttcctgcctaaaacatttgtgcctaccccaggctcttcaatattttcttgtataatttttttagtttcagtgtttatgtctagatttctaattcatttcaagtgaactttttttttattactatactttaagttttacggtacatgtgcacaatgtgcaggttagttacatatgtatacatgtgccatgttagtgtgctgaaccctgtaactcatcatttaacattaggtatatctccaaatgctatccctccctcataacccaccgacaacaggccctggtatgtgatgttccccttcctgtgtccaagtgttctcattgttcaattcccacctatgagtgagaacatgtggtgtttggttttttgtccttgcaatagtttgctgagaatgatggtttccagctccatccatgtccctacaaaggacatgaactcatcattttttatggctgcatagtattccatgctgtatatgtgccccatattcttaatccagtctattgttgttggacatttgggttggttccaagtctttgctattgtgaatagtgccacaataaacatacatgtgcatgtgtctttatagcagcatgatttataatcctttgggtatatacccagtaatgggatggctgggtcaaatggtatttctagttctagatccctgaggaatcaccacactgacttccacaatggttgaactagtttacagtcccaccaacagtgtaaaagtgttcctgtttctccatatcctctccagcacctgttttttcctgactttttaatgattgccattctaactggtgtgagatggtatctcattgtggttttgatttgcatttctctgatgtccagtgatgatgagcattttttcatgtgtcttttggctgtataaatgtcttcttttgagaaatgtctgttcatatccttcgcccacttgttgatgggcttgtttttttcttgtaaatttgtctgagttcattgtagattctggatattagccctttgtcagatgagtagattgcaaaaattttctcccattctgtaggttgcctgttcactctgatgatagtttcttttgctgtgcagaagctctttagtttcattagatcccatttgtcaattttggcttttgttgccattgcttttggtgttttagacatgaagtccttgcccatgcctatgtcctgaatggtattgcctaggttttcttctagggtttttatggttttaggtctaagatttaagtctttagtccatcttgaattaatttttgtataaggtgtaaggaagggatccagtttcagctttctccatatggctagccagttttcccagcactaattattaaatagggaatcgtttccccatttcttgtttttgtcaggtttgtcaaagatcagatggttgtagatatgcggcattatttctgagggctctgttcggttccattgctctatatctctgttttggtaccagtaccatgctgtcttggttactgtagccttgtagtatagtttgaagtcaggtagcgtgatgcctccagctttgtccttttggcttaggattgacttggcgatgcgggctcttttttggttccatatgaactttaaagtagttttttccaattctgtgaagaaagtcattggtagcttgatggggatggcattgaatctataaattaccttgggcagtatggctgttttcacgatattgattcttcctacccgtgagcatggaatgttcttccatttgtttgtatcctcttttatttcgttgagcagtggtttgtagttctccttgaagaggtccttcacatctcttgtaagttggattcctaggcattttattctctttgaagcaattgtgaatgggagttcactcacgatttggctctctgtttgtctgttattggtgtataagaatgcttgtgatttttgcacattgattttgtatcctgagactttgctgaagttgcctatcagcttaaggagattttgggctgagacaatggggttttctaaatatacaataatgtcatctgcaaacagggacaattggatttcctcttttgctaattgaataccctttatttccttctcctgcctgattgccctggccagaacttccaacactatgttgaataggagtggtgagagagggcatccctgtcttgtaccagttttccaagggaatgcttccagtttttgcccattcagtatgatattggctgtgggtttgtcatagatagctcttattattttgagatacatcccatcaataccgaatttattgagagtttttagcatgaagggctgttgaattttgtcaaaggccttttctgcatctgttgagataatcatatggtttttgtctttggttctgtttgtatgctggattacatttattgatttgtgtctgttgaaccagccttgcatcccagggatgaagccctcttgatcatggtggataagctttttgatgtgctgctggattcggattgccagtattttagtgaggatttttgcatcaatgttcatcagggatattggtctaaaattctctttttttgttgtgtctctgctaggctttggtatcaggatgatgctggcctcataaaatgagttagggaggattccctctttttctattgattggaatagtttcagaaggaatggtaccagctcctccttgtacctctggtagaattcggctgggaatccatctggtcctggactttttttggttggtaagctattaattattgcttcaatttcagagcctgttattggtctattcagagattcaacttcttcctggtttagtcttcggagggtgtatgtgtcgaggaatttatccatttattctagattttctagcttatttgcatagagatgtttatagtattctctgatggtagtttgtatttctgtgggatcggtggtgatatcccagttatcattttttattgcgtctatttgattcttctctcttttcttctttattagccttgctagcaatctatcgattttgttgatcttttcaaaaaaccagctcctggattcattgatttttttgaaggtttttttgagtctctatttccttcagttctgctctgatcttagttatttctcaccttctgctagcttttgaatgtgtttgctcttgcttctctagttcttttaattgtgatgttagggtgtcaattttagatctttcctgctttctcttgtgggcatttagtgctataattttccctctacatactgctttgaatgtgtcccagagattctggtatgtcgtgtctttgttctcattggtttcaaagaacatctttatttctgccttcatttcgttatgtacccagtagtcattcaggagcaggttgttcagtttccaagtagttgagcgattttgagtgagtttcttaatcctgagttctagtttgattgcactgtgttctgagagacagtttgttataatttctgttcttttacatttgctgaggagtgctttagttccaactatgtggtcaattttggaataagtgcggtgtggtgctgagaagaatgtatattctgttgatttggcgtggagaattctgtagatgtctgttaggtctgcttggtgcagagctgagttcaattcctggatattcttgctaactttctgtctcattgatctgtctaatgttgacagtggggtgttaaagtatcccattattattgtgtgggagtctaagtctctttccaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatgagagactaggattgcaacccctgcctttttttgttttccatttgtttggtagatcttcctccatccctttattttgagcctatatgtgtctctgcatgtgagatgggtctcctgaatacagcacactgatgggtcttaactctttatccaatttgccagtctgtgtcttttaattggagcatttagcccatttacatttaaggctaatattgttatgtgtgaatttgatcctgccattatgatgttagctggttattttgcttgttagtggatgcagtttcttcctagcctcaatggtctttacaatttggcatgctttttcagtggctggtaccagttgttcctttccatgtttagtgcttccttcaggagctcttgtagggcaggcctggtggtgacaaaatctctcatcatttgcttgtctataaaggattttatttctccttcatttatgaagcttagtttggctggatattaaattctgggttgaaaattcttttctttaagaatgttgaatattggcccccactctcttctggcttgtagtgtttctgctgagaggtcagctgttagtctgctgggcttccctttgtgggtaacccgacctttctctctggctgcccttaacattttttccttcatttcaactttggtgaatctgacaattatgtgtcttggagttgctcttctggaggagtatctttgtggcattctctgtatttcctgaatttgaatgttggcctgccttgctagattggggaagttctcctgtatgatatcctgcagagtgttttccaacttggttccattctccctgtcactttcaggtacaccaatcagacgtagatttggtcttttcacatactcccatatttcttggaggctttgttcatttctttttattcttttttctctaaacttctcttctcgcttcatttcattcatttgatcttccatcactgatagcctttcttccagttgatctaatcggctactgaggcttatgcatttgtcatgtagttctcgtgccttgtttttcagctccatcaggtcctttaaggacttctccgcattggttattctagttagccattcgtctaattttttttcaaggtttttaacttctttgacatgggtttgaacttccacctttagctctgagtagtttgatcgtctgaagccttcttctctcaactcatcaaagtcattctctgtccaactttgttccattgctggtgaggagctgcgttcctttggaggaagagaggcactctgatttttagaatttccagtttttctgctctgttttttccccatctttgtggttttatctacctttggtctttgatgatggtgacgtacagatggggttttggtgtggatgtcctttctgttttttagttttccttctaacagtcaggaccttcagctgcaggtctgttggagtttgctggaggtccactccagaccccgtttgcctgggtatcagcagcggaggctgcagaacagcggatattggtgaacatcaaatgttgctgcctgatcatgcctctggaagttttgtctcagaggagtacccggccatgtgaggtgtcagtctgcccctactaggaggtgcctcccagttacgctactcgggggtcaaggacgtgcttgaggaggcagtctgtccattctcagatctccagctgcgtgctaggagaacctctactctcttcaaagctgtcagacagggacatttaaatctgcagaggattctgctgccttttgtttggcaatgccctgcccccagaggtggagtctacagaggcaggcaggcctccttgagctgcggtgggctctacccagtttgagcttccaggctgctttgtttacctagtcaagcctcagcaatggcaggcacccctcccccagcctcgctgctgccttgcagtttgatctcagactgctgtgctagcaatgagtgaggctccgtgggcataggaccctccaagccaggcacgggatataatctcttgctgtgccgtttgctaagacagttggaaaagcaccatattggggtgggagtgacttgattttccaggtgccatccatcacccctttctttgactaggaaaggg

SEQ ID NO: 12456 - DNA, 6067 bp, Homo sapiens
ttttcttcttgttttctttaatacatttttttaattaattaatttattattattatactttaagttttagggtatatgtgcacaatgtgcaggttagttacatatgtatacatgtgccatgctgctgcgctgcacccactaactcgtcatctagcattaggtatatctcccaatgctatccctcccccctccccctaccccacaacagtccccagagtgtgatgttccccttcctgtgtccatgtgttctcattgttcaattcccacctatgagtgagaatatgcagtgtctggttttttgttcttgtgatagtttactgagaatgatgatttccaatttcatccatgtccctacaaaggacatgaactcatcattttttatggctgcatagtattccatggtgtatatgtgccacgctttcttaatccagtctatcattgttggacatttgggttggttccaagtctttgctattgtgaataatgccacaataaacatacgtgtgcatgtgtctttatagcagcatgatttatagtcccttgggtatatacccagtaattggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgagttgcatttctctgatggccagtgatggtgagcattttttcatgtgtttttggctgcataaatgtcttcttttgagaagtgtctgttcatgtccttcgcccactttttgatggggttgtttgtttttttcttgtaaattgtttgagttcattgtagattctggatattagccctttgtcagacgagtaggttgcgaaaattttctcccattttttaggttgcctgttcactctgatggtagtttcttttgctgtgcagaagctctttagtttaattagatcccatttgtcaattttggcttttgttgccattgctttaagtgttttagacatgaagtccttgcccatgcctatgtcctgaatggtaatgcctaggttttcttctagggtttttatggttttaggtcttacatttaagtctttaatccatcttgaattgatttttgtataaggtgtaaggaaggcatccagtttcagctttctatatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagccttgttcttttggctcaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccgtgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttcggctgagacaatggggttttctagatatacaatcatgtcgtctgcaaacagggacaatttgacttcctcttttcctaattgaataccctttatttccttctcctgcctaattgccctgaccagaacttccaacactatgttaaatagaagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggctgttgaattttgtcaaaggcctcttctgcatctattgagataatcatgtggtttttgtctttggttctgtttatatgctggattacatttattgatttgcatatattgaaccagccttgcatcccagggatgaagcccacttgatcatggtggataagctttttgatgtgttgctggattcggtttgccagtattttattgaggatttttgcatcaatgttcatcaaggatattggtctaaaattctcttttttggttgtgtctctgcccggctttggtatcaggatgatgctggcctcataaaatcagttagggaggattccctctttttctattgattggaatagtttcagaaggaatggtaccagttcctccttgtacctctggtagaattcggctgtgaatccatttagtcctggactctttttggttggtaagctattgattactgccacaatttcagaccctgttattggtctattcagagattcagcttcttcctggtttagtcttgggagagtgtatgtgtccagaagtttatccatttcttctagattttctagtttatttgcatagaggtgtttgtagtattctctgatggtagtttgtatttctgtgggatcggtgatgatatcccctttatcattttttattgcatctatttgattcttctctctttttttctttattagtcttgctagcggtctatcaattttgctgatcctttcaaaaaaccagctcctggattcatcaattttttgaagggttttttgtgtctctatttccttcagttctgctctgattttagttatttcctgccttctgctagcttttgaatgtgtttgctcttgcttttctagttcctttaattgtgatgttaggctgtcaattttggatctttcctgctttctcttgtgggcatttagtgctataaatttccctctacacactgctttaaatgcgtcccagagattctggtatgttgtgtctttgttctcgttggtttcaaagaacatctttatttctgccttcatttcgttatgtacccagtagtcactcaggagcaggttgttcagtttccatgtagttgagcggttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgcattatgaatctgggtgctcctgtattgggtgcatatatatttaggatagttagctcttcttgttgaattgatccctttaccattatgtaacggccttctttgtctcttttgatctttgttggtttaaagtctgttttatcagagattcggattgcaacccctgcctttttttgttttccatttgcttggtagatcttcctccaaccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattagttgatgcagtttcttcctagtctcgatggtctttacattttggcatgattttgcagcggctggtaccggttgttcctttccatgtttagcgcttccttcaggagctcttttagggcagacctggtggtgacaaaatctctcagcatttgcttgtctgtaaagtattttatttctccttcacttatgaagcttgtttggctggatatgaaattctgggttgaaaattcttttctttaagaatgttgaatgttggcccccactctcttctggcttgtagagtttctgccaagagatctgctgttagtctgatgggcttccctttgagggtaacccgacctttctctctggctgcgcttaacattttttccttcatttcaactttggtgaatctgacaattatgtgtcttggagttgctcttcttgaggagtatctttgtggcgttctctgtatttcctgaatctgaatgttggcttgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttcttgcttcatttcattcctttcatcttccatcgctgataccctttcttccagttgattgcatcggctcctgaggcttctgcattcttcacatagttctcgagccttggttttcagctccatcagctcctttaagcacttccctgtcttggttattctagttatacattcttctaaatttttttcaaagttttcaacttctttgcctttggtttgaatgtcctcccgtagctcggagtaatttgatcatctgaagccttcttctctcagctcgtcaaagtcattctccatccagctttgttccgttgctggtgaggaactgcgttcctttggaggaggaaagtcgctctgcttttcagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgctggagtacccggccgtgtgaggtgtcagtctgcccctgctgagggatgcctcccagttaggctgctcgggggtcaggggtcagggacccacttgaggaggcagtctgcccgttctcagatctccagctgcgtgctgggagaaccactgctctcttcaaagctgtcagacagggacatttatgtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggtgcccctccctgagcctcgctgccgccttgcagtttgatctcagactgctgtgctagcaatcagtgagactccatgggcgtaggaccctctgagccaggtgcgggatataatctcctgatgctctgttttttaagcccgtcggaaaagcacagtattcgggtgggagtgacccgattttccaggtgccgtctgtcacccctttctttgactcggaaagggaactccctgaccccttgcgcttcccgagtgaggcaatgcctcgccctgcttcggcttgcatgtggtgcgggcacccactgacctgcgcccactgtttggcactccctagtgagatgaacccggtacctcagatggaaatgcagaaatcacccatcttctgcgtcgctcatgctgggagctgtagaccagagctgttcctattcggccatcttggctcctccct

SEQ ID NO: 12457 - DNA, 5402 bp, Homo sapiens
catgcgcagctaacttttttttttttttatatactttaagttttagggtacacgtgcacattgtgcagattagttacatatgtatacatgtgccatgctggtgcgctgcacccactaactcgtcatctagcattaggtatatctcccgatgctatccctcccccctcccccgaccccacaacaatccccagagtgtgatattcccctccctgtgtccatgtgatctcattgttcaattcccacctatgagtgagaatatgcggagtttggctttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctgtcgtgaataatgccgcaataaacatacgtgtgcctgtgtctttatagcagcatgatttatagtcctttgggtatatacccagtaatgggatggctgggtcaaatggtatttctagttctagatccctgaggaattgccacactgacttccacaatggttgaactagtttactgtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgttttttggctgcaaaaaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctaggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctcttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctctttttcagttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaaggtggattcctaggtattttattctctttgaagcaattgtgaatgggagttcactcatgatttggctgtctgtctgttgttggtgtataagaatgcttgtgatttttgtacattaattttttttatcctgagactttgctgaagttccttatcagcttaaggagatttggggctgagacaatggggttttctagatatacaatcatgtcatctgcaaacagggacaatttgacttcctcttttcctaatggaatacccctttatttccttctcctgcctaattgccctggccagaaattccaacactatgttgaatacgagtggtgatagagggcatccctgtcttgtgccagttttcaaaaggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcatctattgagataatcatatggtttttgtctttggctctgtttatatgctggattacatttattgatttgcgtatattgaaccagccttgcattccagggatgaagcccacttgatcatggtggataagctttttgatgtgttgctggattcgttttgccagttttttattgaggatttttgcatcaatgttcatcaaggatattggtctaaaattctctttttttgttgtgtctcttcctggctttggtatcagaatgatgctggcctcataaaatgagttagggaggattccctctttttctattgattggaatagtttcagaaggaatggtaccagttcctccttgtacctctggtagaatttggctgtgaatccatctggtcctggactctttttggttggtaagctattgattattgccacaatttcagctcctgttattggtctattcagagattcaacttcttcctggtttagtcttgggagagtgtatgtgtccaggaatttatccatttcttctagattttctagtttatttgcatagaggtgtttgcagtattctctgatggtagtttgtatttctgtgggatcggtggtgatatctcctttatcattttttattgcatctatttgattcttctctctttttttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtggtataaatttccctctacacactgctttgaatgtgtcccagagattatggtatgttgtgtctttgttctcattggtttcaaagaacatctttatttctgccttcatttcgttatgtacccagtagtcattcaggagcaggttgttcagttcccatgtagttgagtggttttgagtgagattcttaatccagagttctagtttgattgcactgtggtctgagagatagtttgttataatttctgttcttttacatttgctgaggagagctttacttcccagtatgtggtcaattttggaatagatgtggtgtggtgctgaaaaaaatgtatattctgttgatttgtggtggagagttctgtagatgtctgttaggtccgcttggtgcagagctgacttcaattcctgggtatccttgttaactttctgtctcgttgatctgtctaatgttgacagtggggtgttaaagtctcccattattattgtgtgggagtctaagtctctttgtaggtcactcaggacttgctttatgagtcttggtgctcctgtatgggctgcatatgtatttaggatagttagctcttcttgttgaattgatccctttaccattatgtaatggccttctttgtctcttttgatctttgttggtttaaggtctgttttatcagagactagaattgcaacccctgccttttttttgttttccattggcttggtagatcttcctccatccttttattttgagcctatgtgtgtctctgcacgtgagatgggtttcctgaatacagcacactgatggttcttgactttttatccaatttgccagtctgtgtcttttaattggagcatttagtccatttacatttaaagttaatattgttatgtgtgaatttgatcctgtcattatgatgttagctggtgattttgctcgttagttgatgcagtttcttcctcgtctcaatggtctttacattttggcatgattttgcagtggctggtaccggttgttcctttccatgtttagtgcttccttcaggagctcttgtaaggcaggcctggtagtgacaaaatctctcagcatttgcttgtctgtaaaggattttatttctccttcacttatgaagcttagtttggctggatatgaaattctgggttgaaaattcttttctttaagaatgttgaatatcggcccccactctcttctggcttgtagggtttctgccaagagatctgctgttagtctgatgggcttccctttgagggtaacctgacctttctctctggctgcccttaacattttttccttcatttcaactttggtgaatctgacaattatgtgtcttggagttgctcttctcgagtagtatctttgtggagttctctgtatttcctgaatctgaatgttggcctgccttgctagattggggaagttctcctggataatatcctgcagcgtgttttccaacttggctcccttctccccgtcactttcaggtacaccagtcagacgtagatttggtcttttcacatagtcccatatttcttggaggctttgctcatttctttttattcttttttctctaaacttcccttctcgcttcatttcattcatttcatcttccattgctgataccttttcttccagctgatcgcatcggctcctgaggcttctgcattcttcccatagttctcgagccttggttttcagctccattagctcctttaagcacttctctgtattggttattctagttatacattcttctaaatttttttcaaagttttcaacttctttgcctttggtttgaatgtcctgccatagctcagagtaatttgatcgtctgaagccttcttctctcagctcgtcaaagtcattctccatccagctttgttccgttgctggtgaggaactgcattcctttggaggaggagaggcgctctgctttgtagagtttccagtttttctgttctgttttttccccatctttgtggttttatctacttttggtctttgatgatggtgatgtacagatgggtttttggtgtggatgtcctttgtgtttgttagttttccttctaacagacaggaccctcagctgcagttctgttggaataccctgccgtgtgaggtgtcagtgtgcccctggttgggggtgcctcccagttaggctgcctgggggtcaggggtcagggacccacttgaggaggcagtctgcccgttctcagatctccagttgcgtgctggg

SEQ ID NO: 12458 - DNA, 9109 bp, Homo sapiens
tttcccaattctttttttttttttaatttttttttaattatactttaagttttagggtacatgtgcacattgtgcaggttagttacatatgtatacatgtgccatgctgtgcgctgcacccactaactcgtcatctagcattaggtatatctcctaatgctatccctcccccctccccccaccacacaacagtccccagagtgtgatattccccttcctgtgtccatgtgatctcattgttcaattcccacctatgagtgagaatatgcggtgtttggttttttgtccttgcgacagtttactgagaatgatgatttccaatttcatccatgtccctacaaaggacatgaactcatcattttttatggctgcatagtattccatggtgtatatgtgccacattttcttaatccagtctatcattgttggacatttgggttgcttccaagtctttgctattgtgaataatgccgcaataaacatacgtgtgcatgtgtctttatagcagcaagatttatagtcctttgggtatatacccagtaatgggatggctgggtcaaatggtatttctagttctggatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgctgttgatgttttggacatgaagtccttgcccatgcctatgtcccgaatggtgatgcctaggttttcttctagggtttttatggttttaggtctaacgtttaagtctttaatccatcttgaattgatttttgtataaggtgtaaggaagggatccagtttcagctttctacatagggctagccagttttcccagcaccatttattaaatagggaatcctttccccattgcttgtttttctcaggtttgtcaaagattggatagttgtagatatgcggcgttatttctgaggtctctgttctgttccattgatctatatctctgttttggtaccagtaccatgctgttttggttactgtagccttgtagtatagtttgaagtcaggtagtgtgatgcctccagctttgttcttttggcttaggattgccttggcgatgcaggctcttttttggttccatatgaactttaaagtagttttttccaattctgtgaagaaagtcattggtagcttgatggggatggcactgaatctgtaaattaccttgggcagtatggccattttcacgatattgattcttcctacccatgagcatggaatgttcttccatttgtttgtatcctcttttatttccttgagcagtggtttgtagttctccttgaagaagtccttcacatcctttgtaagttggattcctaggtattttattctctttgaagcaattgtgaatgggagttcactcatgatttggctctctgtttatctgttattggtgtgtaagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgacattggctgtggctttgtcatagatagctcttattattttgaaatacatcccatcaatacctaatttcttgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacctgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctgatagaattcggctgtgaatccatctggtcctggactctttttggttggtaaactattgattattgccacaatttcagctcctgttattggtctattcagagattcaacttcttcctggtttagtcttggaagagtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctctctttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaaagtgtttgctcttgcttctctagttcttttaattgtgatgttagggtgtcaattttggatctttcctgctttctcttgtgggcatttagtgctataaatttccctctacacactgcttttaatgcgtcccagagattctggtatgtggtgtctttgttctccttggtttcaaagagcatctttatttctgccttcatttcgttatgtatccagtagtcattcaggagcaggttgttcagtttccatgtagttgagtggttttaagtgagattcttaatcctgagttctagtttgattgcactgtggtctgagagatagttcattataatttctgttcttttacatttgctgaggagagctttacttccaagtatgtggtcaattttggaataggtgtggtgtggtgctgaaaaaaatgtatattctgttgatttggggtggagagttctgaagatgtctattaggtccgcttggtgcagagctgagttcaattcctgggtatccttgttgactttctgtcttgttgatctgtctaatgttaacagtggggtgttaaagtctcccattattaatgtgtgggagtctaagtctctttgtaggtcactcaggacttgctttatgaatctgggtgctcctgtattgggtgcataaatatttaggatagttagctcttctcgttgaattgatccctttaccattatgtaatggccttctttgtctcttttgatctttgttggtttaaagtctgttttatcagagactaggattgcaacccctgcctttttttgttttccattcgcttggtagatcttcctccatccttttattttgagcctatgtgtgtctctgcatgtgagatgggtttcctgaatacagcacactgatgggtcttgactctttatccaatttgccagtctgtgtcttttaatgggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcagctggtaccggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttgtctttaagaatgttgaatattggcccccactctcttctggcttgtagggtttctgccgagagatccgctgttagtccgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccatcactttcaggtacaccagtcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtagtttgatcttctgaagcctccttctctcagctcgtcaaagtcattctccatccagctttgttccgttgctggtgaggaactgcgttcctttggaggaggagaggcgctttgcgttttagagtttccagtttttctgttctgttttttccccatctttgtggttttatgtacttttggtctttgatgatggtgatgtacagatgggtttttggtgtggatgtcccttctgtttgttagttttccttctaacatacaggaccctcagctgcaggtctgttggaataccctgccatgtgaggtgtcagtgtgccgctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtgtgcagaggttgctgctgtctttttgtttgtctgtgccctgcccccagaggtggagcctacagaggcagggaggcctccttgagctgtggtgggctccacccagttcgagcttcccggctgctttgtttacctaagcaagcctgggcaatggcgggcgcccctcccccagcctcactgccaccttgcagtttgatctcagactgctgtgctagcaatcagcgagactccgtgggcataggaccctccgagccaggtgcgggatataatctcatggtgcgccgttttttaagccggttggaaaagcgcaatattcgggtgggagtgacccaattttccaggtgcgtccatcacccctttctttgactcggaaagggaactccctgaccccttgcgcttcccaagtgaggcaatgcctcgccctgctttggctcacgcatggtgcgcgcacccactgacctgcgcccactgtctggcactccctagtgagatgaacccagtacctcagatggaaatgcagaaatcaccggtcttctgcgtcgctcacgctgggagctgtagaccggagctgttcctatttggccatcttgatcaagaagcttactttcccaattctttaaccagtctgatcctaagtacctgctgtgacctcagatttaatttcttctgatgttcagtggcattttttgggagatatatttttgatttcactcaaagatacctccttcagctcatatttttgagacgtttggatgacttgagaaaagtattcaagttgggcaccctggatttccctggagaaagcctactttctctgttccttagggtcaatcagggatccaagtcaacggaggctgtgtcattttcaacttgtagcttccaaggtcactctagtcatgcccattccagctagcaggaaggggaaagactggaagtcatgtctataaaattcatcttaagcatgagatgcggaaattgcacacatcagttctgctcgcatcgcatttgtgagggcttagttacatatgacctctactcattgcaggagaggctgcaaaatatagtccctaactggcccagacaccactttgtcactatggaagaagaggagaacagattttgttggatacccagcagtctctgccatagataagttgacacaattccttgaatctgccatattccataatatatgctatattatatattatggaactatgtattagaccataagctccctattccccttgactttgagaaagcttaaagctaaatttagtgctctcttatagtacatcattttcattttttgatgtttattcattattctgatctggtttttgatctccctttttacttacaatggtcttgtctatcacacattttagtatcttacgccattccaaattctttcaaaaagtgggtgggatataaataataatagaattacacaatgcagtaaggtacctgcacaaacagcagctaatgtaaggagactgaaaaaggaactatatttgttaaaatcaaattggctggcctgcaagaagtgtgggtagtagaatctctttggaggacatcgcaacacttcttatatccatgaggtgggcatgcagtggtggcatacagttcaagtagtataatgataaagaatggggtgaccctgtgtctgacaggcaaagttgcctatcaatatattggcatcttatcccataatctgtaagaattagtattttggtgctacataataaagtattttagagtataaaaattagttgttcatatgccagcaaccaccattagtattttcaaaaaagtgcagtgaattctgagcatctaatatgtgcttagcactctgctaatctccatgagagatggacaacatggtctcttccttaaggatcttacacatttataatcctgagagccataatatactaaacagcaaagtgtttttcattcacccttctaaaccctagcccctacatcagtgctaggcacagagtggactctcaacaactaatgccaattgaatgaaaaatattaaaatgtcacttaatgctgaactgaaatttgaaatagatatgggaaggctcagaaatacgcaggatttccgctgatgtttctaaagaataccaaggttttgcttgtgttgactcagaaagactaaaacttggtcactcatttgacagggaaattcatagtaaaactgtttaatagctccttctagatttatttgtcagtgagcctggatatttactctgcttcttataactgtgagaaaaaatgtatgtcttttctctaggcattttatgacaatgtgtagctacctaagatgtgtgggtaccctgggggctggatagtaaaggattaagcttttaaaatatctacccacaggcatttattagaaggtatgcttcacattttattaagttataagctctccaaaaatgctcatgttttaaatgtttttcatctttgttggtgtttatctttgttttttatgcctagcttctgccaaaaaactcccacaaacttttaaattctttaaaaaggcacttcagtagtatgtaagatctgatgtctgtttatatagttctgtgcttctaactaatgtgtttaaaaatgtgtccatgtattttttatatgtatacacacagattataatgctacctggacaatgatagagcatttcaactttaaatctctgtcatctttactgaatggctttcagctggtaattctttaccttttggtgacatcagagatatttttcattccagtgaactctatatggcattgttgcatttgatgatctttttttttttcttttttttactttattattattatactttaagttttagggtacatgtgcacaatgtgcgggttagttacgtatgtatacatgtgccatgctggtgtgctgcacccattaactcatcatttagcattaggtatatctcctaatgctatccctcccccctccccccaccacacaacagtccccagagtgtgatgttccccttcctgtgtccatgtgttctcattgttcaattcccacctatgagtgagaatatgcagtgtttgtttttttgttcttgcgatagtttactgagaatgatgatttccaatttcatccatgtccctacaaaggacatgaactcatgattttttatggctgcatagtattccatggtgtatatgtgccacattttcttaatccaatctatcattgttggacatttgggttgcttccaagtctttgctattgtgaatagtgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttgctatttctccacatcctctcccgcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgtttatgtc

SEQ ID NO: 12459 - DNA, 5958 bp, Homo sapiens
ttaaattttattattattatactttgagatttagggtacatgtgcacaatgtgcaggtttgttacatatgtatacatgtgccatgttgatgtgctgcacccacaacctcgtcatttagcattaggtatatctcctaatgctatccctcccccctccccccaccccacaacaggccccggtgtgtgatgttccccttcctgtgtccatgcgttctcattgttcaattcccacctatgagtgagaacatgcagtgtttggttttttgtccttgcgatagtttgctgagaatgatggtttccagcttcatccatgttcctagaaaggaaatgaactcatcattttttatggctgcatagtattccatggtgtatatgtgccacattttctttttttttttcctttttttttacttcaagaaatattttatttatgaacttttttttcttttttttaattatactttaagttttagggtacatgtgcacattgtgcaggttagttacatatgtatacatgtgccatgctggtgcactgcacccactaactcgtcatctagcattaggtatatctcccaatgctatcccttccccctccccccaccccaccacagtccccagagtgtgatattccccttcctgtgtccatgtgatctcattgttcaattcccacctatgagtgagaatatgcggtgtttggttttttgttcttgtgatagtttactgaaaatgatgatttccaatttcatccatgtccctacaaaggacatgaattcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctaggtctagatccctgaggaatctccacactgaattccacaacggttgaactagtttacagtcccaccaacagtgtaaaagtgttcctatttctccacatcccctccagcacctgttgtttcctgactttttaatgattgccattctaactggtgtgaaatggtatgtcattgtggttttgatttgcatttctctgatggccagtgatgatgagcattttttcatgtgttttttggctgcataaatgtcttcttttgagaagtgtctgttcatatccttcacccactttttgatgcaattgtttgtttttttcttgtaaatttgtttgagttcattgtagattctggatattagccctttgtcagatgagtaggttgcaaaaattttctcccattctgtaggttgcttgttcactctgatggcagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttgtggttttaggtctaacatgtaagtctttaatccatcttgaattaatttttgtataaggtgtaaggaagggatccagtttcagctttctacatatggctagtcagttttcccagcaccatttattaaatagggaatcctttccccatttcttgtttttgtcaggtttgtcaaagatcagatagttgtagatatgcagcattatttctgacggctctgttctattccattggtctatatctctgttttggtaccagtaccatgctgttttggttactgcagccttgtagtatactttgaagtcaggtagcgtgatgccttcagttttgttcttttggtttagatttgacttggcaatgtgggctcttttttggtgccataggaactttaaagtagttttttccaattctgtgaagaaaggcattggtagcttgatggggatggcattgaatctataaattacgttgggcagtatggccattttcacaatattgattcttcctgcccatgagcacggaatgttcttccatttgcttgtatcctcttttatttccttgagcggtggtttgtagttctccttgaagaggtccttcacatcccttgtaagttggattcctaggtattttattctctttgaagtaattgtgaatgggagttcactcatgatttggctctctgtttgtctgttattgatttataagaatgcttgtgatttttgcacattgattttgtatcctgagactgctgaagttgcttatcagcttaaggagattttgggctgagacgacggggttttctaggtatacaatcatgtcatctgcaaacagggacaatttgacttcctcttttcctaattgaatgccctttatttctttctcctgcctgattgccctggccagaacttccaacactatgttgaatagtagtggtaagagagggcatccctgtcttgtgccagttttcaaagggaatgcttccagtttttgtccattcagtatgatattggctgtgggttttgtcatagatagctcttattattttgagatatgcccatcaatacctaatttattgagagtttttagcatgaagcattgttgaattttgtcaaaggccttttctgcatctattgagataatcatgtggtttttgtctttggttctgtttatatgctggattatgtttattgatttgtgtatgttgaaccagccttgcatcccagggatgaagcccacttgttcatggtggataagctttttgatgtgctgctggatttggtttgccagtattttattgaggatttttgcatcaatattcatcaaggatattagtctaaaattctctttttttgttgtgtctctgccaggctttggtatcaggatgatgctggcctcataaaatgagttagggaggattccctctttttctgttgattggaatagtttcagaaggattggtaccagctcctccttgtacctctggtagaattcggctgtgaatccatctggtgctggactttttttggttggtaagctattaattattgcctcaatttcagagcctgttattggtctattcagagattcaacttcttcctggtttagtcttgggagggtgtatgtgccaaggaatttatccatttcttctagattttccagtttatttgtgtagaggtgtttatagtattctttgatggtaggttgtatttctgtgggattggtggtgatatcccctttatcattttttattgcatctttttgattcttctctcttttcttctttattagtcttgctagcagtctatcaattttgttgatcttttcaaaaaaccagctcctggattcactgattttttgaagggatttttgtgtctctatttccttcagttctgctctgatcttagttatttcttgccttctgctagcttttgaatgtgtttgctcttgcttctctagttcttttaattgtgatgttagggtgtcaattttagatcattcctgctttctcttgtgggcatttagtgctataaatttccctctgcacactgctttgaatgtgtcccagagattctggtatgttgtgtctttgttctcgttggtttcaaagaacatctttatttctgccttctttttgttatgtacccagtagtcactcaggagcaggttgttcagtttccatgtagttgagtggttttgagtgagtttcttaatcctgagttctagtttgattgcactgtcgtctgagagacagtttgttataatttttattcttttacatttgctgaggagagctttacttccaactatgtggtcaattttggaataggtgtagtgtggtgctgaaaagaatttatattctgttgatttggggtggagagttctgtagatgtctattaggtccgcttggtgcagagctgagttcaattcctggatatccttgttaactttctgtctcattgatctgtctaatgttgacagtggggtgttaaagtctcctattattattgtatgggagtctaagtctctttgtaggtcactaaggacttgctttatgaatctgggtgcgcctgtattgggtgcatatatatttaggatagttagttcttcttgttgaattgatccctttaccattatgtaatggccttctttgtctcttttgatcttttttggtttaaagtctgttttatcagagactaggattgcaacccctgcctttttttgtttctcatttgcttggtagatcttcctccatccctttattttgagcttatgtgtgtctctgcacatgagatgggtttcctgaatacagcacactgatgggtcttcagtctttatccaatttgccagtctgtgtcttttaactggagcatttagcccatttacatttaaggttaatatttttatgtgtggatttgatcctgtcattatgatgttagctggttattttgctcgttagttggtgcagtttattcctggccttgatggtcttcacgatttggcatgtttttgcagtggctggtactggttgttcctttccacatttagtgcttccttcaggagctcttgtatggcaggcctggtggtgacaaaatctctcagcacttccttgtctgtgaaggattttatttctccttcacttatgaagcttagtttggctggatatgaaattctgggttgaaaattcttttccttaagaatgttgaatattggcccccactcttttctggcttgtagagtttctgccaaggcatcagcagttagtctgatgggcttccctttgtgggtaacccgacctttctctctggctgcccttaacattttttcctttgtttcaactttggtgaatctgacaattatgcgtcttggagttgctcttctcgaggagtatctttgtggcattctctgtatttcctgaatttgaatgttggcctgccttgctagattggggaagttctcctggataatatcctgcagagtgttttccaacttggttccattctctccgtcactttcaggtacaccaatcagatgtagatttggtcttttcacatagtcccatatttctggaaagctttgttcattactttttattcctttttctctaaacttctcttctcacttcatttcattcatttcatcttccatcgctgatacccttgcttccagttgattacattggctactgaggcttgtgcattcgtcatgtatttctcgtgccacagttttcagctccatcaggtcttttaaggacttctctgcattggttattctagttagccattcgtctaatttttttcaaggtttttaacttctttgccattggttcaaatttcctcctttagctcggagtagtttgatcttctgaagccttcttctctcaactcatcaaagtcattctccatccagctttgttctgttgcgggtgaggaggtgcattcctttggaggagtagaggcactctgatttttagagtttctggtttttcggcactgtttattccccatctttgtggttttatctacctttggtctttgatgatggtgacatacagatgggtttttggtgtggatgtcctgtttgttagttttccttctaacagtcaggaccctcagctgcgggctgttggagtttgctggaggtccactccagaccctgtttgcctgggtatcagcagcggtggctgcagaacagtggatgttggtgaactgcaaattctgctgcctgattgttcctctggaagttttgtctcagaggagtacccggctgtgtgaggtgtcagaccgcccctactagggggtgcctcccagttaggctcctcgggggtcagggacccacttgaggaggcagtctgcctgttctcagatctcaagctgcatgctgggagaaccactactctctt

SEQ ID NO: 12460 - DNA, 6050 bp, Homo sapiens
tgtattattattattattatactttaagttttagggtacatgtgcacaacatgcaggtgtgttacatatatatacatgtgccatgttggtgtgctgcacccattaactcgtcatttaacattaggtatatctcctaatgctatccctccctcctcctcccaccccacaacagacccctgtgtgtgatgttccccttcctgtgtccatgtgttctcattgttctgttcccacctatgagtgagaacctgcagtgtttagttttttgtccttgcaatagtttgctgagaatgatggtttccagctttatccatgtccctacaaaggacatgaactcatccttttttatggctgcatagtattccatgctgtatatgtgccacattttcttaatccagtctatcattgttggacgtttgggttggttccaagtctttgctattgtgaatagtgctgcaataaacatacgtgtgcatgtgtctttatagcagcatgatttataatcctttaggtatatacccagtaatgcgatggctgggtcaaatggtatttctagttctagatccctgaggaatcgccacactgacttccacaatgtttgaactagtttacagtcccaccaacagtgtaaaggtgttcctatttctccacatcctctccagcacctgtagtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccttcacccactttttgatggggttgtttgtttttttcttgtaaatttgtttgagttcattgtagattctggatattagccctttgtcagttgagtagattgcaaaaattttctcccattctgtaggttgcctgttcactctgatggtagtttcttttgctgtgcagaagctctttagtttaattagatcccatttatcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaattttagtataaggtgtaaggaagggatccagtttcagctttctccatatggctagccagttttcccagcaccatttattaaagagggaatcctttccccatttcttatttttgtcaggtttgtcaaagatcagatagttgtagacatgtggcattatttctgagggctctgttctgttccaatggtctatatctctgttttggtaccagtaccatgctgttttggttactgtagccttgtagtatagtttgaagtcaggtagcatgatgcctccagctttgttctttttgcttaggattgacttggcaatgagggctcttttttggtaccatatgaactttaaagtagttttttccaattctgtgaagaaagtcattggtagcttgatggggatggcattgaatctataaattaccttgggcagtatggccattttcaccatattgattcttcctacccatgagcatggaatgttcttccatttgtttgtatcctcttttatttccttgagcagtggtttgtagttctccttgaagaggtccttcacatcccttgtaagttggattcctagctattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttgctcttttcctaattgaataccctttatttctttctcttgcctgattgccctggccagaacttccaacactatgttgaataggagtggtgagagagggcatccctgtcttgtgccagttttcaaagggaatgcttccaatttttgcccattcagtatgatattggctgtgagtttgtcataaatagctcttactattttgagatacgtcccatcaatacctaatttattgagagtttttagcatgaagggctgttgaattttgtcaaaggccttttctgcatctattgagataatcatgtggtttttctcgttggttctgtttatatgctggattacgtttattgatttgcgtatgttgaaccagccttgcatcccagggatgaagcccacttgatcatggtggataagcttttcgatgtgctgctggatttggtttgccagtattttattgaggatttttgcattgatgttcatcagggatattggtctaaaattctctttttttgttgtgtctctgccaggctttggtatcaggatgatgctggcctcataaaatgagttagggaggattctctctttttctgttgattggaatagtttcagaaggaatggtaccagctccttcttgtacctctggtagaattcggctgtgaatccatctggtcctggactttttttggttggtaagctattaattattgccccaatttcagatcctgttattggtctcttcagagattcaacttcttcctggtttagtcttgggagactgtatgtgtccaggaatttatccatttcttccagattttctagtttatttgtgtagaggtgtttatagtattctctgatggtagtttgtatttctgtgggatcggtggtgatatcccctttatcattttttattgtgtctatttgattcttctctcttttcctgtttattagtcttgctagtggtctatcaattttgttgatcttttcaaaaaaccaactcctggattcattgattttttgaagggttttttgtgtctctatttccttcagttctgctctgatcttagttattttcttgccttctgctagcttttgaatgtgtttgctcttgcttctctagttcttttaattgtgatgttagggtgtcaattttagatctttcctgctttcttttgtgagcatttagtgctataaatttccctctacacactgctttgaatgtgtctcagagattctggtatgttgtgtctttgttctcgttggtttcaaagaacatctttatttctgccttcatttcgttatgtacccagtagtcattcaggagcatgttgttcagttgccatgtggttgagtggttttgagtgggtttcttaatcctgagttctagtttgattgcactgtggtctgagagacagtttgttatactttctgttcttttaatttgctgaggagtgctttacttccaactatgtggtcaattttggaataggtgtggtgtggtgctgaaaagaatgtatattctgttgatttggggtggagagttctgtagatgtctattaggtccacttggtgcagagctgagttcaattcctggatatccttgttaactttttgtctcattgatctgtctaatgttaacagtggggtgttaaagtctcccattattattgtgtgggagtctaagtcactttgtaggtctctaaggacttgctttatgaatctgggtgctcctgtattgggtgcatatatatttaggatagttagctcttcttgttgaatggatccctttaccattatgtagtggccttctttgtctcttttgatctttgttggtttaaagtctgttttatcagagactaggattgcaacccctgcctttttttgttttccatttgcttggtagatcttcctccatccttttattttgaacctatgtgtgtctctgcacgtgagatgggtttcctgaatacagcacactgatgggtcttgactctttatccaatttgccagtctgtgtcttttgattggaacatttagcccatttacatttaaggttaatattgttatgtgtgaatttgatcctgtcattatgatgttagctggttattttgctcgtgagttgatgcagtttcttcctagccttgatggtctttacaatttggcatgtttttgctgcggctggtaccggttgttcctttccatgtttagtgcttccttcaggagctcttgtagggcaggcctggtggtgacaaaatctctgagcatttgcttgtctgtaaagtattttatttctccttcacttatgaagcttagtttggctggatatgaaattctgggttgaaaattcttttctttaagtatgttgaagggccgggtgcagtggttcacgcctgtaatctcagcactttgggaggctgtggtgggtggatcacgaggtcaggagattgagaccatcctggctaacatggtgaaaccccgtctctactaaaaatacaaaaaaatttagccgggcttggtagcgggtgcctgtagtcccagctactcggaaggctgaggcaggagaatggtgtgaacccaggaggcagagcttgctgtgagccgagatcgcgccactgcactccagcctgggcgagagcgagagtccgtctcaaaaaaaaaaaaaaaaaaaaaaaaaaaaaagaatgttgactattggcccccactctcttctggcttgtagagtttctgctgagagatccgctgttagtctgatgggcttccctttgtgggtaacccgacctttctctctagctgcccttaacattttttccttcatttcaactttggtgaatctgacaattatgtgtcttggagttgctcttctcgaggagtatctttgtggcattctctgtatttcctgaatttgaatgttggcctgccttgctagattggggaagttctcttggataatatcctgcagagtgttttccaacttggttccattctccctgtcactttcaggtacaccaatcagatgtagatttggtcttttcacatagtcccatatttcttggaggctttgttcatttctttttattcttttttctctaaccttctcttcttgcttcatttcattaatttcatcttccatcactgataccttttcttccagttgatcgaatcggctactgaggcttgtgcattcgtcacgtagttcttgtgccatggttttcagctccatcaggtcctttaaggacttctctgcattggttattctagttagtcattcgtctaatcttttttcaagatttttaacttctttgccatgggttcgaacttcctcctttagctcagagtagtttgatcgtctgaagcattcttctctcaactcgtcaaagtcattctgcgtccagctttgttctgttgctggtgacgagctgtgttcctttggaggaggagaggcactctgatttttagaattttcagtttttctgctctgttttttccccatctttatggttttatctacctttggtctttgatgatggtgacgtacagatggggttttggtgtggatgtcctttctgtttgttagttttccttctaacagtcaggaccctcagctgcaggtctgttggagtttgctggaggaccactccagaccctgtttgcctggatatcagcagcggaggctgcagaacagcggatattggtgaacagccaatgttgctgcctcatcattcctctggaagttttgtctcagaggagtacccggccctgtgaggtgtcagtctgcccctactggggggtgcctcccagttaggctactcaggggtcagggacccacttgaggaggcagtctgtctgttctcagatctcaagctgcatgctgggagaaccactactctcttctaagctgtcagacagggacatttaagtctgcagaggtttctgctgccttttgtttggctatgccctgcccccagaggtggagtctacacaggcaggcaggcctccttgagctgcagtgggctccacccagttcgagcttcccagctgctttgtttacctactcaagcctcggcaatggcaggcacccctcccccagcct

SEQ ID NO: 12461 - DNA, 5661 bp, Homo sapiens
tgtcatttttttaaaattatactttaagttttacggtacatatacacaatgtgcaggtttgttacatatgtatacatatggcatgttggtgtgctgcacccattaacttgtcatttaacattaggcatatctcctaatgttatccctcccctctcccgccaacccacaacaggccccggtgtgtgatgttccccttcctgtgcccatgtgttctcattgttcaattccaatctatgagtgagaacatgcagtgtttggttttttgtccttgcgacagtttgctgaaaatgatggtttccagcttcatccatgtccctacaaaggacatgaactcatcattttttatggctgcatagtattccatagtgtatatgtgccacattttcttaatccagtctatcatttatggacatttgggttggttccaagtctttgctattttgagtagtgccacaataaacttacatgtgcatgtgtctttatagcagcatgttttataatcctttgagtatatatccagtaataggatggctgggtcaaatggtatttctagttctagatccctgaggaatcgccacactgacttccacaatggttgaactagtttacagtcccaccaacagtgtaaaagtgttcctatgtctccacatcctctccagtacctgttgtttcctgactttttaatgattgccattctaactggtgtgagatgatatctcattgtggttttgatttgcatttctctgatggccagtgatgatgagcattttttcatgtgtcttttcgctgctaaatgtcttcttctgagaagtgtctgttcatatcctttgcccacattttgatggggttgtttgtttttttcttgtaaatttgtttcagttcattgtagattctggatattagcccttttctcagatgagtatattgcaaaaattttctgccattctgtaggttgcctgttcactctgatggtagtttcttttgctgtgcagaagctctttagtttaattagatcccatttgtcaatttgggcttttgttgccattgctttttgtgttttagacatgaagtccttgcccatgcctatgtcctgaatggtaatgcctaggttttcttctagggtttttatggttttaggtttaacatttaagtctttaatccatgttgaattaatttttgtataaggtgtaaggaagggatccagtttcagctttctacatatggctagcaagtcttcccagcaccatttattaaatagggaaaccttcccccatttcttgtttttgtcagatttgtcaaagatcagatagttgtagatatgcggcattatttctgagggctctgttctgttccattggtctatatttctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagttgttttctccaattctctgaagaaagtcattggtagcttgatgcggatggcattgaatctataaattaccttgggcagtatggccattttcacaatattgcttattcctacccatgagcatggaatgttcttccatttgtttgtatcctcttttatttcattgagcagtggtttgtagttctccttgaagaggtccttcacatcccctgtaagttggattcctaggtattttattctctttgaagcaattgtgaatgggagttcactcatgatttggctctctgtttgtctgttattggtgtataagaatgcttgtgatttttgcacattgattttgtatcctgagaatttgctgaagttgcctttcaccttatggagattttgggctgagacgatggggttttctagataaacaatcatgtcatctacaaacagggaccatttgactttctcttttcctaattgaataccctttatttccttctcctgcctgattgccctggccaggacttccaacactatgttgaataggagtggtgagagagggcatccctgtcttgtgccagttttcaaagggaatgcttccagtttttgcccattcagtatattggctgtgggtttgtcatagatagctcttattattttgagatacgtcccatcaatacctaatttattgagagtttttagcatgaagggctgttgaatttcgtcaaaggccttttctgcatctattgagataaacatgtggtttctgtctttggttctgtttgtatgctggattatgtttattgatttacgtatattgaaccagcgttgcatcacagggataaaacccacttgatcatggtggataagctttttgatgtgctgctggattcggtttgccagtattttattgaggatttttgcatcgatgttcatcggggatattggtctaaaattctctttttttgttgtgtctctgccaggctttggtatcaggatgatgctgacctcataaaatgagttagggaggatttcctctttttctattgatcagaatagttttagaaggaatggtaccagctcctccttgtacctctggtagaattcggctgtgaatccatctggtcctggacttttttttggttcgtaagctattaattattgcctcaatttcagagcttgttattggtctattcagagattcaacttcttcctggtttagtcttgggagggtttatgcatcgaggaatttatccatttcttctagattttctagtttatttgcgtagaggtgtttatagtattctctgatggtagtttgtatttctgtgagattggtggtgatatcccctttatcattttttattgtgtctatttgattcttctctcttttcttctttatcagtcttgctagtggtctatcaattttgttgatcttttcaaaaaaccggctcctggattcattgatttttgaagcgttttttgtgtctctgtttccttcagttctgctctgatcttagttatttcttgccttctgctagctgttgaatatgtttgcttttgcttctctagttcttttaattgtgatgttagggtgtcgattttagatctttcctgctttctcttgtgggcatttagtgctatacatttccctctacacactgctttgaatgtgtcccagagattcttgtatgttgtgtctttgttctcgttggtttcaaagtacatctttatttctgccttcatttcgttatgtacccggtagtcattcaggagcaggttgttcagtttccatgtagttgagcagttttgagtgagtttcttaatcctgagttctagtttgattgcactgtggtctgcgagacagtttgttataatttctgttcttttacatttgctgaggagagctttacttccaactatgtggtcaattttggaatcagtgcagtgtggtgctgagaagaatgtatattgtgttgatttggggtggagagttctgtagatgtctattaggtccgcttggtgcagagctgagttaagttcctggatatccttgttaactttctgtctcattgatctgtctgatgttgacagtggggtgttaaagtctcccattattattgtgtgggagtctaagtctctttgtaggtctctaaggacttgctttatgaatctgggtcctcctgtattaggtgcctatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacatgagatgtgttttctgaatacagcacactgatgggccttgactctttatccaatttgccagtctgtgtcttttaattggagcatttatcccatttacctttaaggttaatattgttatgtgtgaatttgatcctgtcattatgatgttagctggttattttgctcattagttgatgcagtttcttcttagcctcgatggtctttacaatttggcatgattttgcagtggctggtaccggatgttcctttccacgtctagtgctttcttcaggagcccttttagggcaggcctggcggtgagaaaatctctcagcatttgcttgtctgtaaagtattttatttctccttcacttatgaagcttagtttggctggatatggaattctgggttgaaaattcttttgtttaaaaatgttgaatattggcccccactctcttctggcttgtagagtatctgccgagagatcagctgttagtctgattggcttccctttgtgggtaagccgacctttctctctggctgcccttaacattttttccttcatttcaactttagtgaatctgacaattatgtgtcttggagttgctcttctcgaggagtatctttgtggcattctctgtatttactgaatttgaatgttggtctgcctcgctagattggggaagttctcctggataatatcctgcagaggttttccaacttggttccattctccccgtcatttttaggtacaccattcagacgtagatttgaccttttcacatagtcccatatttcttggaggctttattcgtttcttttttattcttttttctctaaacttgtcttctcgcttcatttcatcttccatcactgataccctttcttccagttgatcgaatcggctactgaggcttgtgcattggtcccgtagttctcgtgccatggttttcatctccatcacgtcctttaaggacttctctgcattggttattctagttagccattcgtctaattttttttcaaggtttttaacttctttgccatgggttcgaacttcctcctttagctcagagtagtttgatcgtctgaagccttcttctttcaactcgtcaaaatcattctccgtccagctttgttccattgctggtgaggagctgcattcccttggaggaggagaggtgctctgatttttagagtttccagtttttctgctctgttttttccgcatctttgtggttttatctacctttggtctttgatgatggtgacgtacagatggggttttggtgtgggtgtcctttctgtttattagctttccttctaactgtcaggacccccagctgcaagtctgttggagtttgctggaggtccactccagatcctgtttgcctgggtatcagcagcagaggctgcagaacagaggatattggtgaacagcaaatgttgctgcctgatcgttcctctggaagttttgtctcagaggagtacccggccgtgtgaggtgtcagtctgcccctactagggggtgcctcccagttaggctactcgggggtcagggacccacttgaggaggcagtctgtttgttctcagatctccagctgcgtgctgggagaaccactactctcttcaaagctgtcagacagggacatttaagtctgcagagatttctgctgccttttgtttggctatgccctgcccccagaggtgaagtctacagaggcaggcaggcctccttgaactgtggtgggcttcacccagttcaatcttcctgg

SEQ ID NO: 12462 - DNA, 6046 bp, Homo sapiens
attttcttttttctttttttttttttattatactttaagttttagggtacatgtgcacattgtgcaggttagttacatatgtatacatgtgccatgctggtgtgctgcacccactaactcgtcatctagcattaggtatatctcccaatgctacacctcccccctccccccaccccaccacagtccccagagtgtgatattccccttcctgtgtccatgtgatctcattgttcaattcccacctatgagtgagaatatgcagtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtattttttggctgcataaacgtcttcttttgagaagtgtctgttcatgtccttcgcccactatttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccattggtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgccgaagttgcttatcagcttaaggagattttgggctgagacgatggggttttctagataaacaatcatgtcgtctgcaaacagggacaatttgacttcctcttttcctaattgaataccctttatttccttctcctgcctgattcccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggctttttctgcatctattgagataatcatgtggcttttgtctttggctctgtttatatgctggattacatttattgatttgcgtatattgaaccagccttgcatcccagggatgaaggccacttgatcatggtggataagctttttgatgtgctgctggattcggtttgccagtattttattgaggatttttgcatcaatgttcatcaaggatattggtctaaaattctcttatttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttcccgctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcagctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggcggagagttctgtagatgtctattaggtccgcttggtgcagagctgagttcaattcctgggtatctttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatgggcttctttgtctcttttgatcgttgttggtttaaagtctgttttatcagagactaggattgcaacccctgcttttttttgttttccatttgcttggtagatcttcctccatccttttattttgagcctatgtgtgtctctgcacgtgagatgagtttcctgaatacagcacactgatgggtcttgactctttatccaacttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcacttccttcaggagctcttttagggcaggcctggtggtgacaaaatctcttagcatttgcttgtctgtaaaggattttatttctccttcacttatgaagcttagtttggctggatatgaaattctgggttgaaaattcttttctttaagaatgttgaatattggcccccactctcttctggcttgtagggtttctgccaagagatccactgttagtctgatgggcttccctttgagggtaacccgacctttctctctggctgcccttaacattttttccttcattgcaactttggtgaacctgaaaattatgtgtcttggagttgctcttctcgaggagtgtctttgtggcattctctgtatttcctgaatttgaacgttggcctgccttgctagattggggaagttctcctggataatatcctgcagagtgttttccaacttggttccattctccgcatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctctattggttattgtagttatacattcttctaaatttttttcaaagttttcaacttctttgcctttggtttgaatgtcctcccatagctcagagtaatttgatcgtctgaaaccttcttctgtcagctcgtcaaagtcattctccatccagctttgttccgttgctggtgaggaactgtgttcctttggaggaggagaggcactctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgtctcccagttaggctgctcgggggtcaggggtcagggacccacttgaggaggtagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagattccgtgggcgtaggaccctctgagccaggtgtgggatatagtctcgtggtgcgccgttttttaagccggtctgaaaagcgcagtattcgggtgggagtgacccgattttccaggtgcgtccctcacccctttctttgactaggaaagggaactccctgaccccttgcacttcccaggtgaggcaatgcctcgccctgcttcccctcgcgcacggtgcgcacacccactggcctgcacccactgtctggcactccctagtgagatgaacccggtacctcagatggaaatgcagaaatcacccgtcttctgcgtcgctcacgctgggagctgtagaccggagctgttcctattcggccatcttggctcctcccccc

SEQ ID NO: 12463 - DNA, 6100 bp, Homo sapiens
tttttttaaatatattttttaaattttattattattatactttaagttttagggtacatgtgcacaacgtgtaggtttgttacatatgtatacatgtgccatgttggtgtgctgcacccattaactcgtcatttagcattaggtatatctcctaatgctattcttcccccctccccccaccccacaacagtccccggagtgtgatgttccccttcctgtgtccatgtgttctcactgttcaattcccacctatgagtgagaacatgcggtatttggttttttgtccttgcaatggtttgctgagaatgatggtttccaatttcatccatgtccctacaaaggacatgaactcttcattttttatggccgcatagtattccatggtgtatatgtgccaaattttcttaatcagtctatcgttgttggacatttgggttggttccaagtctttggtattgtgaatagtgctgcaataaacatacgtgtgcatgtgtctttatagcagcatgatttataatcctttgggtatatacccagtaatgggatggctgggtcaaatggtatttctggttctagatccctgaggaatcgccacactgacttccacaatggttgaactagtttacagtcccaccaacagtgtaaaagtgttgctatttctccacatcctctccagcacctgttgtttcctgactttttaatgattgccattctaactggtgtgagatggtatctcattatggttttgatttgcatttctctgatggccagtgatgatgagcatgttttcatgtgttttttggctgcataaatgtcttcttttgagaagtgtctgttcatatcctttgcccactttttgatggggttgttttttcttgtaaatttgtttgagttcattgtagattctggatattagccctttgtcagatgagtaggttgcgaaaattttctcccattttgtaggttgcctgttcactctgatggtagtttctttttctgtgcagaagctctttagtttaattagatcccatttgtcaattttggcttttgttgccattgcttttggtgttttagacatgaagtccttgcccatgcctatgtactgaatggtaatgcctaggttttcttctagggtttttatggttttaggtctaacatttaagtctttaatccatcttgaattaatttttgtataaggtgtaaggaagggatccagtttcagctttcagctttctacatatggctagccaggtttcccagcaccatttattaaatagggaatcctttccccagttcttgtttttgtcaggtttgtcaaagatcagatggctgtagatatgcggcattatttctgagggctctgttctgttccattgatctatatctctgttttggtaccagtaccatgctgttttggttactgtagccgtgtagtatagtttgaagttaggtagcgtgatgcctctggctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttattacattgagcagtggtttgtagttctccttgaagaggtccttcacatcccttgtaagttggattcctaggtattctattctctttgaagcaaaagtgaatgggagttcactcatgatttggctctctgtttgtctgttattggtgtataagaaagcttgtgatttttgtacattgattttgtatcctgagactttgctgaagctgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtagtgagagagggcatccctgtcttgtgccagttttcaaagggaatgcttccagtttttgcccattcagtatgatattgggtgtgggtttgtcatagatagctcttattattttgagatatgtcccatcaatacctaatttattgagagtttttagcatgaagggctgttgaattttgtcaaaggccttttctgcatgtattgagataatcatgtggtttttgtctttggttctgtttatatgctggattacatttattgatttgcgtatgttgaaccagccttgcatcccagggatgaagcccacttgatcatggtgcataagctttttgatgtgctgctggattcggtttgccagtattttattgaggatttttgcatcaatgttcatcaaggatattggtctaaaattctattttttggttgtgtctctgccaggctttggtatcaggatgatgctggcctcataaaatgagttagggaggattccctctttttctattgattggaatagtttcagaaggaatggtaccacctcctccttgtacctctggtagagttcggctgtgaatccatctggtcctggactttttttggttggtaagctattgattattgccacaatttcagagcttgtcattggtctattcagagattcaacttcttcctggtttagtcttgggagggtgtatgtgtcgaggaatttatccatttcttctagattttctagtttatttgtgtagaggtgtttgtagtattctctgatggtagtttgtatttctgtgggatcggtggtgatatcccctttatcattttttattgcgtctatttgattcttctctcttttcttctttattagtcttggtagtggtctatcgattttgttgatcttttcaaaaaaccagctcctggactcattaattttttgaagggctttttgtgtctctatttccttcagttctgctctgattttagttatttcttgtcttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttttgtctttgttctcattggtttcaaagaacatctttatttctgccttcatttcgttatgtacccagtagtcattcaggagcagatttttcagtttccatgtagttgagcggttttgagtgagtttcttaatcctgagttctagtttgattgcactgtggtctgagagacagtttgttataatttcttttgttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtcttgttgatctgtgtaatgttgacagtggggtgttaaagtctcccattattattgtgtgggagtctaagtctttctgtaggtcactaaggacttgctttatgaatttgggtgctcctgtattgggtgcatatatatttaggatagttagctcttgttgaattgatccctttaccattatgtaatggccgtctttgtctcttttgatctttgttggtttgaagtctgttttatcagagactaggattgcaacccctgcctttttttgttttccatttgcttggtagatcttcctccatccctttattttgagcctatgtatgtctctgcacgtgagatgggttccctgaatacagcacactgatgggtcttgactctttatccaatttgccagtctgtgtcttttaattggagcatttagcccatttacatttaaagttaatatttttatgtgtatttgttcctgtcattatgatattagctggttattttgcttgtcagttgatgcagtttcttcctagccttgacggtctttacattttggcatgtttttgcagcggctggtaccggttgttcctttccatgtttactgcttccttcaggagctcttttagggcaggcctggtggtgacaaaatctctcagcatttgcttgtctttaaaatattttatttctctttcacttatgaagcttagtttggctggatacgaaattctgggtagaaaattcttttctttaagaatgttgaatattggcccccactctcttctggcttgtagagtttctgccgaaagatccgctgttagtctgatgggcttccctttgtgggtaacccgacctttctctctggctgcccttaacattttttccttcatttcaactttggtgaatctgacaattatgtgtcttggagttgctcttctcaaggagtatctttgtggcgttctctgtgtttcctgaatctgaatgttggcctgcctttctagattggggaagttctcctggataatatcctgtagagtgttttccaacttggttccattctccccgtcactttcaggtacaccaatgagacgtagatttggtcttttcacatagtcccatatttcttggaggctttgttcgtttctttttattcttttttctctaaacttctcttctcgcttcttttcattcatttcatcttccgtcactgataccctttcttccagttgatcgcatcggctcctgaggcttcggcattcttcatgtagttctcgacccttggctttcagctccatcagctcctttatggacttctctgcattggttattctagttatccattagtctaattttttttcacagtttttaacttctttgccattggtttgaatttcctcctgtagcttggagtaggttgatcatctgaagccttcttctctcagctcgtcaaagtcattctccatccagctttgttccgttgctggtgaggagctgcgttcctttggaggaggagaggcattctgctttttagagtttccagtttttctgctctgttttttccccatctttgtggttttatctacttttggtctttgatgatggtgacgtacagaagggtttttggtatggatgtcccttctgtttgttagttttccttctaacagacaggaccctcagctgcaggtctgttggagtttgctagaggtccactccagaccctgtttgcctgcgtatcagcagtgatggctgtagaacagtggatcttggtgaaccgcaaatgctgctgcctgatcgttcctctggaagttttgtctcagaggagtaccgggccgtgtgaggtgtcagtctgcccctaccggggggtgcctcccagttaggctgcttgggggtcaaggacccacttgaggaggcagtctgcccgttctcagatctccagccacgtgctgggagaaaaccactactctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttcccggctgctttgtttacctaatcaagcctgggcaatggcaggtgcccctcccccagcctcactgccgccttgcagtttgatctcagactgctgtactagcaatcagcgcgactccgtgggcctaggatcctccgagccaggtgcggggtataatctccttgtgtgtcgttttttaagcccgttggaaaagcgcagtattagcgtgggagtgacccgattttccaggtgcggtctgtcacccctttctttgactaggaaagggaactccctgaccccttgcacttcccgagcgaggcgatgcctcgccttgcttcggctcgcgcaaggtgcgctgcacccactgtcctgcgcccactgtctggcaccccctagtgagatgaacctggtacctcagatggaaatgcagaaatcacc

SEQ ID NO: 12464 - DNA, 5452 bp, Homo sapiens
ttttattttattttattttattttattttattttatttatttatttatttattattattatactttaagttttagggtacatgtgcacaatgtgcaggttagttacatatgtatgcatgtgccatggtggtgcgctgcacccactaactcgtcatctagcattaggtatatctcccaatgctatccctcccccctccccccaccctacaacagtccccagagtgtgatgttccccttcctgtgtccatgtgttctcattgttcaactcccacccatgagtgagaatatgcggtttttggttttttgttcttgcgatagtttactgagaatgatgatttccaatttcatgcatgtccctacaaaggacatgaactcatcattttgtatggctgaatagtattccatggtgtatatgtgccacattttcttaatccagtctatcattgttggacgtgtgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccatatcctctccagcacctgttatttcctgactttttaatgattgccattctaactggtgtgaaatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaacccatcttgaattaatttttgtataaggtgtaaggaaaggatccagtttcagctttctacatatggctagccagttttcccagcaccatttattaaatagggaatcctttccccattgcttgtttttgtcaggtttgtcacagatcagatagttgtagatatgcggcgttatttctgagggctctgttctgttccattgatctatatctctgttttggtaccagtaccatgcttttttggttattgtagccttgtagtatagtttgaagtcaagtagtgtgacgcctccagctttgttcttttggcttaggattgacttggcgatgcgggctcttttttggttccatatgaactttaaagtagttttttccaattctgtgaagaaagtcattggtagcttgatggggatggcactgaatctgtaaattaccttgggcagtatggccattttcacgatattgattcttcctacccatgagcatggaatgttcttccatttgtttgtatcctcttttatttccttgagcagtggtttttagttctccttgaagaggtccttcacatcccttgtaagttggatttctaggtattttattctctttgaagcaattgtgaatgggagttcactcatgatttggctctctgtttgtctgttggtgtataagaatgcttgtgatttttgtacattgattttgtatcctgagactttgctgaagttgcttatcagcttaaggagattttgggctgagacaatggggttttctagatatacaatcatgtcgtctgcaaacaggtacaatttgacttcctcttttcctaattgaatgccctttatttccttctcctgcctcattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttctgcatctgttgagataatcatgtggtttttatctttggttctgtttatatgctggattacatttattgatttgcgtatattgaaccaggcttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgcccggctttggtatcaggatgatgctggcctcataaaatgagttagggaggatttactctttttctattgagtggaatagtttcaaaaggaatggtaccagttcctccttgtacctgtggtagaatttggctgtgaatccatctggtcctggactctttttggttggtaagctattgattattgccacaatttcagctcctattattggtctattcagagattcaacttcttcctggtttagtcctgggagagtgtatatgtcaaggaatttatccatttcttctagattttctagtttatttgcatagaggtgtttgtagtattctcttatggtagtttgtatttctgtggaattggtggtgatatcccctttatcattttttattgctcctatttgattcttctctctttttttctttattagtcttgctagcggtctatcaattttgttgatcctttcaaaaaaccagctcctggattcgttaattttttgaagggttttttgtgtctctatttccttcagttctgctctgatcttagttatttcttgccttctgctagcttttgaatatgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagtggttttgagtgagattcttaatcctgagttccagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctccttataggtcactcaggacttgctttatgaatctgggtgctcctgtattgggtgcatatatatttaggatagttagctcttcttgttgaattgatccctttaccattaagtaatggccttctttgtctcttttgatctttgttggtttaaagtctgttttatcagagactaggattgcaaccccttcctttttttgttttccattttcttggtagatcttcctccatccttttattttgagcctatgtgtgtctctgcccatgagatgggtttcctgaatacagcacactgatgggtcttgactctttatccaatttgacagtctgtgtcttttaattggagcatttagtccattgacacttaaagttaatattgttatgtgtgaatttgatcctgtcattatgatgttagctggttgttttgcttgttagttgatgcagtttcttcctagtctcgatggtctttacattttggcatgattttgcagcggctggtaccggttgttcctttccatgtttagtgcttccttcaggagctcttttagggcaggcctggtggtgacaaaatctctcagtatttgcttgtctgtaaagtattttatttctcctttacttatgaagtttagtttggctggatatgaaattctgggttgaaaattcttttctttaagaatgttgaatattggcccccactctcttctggcttgtagagtttctgccgagagatctgctgttagtctgatgggcttccctttgagggtaacccgacctttctctctggctgcccttaacattttttccttcatttcaactttggtgaatctgacaattatgtgtcttggtgttgctcttctcgaggagtatctttgtggcgttctctgtatttcctgaatctgaatgttggcctgccttgctagattggggaagttctcctggataataccctgcagagtgttttccaacttggttccattctccccgtcactttcaggtacaccaatcagacgtagatttggtcttttcacatagtcccatatttcttggacgctttgctcgtttctttttattcttttttctctaaacttcccttctcccttcattttattcatttcatcttccatcacttataccctttcttccagttgatcacatcagctcctgaggcttctgcattcttcatgtagttctcgagccttggttttcagctccatcagctcctttaagcacttctctgtattggtgattctagttatatattcttctaaatttttttcaaagttttcaacttctttgcctttggtttgaatgtcttcccatagctcggagtaatttgattgtctgaagccttcttctctcagcttgtcaaagtcattctctgtccagctttgttccgttgctggtgaggaactgcattcctttggaggaggagaggcactctgctttttagagtttccagtttttctgctctggtttttctccatctttgtggttttatctacttttggtctttgatgatggtgatgtacagatgggtttttggtgtggatgtcctttctgtttgctagttttctttctaacagacaagaccctcagctgcaggtctgctggagtacccggccgtgtgaggtgtcagtctgcccctgctggggggtgcctcccagttaggctgctcgggggtcaggggtcagggacccacttgaggaggcagtctgcccgttctcagatctccagctgcgtgctgggagaaccactgctctcttcaaagct

SEQ ID NO: 12465 - DNA, 6122 bp, Homo sapiens
tttttctcattttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccaataatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaaaggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagatcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttatttctttattagtcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatccttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcagctggtactggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgacgccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgtgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccctgattgtgcattttagcctgggcaacagagcgacaccctgtctcaaaaaaaaaaaaaaaaaaaaaaaaaagaagaa

SEQ ID NO: 12466 - DNA, 6045 bp, Homo sapiens
ttttttttcctttcttttttttttttttattatactttaagttttagggtacatgtgcacattgtgcaggttagttacatacgtatacaagtgccatgctggtgcgctgcacccactaactcatcatctagcattaggtatatctcccagtgctatccctccaccctcccccaaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcatttttcatgtgttttttggctgcataaatgtcttcttttgagaagtgtctgttcatgtctttgcccactttttgatggggttgcttgtttttttcttctaaatttgtttgagttcattgtagattctggatattagccctttgtcatatgagtatgttgcgaaaattttctcccattttgtaggttgcctgttcactctgatggtagtttcttttgctgtgcagaaactctttagtttaattagatcccatttgtcaattttgtcttttgttgccattgcttttggtgttttagacatgaagtccttgcccatgcctatgtcctgaatggtaatgcctaggttttcttctaaggtttttatggttttaggtctaacgtttaagtctttaatccatcttgaattgatttttgtataagttgcaaggaagggatccagtttcagctttctacatatggctagcctgttttcccagcaccatttattaaatagggaatcctttccccactgcttgtttttctcaggtttgtcaaagatcagatagttgtagatatgcggcattatttctgagggctctgttatgttccattgatctatatctctgttttggtaccagtaccatgctgttttggtgactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccataagcatggaatgttattccatttgtttgtatcctcttttatttccttgagcagtggtttgtagttctccttgaagaggtccttcacgtcccttgtaagttggattcctaggtattttattctctttgaagcaattgtaaatgggagttcactcatgatttggctctctgtttgtctgttgttggtgtataagaatgcttgtgatttttgtacattgattttgtatcctgagactttgctgaagttgcttatcagcttaagcagattttgggttgagacagtggggttttctagatatacaatcatgtcatctgcaaacagggacaatttgatttcctcttttcctaattgaataccctttatttccttctcctgcctaattgccctggccagaacttccaacactatgttgaataggagtggtgagagagggcatccctgtcttgtgctagttttcaaagggaatgcttccagttcttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcctccttgtacctctggtagaattcagctgtgaatccatctggtcctggactctttttggttggtaagctattgattattgccacaatttcagctcctgttattggtctattcagagattcaatttcttcctggtttagtcttgggacagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttcactctttttttctttattagtcttgctagcggtttatcaattttgttgatcctttcaaaaaaccagctcctggattcattaattttttgaagagttttttgtgtctctatttccttcagttctgctctgattttagttatttcttgccttctgctagcttttgaatgtgtttgctcttggttttctagttcttttaattgtgatgttagggtgtcaattttggatctttcctgctttctcttgtgggcatttagtgctataaatttccctctacacaatgttttgaatgtgtcccagagattctggtatgttgtgtctttgctctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggcctgagagacagtttgttataatctctgttcttttacatttgctgaggagagctttacttccaagtatgtggtcaattttggaataggtgtggtgtggtgctgaaaaaaatgtatattctattgatttggggtggagagttctgtagatgtctattaggtccgcttggtgcagagctgagttcaattcctgggtatccttgttgactttctgtctcgttgatctgtctaatgttgacagtggggtgttaaactctcccactattaatgtgttggagtctaagtctctttgtaggtcactcaggacttgctttatgaatctgggtgctcctgtattgggtgcatatatatttaggatagttagctcttcttgttgtattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatatgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtacccgttgctcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatattgaatattggcccccactctcttctggcttgtagggtttctgccgagagatccgctgttagtctgatgggcttccctttgagggtaacccgacctttctctctggctgctcttaacattttttccttcatttcaactttggtgaatctgacaattatgtatcttggagttgctcttctcgaggagtatctctgtggcattctctgtatttcctgaatctgaatgttggcctgccttgctagattggggaagttctcctggataatatcctgcagagtgttttccaacttggttccattctccccatcactttcaggtacaccaatcagacgtagatttggtcttttcacatagtcccatatttcttggaggctttcctcatttctttttattcttttttctctaaacttcccatctcgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcctgtagctcagagtaatttgatcgtctaaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacgggaccctcagctgctggtctgttggaataccctgccgcgtgagatgccagtgtgcccctgctgtggggtgcctcccagttaggctgctcgggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgctgccgccttgcagtttgatctcagactgctgtgctagtaatcagcgagactccgtgggcgtaggaccgtacaagccaggtgcgggatataatcttgtggcgcgccccttttttaagccggtcggaaaagcgcagtattccggtgggagtgacccgattttccaggtgcgtccgtcacccctttctttgactcggaaacggaactccctgaccccttgcgcttcccaagtgaggcaatgcctcgccctgcttcggctcgcgcacggtgcgcgcacccactgacctgcgcccactgtctggcactccctagtgagatgaacccggtacctcagatggaaatgcagaaatcacctgtcttccacgtcgctcacgctgggagctgtagaccggagctgttcctattcggccatcttggctcctccct

SEQ ID NO: 12467 - DNA, 4942 bp, Homo sapiens
ttattattatactttaagttctagggtacatgtgcacaatgtgcaggtttgatacataggtatacatgtgccatgttggtttgctgcacccatcaactcatcatttacattaggtatttgtcctaatgctatccctcccccagccccccaacccctgacaggccccagtgtgtgatgttccccgccctgtgtccaagtgatctcattgttcaattcccacctgtgagtgagaacatgcggtgtttggttttctgtccttgtgatagtttggtcagaatgacggtttccagcttcaaccacgtccctgcaaaggacatgaactcatccctttttatggctgcatagtattccatggtgtatatgtgccacattttcttaatccagtctatcattgatggacatttgggttggttccaagtctttgctattgtgaatagtgctgcaataaacatatgtgtgcatgtgtctttatagtagcatgatttataatcctttaggtatatacccagtaacaagatggctgggtcaaatggtaattctagttctagatccttgaggaatcgccactgtcttccacaatggttgaactaatttacactcccaccaacagtgtaaaagcgttcctatttctccacatcctttccagcatctcttgtttcctgactttttaatgattgccattctaactggtgtgagatggtatctcactgtggttttgatttgcatttctctgatgaccagtgatgatgagcattttttcatgtatctgttggctgcataaatgtcttcttctgagaagtgtctaattcatatcctttgcccactttttcatgaggttgtttttttcttgtaaatttgtttgagttctttgtagattctggatattagccctttgtcggatgggttgattgcaaaaattttctcccattctgtaggttgcctgttctctctgatggtagtttcttttgccatgcagaagctctttagtttaattagatcccatttgtcagttttggcttttcttgccattgcttttggtgttttcgtcatgcagtccttgcccatgcctgtgtcctgaatggtactgcctaggttttcttctagggtttttatggttttagttctaacatgtaagtctttaatccatcttgaattaatttttgcataaggtataaggaagggatccagtttcagctttctacatatggctagcctgttttcccagcgcaccatttattaaatagggaatcctttccccatttcttgtttttgtcaggtttgtcaaagatcagatggttgtagatgtgtggtgttatttctgaggcctctgttctgttccattggtctatatctctgttttggtaccagtaccatgctgtttgggttactgtagccttgtagtatagtttgaagtcaggtagcgtgatgtctccagctttattcttttggcttaggattgtcttggcaatgcaggctctttttcggttccatatgaattttaaagtagttttttccaattgtgtgaagaaagtcatcggtagcttgatggggatggcattgaatctataaattactttgggcagtatggccattttcacgatattgattcttcctatccatgagcatggaatatgcttccatttgtttgtgtcctcttttatttccttgggcagtggtttgtagttctccttgaagaggtccttcacattccttgtaagtttgattcctaggtattttattctctttgtagcaattgcaaatgggagttctctcatgatttggctctctgtctgttaatggagtataggaatgcttgtgatttttgcacattgattttgtatcctgagactttcctgaatttgcttatcagtttaaggagattttgggctgagacgatggggttttctaaatatacaatcatgtcatctgcaaacagagacaatttgacttcctcattttctaattgaataccctttatttctttctcttgcctgactgccctggtcagaacttccaacactatgttgaacaggagtggtgacagagggcatccttgtcttgtgccggttttcaaagggaatgcttccagtttttgcccattcagtatgatattggctgtgggtttgtcataaatagttcttattattttgagatacattccatcaatacctagtttattgagagtgtttagcatgaagggctgttgaattctgtcgaaggccttttctgcatctattgagataatcatgtggtttttgtcattagttctgtttatgtgatggattatgtttattgatttgcatatgttgaaccagccttgcatcctagggatgaagctgacttgatcatggtggataaactttttgatgtgctgctggattcggtttgccagtattttattgaggatttttgcatcaatgttcatcagggatactggtctgaaattctctttttttgttgtgtctctgccaggctttggtatcaggatgatgctggcctcataaaatgcgttagggaggattccctctttttctattgattggaatagtttcagaaggaatggtaccagctcctctttgtacctctggtagaattcagctgtgaatccatctggtcctggactttttttggttggtaggctattacttactgcctcaatttcagagcctattattggtctattcagagattcaaattcttcctggtttagtcttgggagggtgtatgtgtccaggaatttatccatttcttctagattttctagtttatttgcgtagaggtgtttatagtattctctgatggtagtttgtatttctgtgggatcggtgctgatatcccctttatcattttttattgcatctatttgattcttctctcttttcttctttattagtcttgctagccgtacatctattttgttgatcttttcaaaaaacgagctcctggattcattggttttttgaagggtttttttgtatctctatctccttcagttctgctccgattgtagttatttcttgccttttgctagctttcgaatgtgtttgctcttcattctctcgttcttttaattgtgatgttagggtgtcgattttagatctttcctgctttctcttgtgggcatttagtgctataaatttccctgtacacaccgctttaaatgtgtcccagagattctggtatgttgtgtctttgttctcattggtttcaaagaacatctttatttctgccttcatttcgttatttacctagtagtcactcaggagcaagttgttcagtttccatgtacttgtgcagttttgagtgagtttcttaatcctgagttctaatttgattgcactgtggtctgagagacagtttgttgtgatttttgttcctttacatttgctgaggagtgctttacttccaactatgtggtcaactacagaataagtgtgatgtggtgctgagaagaatgtatattctgttgatttaggatggagagttctatagatgtctattaagtctgcttgttgcagagctgagttcaggtcctggatatgcttgttaaccttctgtctcgttgatctgtctaatattgacagtggggtgttaaagtctcccattattattttgtgggagtctaagtctctttgtaggtctctaaggacttgctttatgaatctgggtgctcctgtattgggtgcacatatacttaggatacttagctcttcttgttgaattgatccctttaccattatgtaatggccttctttgtctcttttgatctttgttggttcaaagtctgttttatctgagactaggattgcaagccctactttttttttttgctttccatttgcttggtagatcttcctccatccctttattttgagcctatgtgcatctttgcatgtgagatgggtctcctgaatacagcacactgatggatcttgactctttatccaatttgccagtctgtgtcttttaattagagcatttagtccatttacatttaaggttaatattgttatatgtgaatttgatcctatcattatgatgttagctggctactttgcccgttaattgatgcagtttcttcatagcatcaatggtctttacaatttggcatgtttttgcagtggctggtaccggttgtttctttccacgtttagtgcttccttcaggagctcttgtaaggcaggcctggtggtgacaaaatctcttggcatttgcttgtctgtaaagtattttatttctccttcagttatgaagcttagtttggctggatatgaaattctgggttgaaaactcctttctttaagaatgttgaatattggctcccactctcttctggcttgtaggtttctgccaagaaatctgctgttaatatgatgggcttccttttctgggtaacctgacctttctctctggctgcccttaacaccttttccttcatttcaaccttggtgaatctgacaattatgtgtcttggggttgctcttcttgaggagtatttttgtggtgttctctgtatttcctgaatttgaatgttggcctgccttgctaggttggggaagttctcctgaataatatcgtgaagagtgttttccaacttggttccattcttcccatcactttcaggtacaccaatcaaacgtaaatttggtcttttcacatagtcccatatttcttggaggctttcttcttttctttttactctttttttctctaacctggtcttctcacttaatttcattaatttgatcttcagtcactgataccctttcttccacttgatcgaattggctattgaagcttgtgcatgcatcatgaagttctcgtgccatggttttcagctgcatcaggtcatttaaggtcttctctacactgtttattctagttagccattcgtctaatcttttttcaaggtttttagcttccttgcgatgggttcgaatat

SEQ ID NO: 12468 - DNA, 5415 bp, Homo sapiens
tttttttttttttttaatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcagttcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcaggatttatagtcatttgggtatatacccagtaatgggatggctgggtcaaatggtatttctagttctagatccctgaggaatcgccacactgacttccacaatggttgaactagtttacagtcccaccaacagtgtaaaagtgtttgtatttctccacatcctctccagcacctgttgtttcctgactttttaatgattgccattctaactggtgtgagatgatatctcaatagtggttttgatttgcatttctctgatggccagtgatgatgagcattttttcatgtgttttttggctgcataaatgtcttcttttgagaagtgtctgttcatgtccttcacccactttttgatggggttgtttgttttttttcttgtaaatttgtttgagttcattgtagattctggatattagccctttgtcagatgagtaggttgcaaaaattttctcccatgttgtagtttgcctgttcactctgatggtagtttcttttgctgtgcagaagctctttagttttatgagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcattatttctgagggctctgttctgttccattgatctatatctctgttttggtaccagtaccatgctgttttggttactgtagccttgtagtatagtttgaagtcaggtagtgtgatgcctccagctttgttcttttgccttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttatatcctgagactttgctgaagttgcttatcagcttaaggagattttgggctgagacgatggggttttctagataaacaatcatgtcatctgcaaacagggacaatttgacttcctcttttcctaattgaataccctttatttccttctcctgcctgattgctctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattttgatgttagggtgtcaattttggatctttcctgctttctcttgtggggatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactacgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgtgggtttaaagtctgttttatcagagactaggattgcaaccccttcctttttttgttttccatttgcttggtagatcttcctccatccttttattttcagcctatgtgtgtctctgcacgtgagaagggtttcttgaatacagcacactgatgggtcttgactctttatccatttgccagtctgtgtcttttaattggagcatttagcccatttacatttaaggttaatattgttatgtgtgaatttgatcctgtcattatgatgttagctggctattttgttcattagttgatgcagtttcttcctagcatcgatggtgtttacaattgggcatgtttttgcagtggctggtactggttgttcctttccacgtttagcacttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatttgctgttagtctgatgggcttccctttgagggtaacccgacctttctctctggctgcccttaacattttttccttcatttcaactttggtgaatctgacaattatgtgtcttggagttgctcttctcgaggagtgtctttgtggcgttctctgtatttcctgaatctgaacgttggcctgccttgctagattggggaagttctcctggataatatcctgcagagtgttttccaacttggttccattctccgcctcactttcaggtacaccaatcagacgtagatttggtcttttcacatagtcccatatttattggaggctttgctcatttctttttattctttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattcgttattctagttatacattcttctaaatttttttcaaagttttcaacttctttgcctttggtttgaatgtgctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgaggttttctctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctc

SEQ ID NO: 12469 - DNA, 10554 bp, Homo sapiens
tttttttatgtgttttttttaaattttattattattatactttaagttttagggtacatgtgcacaatgtgcaggttagttacatatgtatacatgtgccttgctggtgtgctgcacccattaactcgtcatttagcattaggtatatctcctaaagctatccctacccccctccccccaacccacaacagtccccagagtgtgatgttccccttcctgtgtccatgtgttctcattgttcaatttccatctatgagtgagaatatgcagtgtttggttttttgttcttgcgatagtttactgagaatgatgatttccatggatgatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttgtagtcctttgggtatatacccagtaatgggatggctgggtcaaatggtatttctagttctagatccctgaggaatcgccacacttacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgtcgccattgcttttggtgttttagacatgaagtccttgcccatgcctatgtcctgaatggtaatgcctacgttttcttctagggtttttatgtttttaagtctaacgtttaagtctttaatccatcttgaattaatttttgtataaggtgtaaggaagggatccagtttcagctttctacatatggctagccagttttcccagcaccatttattaaatagggaatgctttccccatttcttctttttgtcaggtttgtcaaagatcagatagttgtagatacacggcgttatttctgagggctctgttctgttccatagatctatatctctgttttggtaccagtaccatgctgttttggttactgtagccttgtagtatagtttgaagtcaggtagtgtgacgcctccagctttgttcttttggcttgggattgacttggtgatgcgggctcttttttggttccatatgaactttgaagtagttttttccaattatgtgaagaaagtcattggtagcttgatggggatggcattgaatctataaattaccttgagcagtatggccattttcacaataatgattcttcctacccatgagcatggaatgtacaccaataatgttcaagctgagagtcaaattgagaatgttattacatttacaaaaactgaaaaaaaattaaaatacctagaaatatatctaactaaggaaatgaaaaaatctttacaaagagaactataaaacgctgttgaaaaaaaccagagatgacgcaaacaagtggaaaaacattccatgttcgtggacttgaagaatcaatactgtaaaaaaaggccattctgcccaatgcaatctacagattcactgctatccctatcaaactaccaatgtcatttttcacagaattagaaaaaaatgattctaaaagtcatatggaaccaaaaaagagcccaattcaccaaaacaatcctaaaccaaaagaataaagctggggacatcacattacccaattttacaatattataaggctacagtaaccaaaataacgtattactggtacaaagacagactcacagaccaatgaaacaggatagagaatccaaaattaagccacacacctatacagtcaccagatcttcgacaaaaccaacaaaaataagcaatggggaaagaaatccttattcaataaatggcgggatagctgactagccacaggctgaagagtgaaactggacctttacctttcaccatatacaagatggattaaagatttaaatgtagacctaaagctataagaatcctagcagagtctctaataaaaatacaaaaaattagctgggtgtggtggtgggatcctgtggttccagctacttgggaggctgaggcaggaggatgcctcaggttcatgcgaacctgggaggcagagcttgcagtgagatcgtgccactgcactccagcctgggcgacagagtgagactctgtctcaaaaaagaaaaaaaatcctggaagaaaacttaggaaacaccattgtggacattggcggcctgagaaagaatttacgactaagtccgcaaaagcaatctcaattaaaacaaaaattgacaaatgggacctaattaaactgaagagcttctgcacaataaaataaacttatcaacagaataaacagacaacctacagaatgggagaaaatatttgcatactatacatttgacaaaggtgtaatatccagaatctgtgaggaactaaaacaattcaataaagacaaataaccctattaaaaagtaggcaaaagacatgaacagatacttttcaaaagaaggcatacaagtggctaacaaacatatgaaaagatgctcaatatcattaatcatcatagaaaggcaaatcagaagcaccatgagataccattttacaccaattggaatggctgttagtcaaaacaaacaaacaaacaaacatggtggtgggactgcagagaaaaaggaatgcttatacactgccggtggggatgtaaattagttcggccattcagtttagagatttctcaaagaatttaaaacaactaccatctgactcagcaatcctatcacaggctatatatccaaaagaaaacaaataattctgccaaagagacacgggcatgcacatattcattgcagcattatttacaatagcaaagatatggaatcaacctaggtgcccatcaatggtggattggataaagaaaatgtagtacatatgcaccgtggaatactacacagccataaaaatgaaatcatatcctttgcaacaacatggatgcaactaggagccattatcctaggcaaattatgcaggaacagaaattcaaatactgtaagttcacacttataagtgagagctaaatattgggtactcatggatataaagatggcaacagtagacactgggggctagtagatgagggaggaaaggagaagggaaagaattgaaaaactgttaggtatcatgctcagtacctgggttatgggattatttgtatcacaaacttcagcatcaagcaatatgcccacgtaacaaaccagcacatgtacctcctcaatctaaagtaaaaattgaaattataaaaaacaataaataaaaactatcaattgttttacacataaaatattttccatctttaccacttttaagtgtatagctcattggaaataaatacctttatataaacataaaattttcccttattcctctcccctacattttctgacctctggtaatgatcattctactctctgtttttatgagatccacttctttagctcctacatatgagtgagaagatgggatatttgtctctctgttcttggcttatttcacttaacataatggttccatccgtgatactgcagatgacaggatttcattatttctcatgtctaaacaacattccattgtgtatatatacaccacattttctttatcgatttgtatgttgatgggcacttaggttgacttcatattttgggtattgtgaataatgctgcaacaaatatgggagtgcacatatccctttgatatattgatttcctttcttttggatatgttccaagtagtagaattgttggatcatatagtagttctatttttagtcttttgaggaacctccataatgttctccataatggatgtactaatttacattcctaccaacagttggacgagggttcctctttctccacattgttgccagcatctgttattgcctgtctttttgatataagccattttaaccggggtaagatgatatctcattgtggttttgatttgcatttctctgatgattagtgatattgggcacttttttcatatacctgttggccatttgcatgtcttcttttgagaattgtctattcagatcttttgcccatttttggttggattatttgttttttttaattgctgttgagttgtttgagatccttatatattctggttattaatcttttgccagacagatagtttgcaaattttttttccattctatgtgtcgtctcttcaccttgttcttacccttgtggcatggaagctttgtaacttttatttatttatttatttatttttttattattatactttaagttttagggtacatgtgcacattgtgcaggttagtaacatacgtatacatgtgccatgctggtgtgctgcacccactaactcgtcatctagcattaggtatatctcccaatgctatccctcccccctccccccaccccacaacagtccccagagtgtgatgttccccttcctgtgtccatgtgatctcattgttcaattcccaccaatgagtgagaatatgcggtgtttggttttttgtttttgcgatagtttactgagaatgatgatttccaatttcatccatgtccctacaaaggacatgaactcatcattttttatggctgcatagtattccatggtgtatatgtgccacattttcttaatccagtctattattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacacttacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcgtttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccgtttgtcaattttgtcttttgttgccattgcttttggtgttttagacatgacgtcctttcccatgcctatgtcctgaatggtaatgcctaggttttcttctagggtttttatggttttaggtctaacgtttaagtctttaatccatcttgaattgatttttgcataaggtgtaaggaagggatccagtttcagctttctacatatggctagccagttttcccagcaccatttattaaatagggaatcctttccccattgcttgcttttctcaggtttgtcaaagatcagatagttgtagatacacggtgttatttctgagggctctgttctgttccattgatctatatctctgttttggtaccagtaccatgctcttttggttactgtagccttgtagtatagtttgaagtcaggtagtgtgatgcctccagctttgttcttttggcttaggattgacttggtgatgcgggctcttttttagttccatatgaactttaaagtagttttttccaattctgtgaagaaagtcattggtagcttgatggggatggcattgaatctgcaagttaccttgggcagtatggccattttcacgatattgattcttcccacccatgagcatggaatgttcttccatttgtttgtatcctcttttatttccttgagcagcagtttgtagttctccttgaagaggaccttcacatcccttgtaagttggattcctaggtgttttattctctttgaagcaattgtgaatgggagttcactcatgatttggctctctgtttgtctcttgttggtgtataggaatgcttgtgaattttgcacattgattttgtatcctgagactttgctgaagttgcttatcagcttaaggagattttgggctgagacagtggggttttctagatatacaatcatgtcatctgcaaacagggacaatttgacttcctcttttcctaatttaataccctttatttccttctcctgcctaattgccctggccagaacttccaacactatgaataggagtggtgagagagggcatccctgtcttgtgccagttttcaaagggaatccttccagtttttgcccattcagtatgatattggctgtgggtttgtcatagatagctcttattattttgaaatatgtcccatcaatacctaatttattgagagtttttagcatgaaggttgttgaattttgtcagaggccttttctgcatgtattgagataatcatgtggtttttgtctttggctctgtttatatgctggattacatttattgatttgcgtatattgaacctgccttgcatcccagggatgaagcccacttgatcatggtggataagctttttgatgtgctgctggattctgttttccagtattttattgaggatttttgcatcaatgttcatcaaggatattggtctaaaattctcttttttggttgtgaccctgcccggctttggtatcagaatgatgctggcctcataaaatgagttagggaggattccctctttttctattgattggaatagtttcagaaggaatggtaccagttcctccttgtatctctggtagaattcggctgtgaatccatttggtcctggactctttttggctggtaagctattgattattgccacaatttcagctcctgttattggtctattcagcgattcaacttctttctggtttagtcttgggagagtgtatgtgtcaaggaatttatccatttcttctagattttctagtttatttgcacagaggtgtttgtagtattctctgatggtagtttgtatttctgtgggatcagtggtgatatcccctttatcattttttattgcgtctatttgattcttctctcttttttttttattagtcttgctagcggtctatcaattttgttgatcctttcaaaaaaccagctcctggattcattaattttttgaagggtttttttgtgtctctatttccttgagttctgctctgattttagttatttcttgccttctgctagcttttgaatatgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcaatttccatgtagttgagcggttttgagtgagattgttaatcctgagttctagtttgattgcactgtggtctgagagatagtttgttataatttctgtttttttacatttgctgaggagagctttacttccaagtatgtggtcaattttagaataggtgtggtgtggtgctgaaaaaaatgtatattctgttgatttggggtggagagttctgtagatgtgtattaggtccgcttggtgcagagctgagttcaattcctgggtatccttgttgactttttgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagacgaggattgcaaaccctgccttttttttgttttccatttgcttggtagatcttcctccatccttttattttgagcctatatgtgtctctgcacgtgagatgggtttcctgaatacagcacactgatgggtcttgactctttatccaatttgccagtctgtgtcttttaattggagcatttagtccatttacatttaaagttaatagtgttatgtgtgagtttgatcctgtcattatgatgttagctggttattttgctcgttagttgatgcagtttcttcctagtctcgatggtcgttacattttggcatgattttgcagcggctggtactggttgttcctttccatgtttactgcttccttcaggagctcttttcgggcaggcctggtggtgacaaatctctcagcatttgcttgtctgtaaagtgttttatttctccttcacttatgaagcttagtttggctggatatgaaattctgggttgataattcttttctttaagaaggttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatcttcgtggcgttctctgtatttcctgaatctgaactttggcctgccttgctagattggggaaattctcctggataatatcctgcagagtgttttccaacttggttccattctccacatcactttcaggtacaccaatcagacgtagatttggtcttttcacatagtcccatatttcttggaggctttgttcgtttctttttattcttttttctctaaactttccttctcgcttcatttcattcatttcatcttccattgctgataccctttcttccagttgattgcattggctcctgaggcttctgcattcttcacgtagttctcgagccttggttttcagctccatcagctcctttaagcacttctctgtattggttattctagttatacattcttctaaatttttttcaaagttttcaacttctttgcctttgatttgaatgtcctcccgtagctcagagtagtttgatcggctgaagccttcttctctcagctcgtcaaagtcattctccgtccagcttttttccgttgctggtgaggagctgcattcctttggaggaggagaggtgctctgatttttagagtttccagtttttctgttctgttttttccccatctttgtggttttatctgcttctggtctttgatgatggtgatatacagatgggtttttggtgtggatgtcctttctctttgttagttttccttctaacagacaggaccctcagctgcaggtctgttggagtacgctgcagtgtgaggtgtcagtgtgcccctgctgcagagtgcctcccagttaggcttctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagattgatctcagactgctgtgctagcaatcagcgagactctgtggggtagaaccctctgagcgaggtgcgggatataatctcatggtgcgccgttttttaagcctgtcggaaaagtgcagtattcaggtgggagtgacccgattctccaggtgccgtccgtcacccctttctttgattaggaaagggaactccctgaccccttgtgcttcccgagtaaggcaatgcctcaccctgcttcggctcacgcatggtgcgcgcacccactgacctgcgcccactgtctggcactcccgagtgaggtgaacctggtacctcagatggaaatgcagaaatcacccgtcttctgtgtcactcaggctgggagctgtagaccggagctgttcctattcggccatcttggctcct

SEQ ID NO: 12470 - DNA, 4915 bp, Homo sapiens
ttttttattgtacttcaagttctaaggtacatgtgcacaacatgcagttttgttacacaggtatacatgtgccatgttggtttgctgcacccatcaactcgtcatttacattaggtatttctcctaatgctatccctccccgagtcccacacccccaagtaggccctggtgtgtgatgttcccgccctgtgtccatgtgttctcattgttcaactcccacctatgagtgggaacatgtgatgtttggttttctgtccttgtgatagtttgcttagaatgatggtttccagcttcatccaggtccctgcaaaggacattaactaatcctctttatggctgcatagtattccatggtgtatgtgtgccacatttccttaatccagtctatcattgatagacatttgggttggtcccaagtctttgctattgtgaatactgccacaataaacatatgtgtgcatgtgtctttatagtagcatgatttataatcctttgggtatatacccaataatgggattggtgggtcaaatggtatttctagttctagatccttgaggaattgccacactgtcttccacaatggttgaactaatttacaccctcaccaacagtgtaaaagcattcctatttcttctccacatcctctctagcatctattgtttcctgactttttaatgatcaccattctaactggtgtgagatggtatctcatcacggatttgatttgcatttctctgatgaccagtgatgatgagcatttttttcaccgatctgttggctgcataaatgtcttcttttgagaagtgtctattcattacctttgcccactttttgatggggttgtttttttcttgtaaatttgtttaagttctttgtagattctggatattagccctttgtcagatgggtagattgcaaagatttcctcccattctgtaggttgcctgttcactctgatgatcatttcttttgctgtgcagaagccctttagtttaattagatcccatttgtcaattttggcttttgttgccattgcttttggtgttttagtcatgaagtctttgcccatgcctatgtcctaaatggtattgcctaggttttcttctatggtttttatggagttaggtcttacatttaagtctttaatccatcttgagttaatatttgtataaggtgtacagaagagatccaggttcagctttctatatatggctagccagttttcccagcaccatttattaaatagggaatcctttccccattgcttgtgtttgtcaggtttgtcaaagatcagatggttgtagatatgcggcattatttctgaggcctctgttctgttccattggtctatatctctgttttggtaccagtaccatgctgttttggttactgtagccttgtagtatagtttgaagtcaggtagtgtgatgcctccagctttgttcttttggcttaggattgacttggcaatgtgggctcttttttggttccatatgaactttaaagtagttttttccaatcctgtgaagaaagtcattggtagcttgatggggatagcattgactctgtgaattactttgggcagtatggccattttcatgatattgattcttcctatccatgagcatggaatgttcttccatttgtttgtgtcctcctttatttcattgagcagtggtttgtagttctccttgaagaggtccttcacatcctttgtaagttggatccctaggtgttttattttctttgtagtaattgtgaatgggagttcactcatgatttggctctctgtttgtctattattggtgtataggatgcttgtgatttttgccattgattttgtatcctgagactttgctgaagttacttatcaacctaaggagattttgggctgagacaatggggttttctaaatatacagtcatgccatctgcaaacagagacaatttgacttcctgttttcctaattgaataccctttatttctttctcttgcctgatttctctaggcagaacttccaacactatgttgaataggagttgtgagagagggcatccttgtcttgtgctgattttcaaagggaatgcttccagtttttgcccattcagtatgatattggctgtaggtttgtcaaaaatagctcttattattttgagatctgttccatcaatacctggtatattgagagtttttagtatgaaaggctgtcgaattttgtcgaaggctttttctgcgtctatggagataatcatgtggtttttgtcattggttctctttatgtgatggattacgtttattgatttgtgtatgttgaaccaaccttgcattccagggatgaagccgacttgattgtggtggataagctttttgatatgctgctggatttggtttgccagtgttttattgaagatttttgcgttgatattcatcaggaatattggcctaaaattctctttttttgttgtgtctctgccaagctttggtatcaggatgaggctagcctcgtaaaatgagttagggaggattccctccttttcttttgattgaaatagtttcagaaggaatggtatcagctcctttttgtacctctggtagaattcggctgtgaatctgtctggtcctggatgttttttggttggtagggcattaattattgcctccatttcagaacctgttattggtctattcagagattcaacttcttcctggtttagtcttaggagggtgtatgtgtccaagaatttatccatttcttctagattttctagtttatttgcgtagaggtgtttatagtattctctgatggtagtttgtatttctgtgggattggtggtgatatcctctttatcattttttgttgtgtctatttgattcttctctcttttcttctttattagtcttgctaggggtctatctattttgttgatcttttcaaaaaaccagctcctggattcactgatttgttgaagggttttttgtgtttctagcccttcagttctgctctgatcttagttatttcttgctttctgctagcttttaagtttgtttgctcttgcttctctagttcttttaattgtgatgttagggtgtcgattttagatctttcctgctttctcttctgggcatttagtgctataaatttccctctacacattgctttaaatgtgtcccagagattctggtatgttgtgtctttgttctcattggtttcaaataacgtctttatttctgccttcattttgttatgtacccagtagtcattcaggagcaggttattcagtttccgtgtagttgtgggggtttgagtgagtttcttaatcctgagctctaatttgattggactgtggcctgagagacagtttgttctgatttctgttcctttacatttgctgaggagtgttttactaccaattgtgtggtcaattttagaataagtgcgatgtggtgatgagaagaatgtatattctcttgatttggggtgtagacttctgtagatgtctattaggtctgcttggtctagagctgagtttgagtcctagataaccttgttaaccttctgtctcgtttatctgtctaataatgatggtggggtgttaaagtctcccattattattgtgtgggagtctaagtctctttgtaagtctctaaggacctgcttcatgaatctgggtgctcctgtattggatgcatatatatttaagatagttagctcttcttgttgaattgatgcctttaccattatgtaatggccttctttgtctcttttgatttttgttggtttaaagtctgttttatcagagactaggattgcaacccttgcttttttttttctttccatttgcttggtagatcttcctccatccctttattttgagcctatgtgcatctttgcacatgagatgggtctctgaatacaacacaccaataggtcttaattctttatccagtttgccagtctgtgtcttttaattggggcatttagcccatttgtatttaaggttaatattgttatgtttgaatttgatcgtgtcattatgatgttagctggttattttgcccgttaattgatgcagtttcttcatagcgttgatggtctttacaattcagcatgtttttgcggtggctggtaccagttgttccttttcatgtttagtgcttccttcaggagctcttgtaagacaggcctgatggtgacaaaatctctcagcatttgcttgtctgcaaaggattttatttctccttcacttatgaagcttagtttggctggatatgagattctgggttcaaaattcttttctttaagaatgttgaatattggcccccactctcttctggcttgcagggtttctgctgagagatctgctgttagtctgataggcttccctttgtgggtaacccaagctttctctctggctgcctgtaatattttttccttcatttcaaccttggtgaatctgacaattatgtgccttgaggttgctcttttcgaggagtatctttgtggtgttctctgtatttcctgaatttgaatgttggcctgccttgctaggctagggaagttctcctggataatatcctgaagggtgttttccaacttggttccattctccccatcactttcaggtataccaatcaaacgtagatttggtcttttcacatagtcccatatttcctggacactttattcatttctttttactcttttttctctaactttgtcttcttgctttatttcattaatttgatcttcgatcactgatatcctttcttccacttgattgaatcggctattgaagcttgtgcatgcgtcacgaagttcttttgccatggttttcagctccatcaggtcatttaaggtcttctctacactgtttattctagttagccattcatctatccttttttcaaggttttt

SEQ ID NO: 12471 - DNA, 18491 bp, Homo sapiens
ttgtatttatttatttatttattattattatactttaagttttagggtacatgtgcacaatgtgcaggttagttacatatgtatacatgtgccatgctggtgcgctgcacccactaactggtcatctagcattaggtatatctcccaatgccatccctcccccgaccccacgaccccacaacagttcccagagtgtgatgttccctttcctgtgtccatgtgttctcattgttcaattcccacctatgagtgagaacatgtggtgtttggttttctgtccttgagatagtttgctcagaatgatggtttccagcttcatccatgttcccacaaaggacataaactcatccttttttatggctgcatagtattgcatggtgtgtatgtgccacattttcttaatccagtctatcattgatggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgactttcacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatatctctgatggccagtgatggtgagcagtttttcatgtgttttttggctgcataaatgtcttcttttgagaagtgtctgttcatgtcctttgcccactttttaatggggttgtttgtttttttcttgtaaatttgtttgagttcgttgtagattctggatattagccctttgtcagatgagtaggttgtgaaaattttctcccattttttaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcctgaactgattttcgtataaggtgtaaggaagggatccagtttcagctttctacatatggctagccagttttcccagcaccatttattaaatagggaatcctttccccattgcttgttttcctcaggtttgtcaaagatcagatagttgtagatatgcggcgttatttctgaggcctctgttctgttccattgatctatatctctgttttggtaccagtaccatgctgtttttgttactgtagccttgtagtatagtatgaagtcaggtagtgtgatgcctccagctttgttcttttggcttaggattgacttggcgatgcaggctcttttttggttccatatgaactttaaagtagttttttccagttctgtgaagaaagtcattggtagcttgatggggatggcattgaatctgtaaattaccttgggcagtatggccattttcacaatattgattcttcctacccatgagcatggaatgttcttccacttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatccagagactttgctgaagttgcttatcagcttaaggagattttgggctgagacaatggggttttctagatatacaatcatgtcatctgcaaacagggacagtttgacttcctcttttcctaactgaataccctttatttccttctcctgcccaattgccctggccagaacttccaacactgtgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagtatgaaaggttgttgaattttgtcaaaggccttttctgcatctattgagataatcatgtgttttttgtctttggttctgtttatatgctggattacctttattgatttgcgtatattgaaccagccttgcatcccagggatgaagcccacttgatcatggtggataagctttttgatgtgctgctggattcggtttgccagtattttattgaggatttttgtatcaatgttcatcaaggatattggtctaaaattctcttttttggttgtatctctgtccggctttggtatcaggatgatgctggcctcataaaatgagttagggaggattccctctttttctatggattggaatagtttcagaaggaatggtaccagttcctccttgtacctctggtagaattcggctgtgaatccatctggtcctggactctttggttggtaagctattgattattgccacaatttcagatcctgttattggtctattcagagattcaacttttcctggtttagtcttgggagggtgtatgtgtccaggaatttatccatttcttctagattttctagtttatttgcatagaggtgtttgtagtattctctgatggtagtttgtatttctgtgggatcggtggtgatatcccctttatcattttttattgcatctatttgattcttctctctttttttgtttattagtcttgctagcagtctatcaattttgttgatcctttcaaaaaaccagctcctggattaattaattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttggatgcgtcccagagattctggtatgtggtgtctttgttctcgttggtttcaaagaacatctttatttctgccttcgttttgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgttgaggagagctttacttccaagtatgtggtcaattttggaataggtgtggtgtggtgctgaaaaaaatgtacattctgttgatttggggtgaagagttctgtagatgtctattatgtctgcttggtgcagagctgagttcaattcctgggtatccttgttgactttctgtctcgttgatgtgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatgtttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtatattttaattggagcatttagtccatttacatttaaagttaatattgtaatgtgtgaatttgatcctgtcattatgatgttagctggttattttgctcattagttgatgtagtttcttcgtagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaaggattttatttctccttcacttctgaagcttagtttggctggatatgaaattctgggttgaaaattcttttctttaagaatgtcgaatattggcccccactctcttctggcttgtagagtttctgccgagagatccgctgttagtctgatgggtttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgctttgctagattggggaagttctcctggataatatcttgcagagtgttttccaacttggttccattctccccgtcactttcaggtacaccaatcagacgtagatttggtcttttcacatagtcccatatttcttggaggctttgctcgtttctttttattcttttttctctaaacttcccttcccgcttcatttcattcatttcatcttccatcgctgataccctttcttccagttgatcgcattggctcctgaggcttctgcattcttcacatagttctcgagccttggttttcagctccatcagctcctttaagtacttctctgtattggttattctagttatacattcttctaaacttttttcaaagttttcaacttctttgcctttggtttgaatgtcctcccgtagctcggagtaatttgatcgtctgaagccttcttctctcagctcgtcaaagtcattctccgtccagctttgttccgttgctggtgaggaactgcgttcctttggaggaggagaggcgctctgctttttagagtttccagtttttctgctctgttttttccccatctttgtggttttatctacttttggtctttgatgatggtgatgtacagatgtgtttttggtgtggatgtcttttctgtttgttagttttccttctaacagtcaggaccctcagctgcaggtctgttggagtacccagccgtgtgaggtgtcagtctgcccctgcttgggggtgcctcccagttaggctgctcgggggtcaggggtcagggacctacttgaggaggcagtctgcccgttctcagatctccagctgcgtgctgggagaaccactgctctcttcaaagctgtcagactgggacatttttttgtcctgcttatttctaattgagtttctttggatcttctctccttttcttcgttaatctcactaatggtctatcaatttcatttctcttttcaaagaaccagctctttgtttatcttttatattgtgttttttttgtttgtttcaatttcatttaattctgccctgatcttagttatttctttacttctgctgggtttgggtttggttgattcttgtttctctaactccttgaggtgtgaccttagattgtctatttgtactctttcagacttcatgatgtaggcatttaatactatgaactttcctcttagctctgtctttgctgtattccagaggttcagatattttgatagtttgtgtcactactatcattcagttcaaagaattttttaatttccatcttgatttcattgttgacccagtgatcattcaggagcaggttattgtacttccatttatttggcatggttttgagggttccttttgcagttggtttctaattttattctactgtggtctgtgagagtacttgataagatttttattttttaaaatgtgttgagacttgttttgtggcctatcatatatggtctatcttggagaatgtttcatgtgctgattaatgaatatatactctgcagtttttggctagaatgttctgtgaatatctgtttagtttatttgttctagggtacagtttaagtccatagtttctttgttgactttctgtcttgatgacctgtctactgctgtcagtggagtattgaagtcccccactattactgtattaacatctatctcatttttttggtctagtagtaattgttttgtaaatttgggagctccagtgttaggtgcatagatacatttaggattgtgatattttcctgctggactagtccttttatcatcatataatacccctctttgtcatttttaactgctgttgctttgaagtttgtgtgatacaagaatagctactcctgcttgcttttgttgtccatttgcatggaaagatattccattggtaacaaatatcccactggtattttgttggtaactttttaattaccatttcaatcttgctgcttgttattggcctgttcagagtttctgtttcttcctgggttaatgtaggagggttgtatatttccaggaatttatccatctcctctaggttttctagttattccattcaagatattccatccaaatggacatcaaaagcaagcaggagtagctattccacccctttacctaagtttatgtgagtctttatgtgtcaggtgggtctcttgaagatagaatatacttggttgatgaattcttatccattctgccatttcatatcttttaggtggagcatttaggccatttacattaaacattagtattgagatgtgaggtactattctattcatcgtactatttgttgcctgaataccttaggtttttttttcattgtgttaaaatgaaaaattataggtcctgtgagatttatgctttaaggatattctattttgatgattttgaggatttaagatttagagctccttttagcagttcttttagtgctggcttggtagtggcaaattcagcatttgtttgtctgaagaagactgtatctttccttcatttatgaagcttaattttgttggatacaaaattcttggctgataattgctttgtttaaggaagctaaagataggaccccaatcccttttagcttgtagggtttcggctgagaaatctgctattaatctgataggttatcttttataggttacctgatgcttttgccgcatagctcttaagagtctttcctttttcttgactttagataacctgatgactatgtgcctaggcaatgatctttttgtgatgaatttcccaggtgttctttgaacttcttgtatgtggatgtctagatctctagcagagctgaggaagttttcttcaattattccctcaaatatgttttccaaacttttagatttatcttcttcctcaggaacaccaattattcttaggtttggtcatttaacataatcccaaacttcttggaggctttgatcattttaaaaaattctttcttctttgtctttgtcagattgggctaatttgaaagccttgtctttgagctgggaagtttctttcttccatttgttcaattctattgctgagaccttccaatgcattttgcattttgcatttctctaagtgtgttcttcatttctagaagttgtgctttttgttttgtttttgtttcgttttgagatggagattcactcttgtcgcccaggctggactggaatggcgcaatcttggctacctgcaacctctgcctcctgggttcaagcgaatctcctatctcagcctcccgagtagctgggattacaggcgtctgccaccacagctggttaatttttctatttttagtagagacagggttcaccacgttgggcaggctggttttgaactcctgacctcaggtgatccacctgcctgagcctcccaaactgctgggattgcaggcgtgagccactgctcccggccgtgattgttttttacttatgctatttcactggagatttttccattcatatcctatatcttttttttttttttctttgaaaaggagtcttgctctgtcacccaggctggagtgcagtgccacaatctcggctcactgcaacctctgcctccctaggttcaagcaattctgcttcagcctccccagtagctgggattataggcgcccaccaccatgcctagctaatttttgtatttttagtagagacagggttttgccacgttggccaggctggtctcgaactcctgacctcaagtgatccacctgcttcggcctcccaaagtgttggggttataggtgtgagccgctacacctggccctatatcattttttttatttctttaagttagactttacctttctctggtgcctccttgattgacttaatagttgaccttctgaattcttttttcctgcagtttagagattttgtcttggtttggatccactgttggtgagctagtgtgatcttttggggtgttaaagaaccttgttttgtcatattaccagaattgcttttctggttccttctcatttgggtagagaatgtgagggaagatctgggactcaagggctgctgttcagattcttttgtcccacaggatgctcctttgatgtggtgctctccccttttccctagggatggcatgtcttgagagccaaactgcagtgattgttatttctcttctggatctagtcacccagcagggctaccaagctctgggctggtactggggagtgtctgcaaagagtcctgagatgtgattcatcttcaggtctttcagccatggataccagcacctgctcaagtggaggtagcaggagagtgaagtggaccctgtgagggtccttggttgtatttttgttaagtgtactactggttttgtgttcgttggcctccagccaggaggtggcgctttcaagagtgcatcagctgtggtattatagggaaaatcacactgtgggcggggccatagagctcccaagagattatgtccttttttttggagttcttctgctgtcccgcagagcctacagcagcaatccatctccttctgtctgctcaattctcttggctttcctggtatattcctgcagtagttcttggagcaaaagttcacaatgtgggtttccacacgctgctctgtccatctgagtgggaactgcaaattagtcctgcctcctatctaccatcttccctccagtataccccctgctgctagtatttttaaacaaaccatgccactctcttctttaaaacacctgtgagagtttgcacttgctaacacaataaagtccaggacctttggcattttctatgttatattttccttcccagttcatgtcctgccatcctctccgaagcaccctgtgtcaatcacacctactcgcttgttcttcacacatagaggtcctctctctctccatgtatctgctcagggtatcatttcctctctttggcaccctggagtcttcatttaaatcccagactgaatataacacctcctgtgaaaccttgagggattgccctaacatttgtccctcctaccccaactctgtgatctgaaatctgtcttactacatgagttttataatactgtttacccaatttgtctctagactgtaagattctcaagaggaaggacctgtttctctttggatacccagcttgacaatgaatgcatttgttcacggaggaagatagtttgagcttaatgggaggtttagcttcagataaggttatagggaaaacaggatatttcctcttctctttatactcagaaagttcaggttccccgtgtagaaagaagaatgtagcagattgctaagctacatgaaaatgtgtttgctcacattttaaatggtgtaaaatataaattaacatcatcattagaaggctggccttaaaaagtcacatggtctctaggaagtcaataagtaaagaacagagcagcttttgtgggcaagactatactttgccaagtgaactaattagctgtatggtcaccagtgaattactttatcccagaccttgtgtgtttttgatttctcagacctcacggggatgaagggccttggttttaaagagctcggactaaatgatccaaagatttctttttgttactaaaattagttctactttaattcttaaggtctgtagaaattaaaatggaaataatttatatttgaagtagaaatacctattcactcttcatgtgctggtgtagtattggaaatcagtctgctaaaccgattcatacttcagtgatagaagatgccaccctgagttactttccccagtagccagatggaaccagtaaggaatatcatatcctaaaagaacaaatccatgtttaaagactgggaggaagatctttttgggttggagtaaggaaagttttgcaccaaggctaagcttgttgccttgtgcattctgctttgtgctcatattcgagttttgaggcaaaaacacacacctagcagtttgggacatgaggcctccatatcacctagtttttccaacccaacaaaccctcaagtttctcccgagagaaagaatataccattgtataagtttcctattgctgctgtaacaagttaccacaaacattaaaaaacatatcttacagttctggaactcaagtcctaaaatcaagctattgctggagccacattcctcttggaggctgtaggggagaatctgtttccttgcatttaccagcttgcagaggctgcctgcgttccgtcacttgtggcatcttcctccattttctagccaattgtggaggatctttaaatctctttactaaagaccctggtgattactttgtgtccacctggataatccaggataatcccccaactcaaaaatgcttcatttagtcacatctgcacagtcccttttgccatgtaaaatttataacttcaggggattaggatatggacatatctggggagctgctattcagcctaccatgactataaatatcattaacctaattaaaatggcctaaattagctggctgtggtggctcacctataatcccaggactttgggaggccaagatgggaggatcgcttgagctcaagagttcaagaccgaccagcctggtcaacagagtgagaccccatctacacacacacacacaaaaattagctgggtgtggtggcccacagctgtagtcctagctaattgggaggctaaggcaagagaatcacctgagttcaggagatggaagctgcagtgagttgtgatcaggccacttcactccaccctgggtgacagagcaagaccctatctcaaaaagaaaaaaaaagaaagcctagatagactttagtttgtattaattatagcttggctatacaatgagtcccaaattaggacatatattaaacgtccattgatttttaattactaaagcagtggttctcaaactttaatgtgtatcaaaatcacctggaaaactaaagtgatttctgggccccatccccatagcttctgactcaaaatatttagatctgggtcaaggctcaagaatttgcatttctaacagattccagatgctgctactactggtccgaaaacaaccccactggaagatgaataaagtggacacaacaaatagcatatgttctactatagaggtggccacatgaagagctctgcaagcccactgtgaaattgatagcaaatctttattcaagtgtattaattgacccacaaatatcctgattaatgaagctggctagtttggcaagatgcattctaactcttaaagtgattgattactgtggagatgtgtgatgacagattggcacctactaaggaaacctctcttgcctggtacattattaaaaataatccagtggggaaataggactaatttaattacatgcctttatgcagtaagatccacagttgaaaaatagaggcagtagctttaattgcactgtaatgttcacacacaaatcatatcttgcttgaaacagttttatggcaaaaatagaccatatattgatttcacatatataacatttaacccttcaagcctttttgcccattaaatatacacacctttacaaaccaataacagtttagaagaattaagctcttctgattataaacttttacattattgatcagacagtagcacataaaattgcttttttttttagtattttacatgaataattttatttgtgcttcatgaaaactccatttatcccattttttattatactttaagttttagggtacatgtgcacaatgtgcaggtttgttacatatgtatacacgtgccgtgttggtgtgctgcacccattaactcatcatttacattaggtatatctcctaatgctatccctccccctccccccaccccacaacaggccctggtgtgtgatgttccccttcctgtgtccatgtgttctcattgttcagttcccacctatgagtgagaacatgcagtgtttggttttttgtccttgcgatagtttgctgagaatgatggtttccagcttcatccatgtccctacaaaggacatgaactcatcattttttatggctgcatagtattccatggtgtatatgtgccacatttccttaatctagtctatcattgatggacatttgggttggttccaagtctttgctattatgaatagtgctgcaataaacatgtgtgcatgtgtctttatagcagcatgttttataatcctttgggtatatacccagtaatggggtggctgggtcaaatgatatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccacttgttgatggggttgtttgtttttttcttgtaaatttgttagagttctttgtagattctggatattagccctttgtcagatgagtagattgcaaaaattttctcccattctgtaggttgtctgttcactctgatggtagtttcttttgctgtgcagaagctctttagtttaattagatcccatttgtcaattttggcttttgttgccattgcttttggtgttttagacatgaagtccttgcccatacctatgtcctgaaaggtattgcctaggttttcttctagggtttttacggttttaggtctaacatttaagtctttagtccatcttgaattaatttttatataaggtgtaaggaagggatccagtttcagctttctacatatggctagcaaggtttcccagcaccatttattaaatagggaatgctttccccatttgttgtttttgtcaggtttgtcaaagatcagatggttgtagatgtgtggtattatttctgagggctctgttctgttccattggtctatatctctgttttggtaccagtaccatgctgttttggttactatagccttgtagtataatttgaagtcaggtaacatgatgcctccagctttgttcttttggcttaggattgtcttggcaatgcgggcccttttttggttccatatgaactttaaagtagttttttccagttctgtgaagaaagtcattggtagcttgatgagggtggcattgaatctataaattaccttgggcactatggccattttcatgatattgattcttcctatccatgggcatggaatgttcttgcatttgtttgtgtcttcttttatttcattgagcagtggtttgtagttctccttgaagaggttcttcacatcccttgtaagttggattcctaggtattttattctctttgaagcaactgtgaatgggagttcactcatgatgtggctctctgttcgtctgtgatttgtgtataagaatgcttgtgattttttgcacattgattttgtatccagagactttgctgaagttgcttatcagcttaaggagattttgggctgagacgatggggttttttaaatatacaatcatgtcatctgcacacagggacaatttgacttcctcttttcctaattgaataccctttatttctttctcctgcctaattgccctggccagaacttccaacactgtgttgaataggagtggtgagagagggcatctttgtcttgtgccagttttcaaagggaatgcttccaggttttgcccattcagtatgatattggctgtgggtttgtcataaatagctcttattattttgagatacatcccatcaatacctaatttattgagagtttttagcatgaagggctgttgaattttctcaaaggccttttctgcatctattgagataatcatgtggtttttgtctttggttctctttatatgctggattacatttattgatttgcatatgttgaaccagccttgcatcccagggatgaagcccacttgatcatggtggataagctttttgatgtgctgctggattcggtttgccagtattttattgaggatttttgcatcaatgttcatcagggatattggtctaaaattctctttttttgttgtgtctttgtcaggctttggtatcaggatgatgctggcctcataaaatgagttagggaggattccctctttttctatggattggaatagtttcagaaggaatggtaccagcttcttgtacctctagtagaattcggctgtgaatccatctggtcctggactttttttggttggtaggctattaattattgcctcaatttcagatcctgttattggtctattcagagattcaacttcttcctggtttagtcttgggagagtgtatgtgtcgaggaatttatccatttcttctagattttctagtttatttgcttagagatgtttatagtattctctgatggtagcttgtatttctgtgagatcagtggtgatatccccttcatcatttttttattgcctctatttgattctcccctcttttcttctttattagtcttgctagcagtctatcaattttgttgatcttttcaaaaaacgagcccctggattcattgattttttgaagggttttttgtgtatctccttcagttgtgctctgatcttagttatttcttgccttctgctagcttttgaatgtgtttgctcttgcttctctagttcttttaattgtgatgttagggtgtcaattttacatctttcctgctttctcttatgggcatttagtgctataaatttccctctacacactgctttaaatgtgtcccagagattctggtatgttgtgtctttgttctcactggtttcaaagaacatctttatttctgccttaattttgttatatacccattagtcattcaggagaaggttgttcagtttccatgtagttgagcggttttgagtgagtttcttaatcctgagttctactttgattgcactgtggtctgagagacagtttgttataatttctgttcttttacatttgctgaggagtgctttacttccagctatgtggtcaattttggaataagggcaatgtggtgctgagaagaatgtatattctgttgatttgtggtggagagttctgtagatgtctattaggtctgcttggtgcagagctgagttcaattcctggatatccttgttaactttctgtctcgtttatctgtctaaggttgacagtggggtgttaaagtctcccattattattgtgtgggagtctaagtctctttgtaagtctctaaggacttgctttatgaatctaggtgctcctgtattgggtgcatatatgtttaggataattagctcttcttgttgaattgatccctttaccattatgtaatggccttgtctcttttgatctttgttggtttaaagtctgttttatcagagactaggattgcaacccctgccttttttttccatttgcttggtagatcttcctccatccctttgttttgagcctatgtgagtctctgcatgtgagatgggtctcctgaatacagcacactgatgggtcttgactctttatccgttttgccagtctgtgtattttaattgaagcatttagcccatttacatttaaggttaatattgttatgtgtgaacttgatcctgtcattatgatgttagctggttattttgctcattagttgatgcagtttcttcctagcattgatggtctttacattttggcatgtttttgcagtggctggtaccagtcgttcctttccatgtttactgcttctttcaggagctcttgtagagcaggcctggtggtgacaaaatctctcagcatttgcttgtctgtaaaggattttatttctccttcacttatgaagcttaatttggctggatatgaaattctgggttgaaaattcgtttaagaatgttgaatattggcccccactctcttctggcttgtagagtttctgctgagattcgccgttagtctgatggtcttccctttgtgggtaacccgacctttctctctggctgcccttaacattttttccttcatttcaactttggtgaatctgacaattatgtgtcttggagttgctcttctcgaggattatctttatggcattctctgtatttcctgaatctgaatgttggcctgccttgctaggttggggaagttctcctggataatatcctgcagagtgttttccaacttggttccattctccccatcactttcaggtacaccaatcagacataaatttggtcttttcacatagtcccatatttcttggaggctttgttcatttccttttactcttttttctctaaacttctcttcttgcttcatttcattcatttgatcttcaatcactgataccctttcttccagttgatcgaatcggctactgaagcttgtgcattcatcacgtagttctcttgccatgtttttcagctccatcaggtcatttaaggacttctctacactgtttattctagttcgccattcatctaatcttttttcaaggtttttagcttctttgcagtgggttcaaacttcctcctttagctcagagaagtttgatcgtctgaagccttcttctctcaacttgtcaaagtcattctccatccagctttgttccgttgctggtaaggagctgcgttcctttggagggggagaggcgctctgatttttagaattttcagcttttctgctctcttttttccccatctttgtggttttatctatctctgctctttgatgatggtgacgtacagatggggttttgatgtggatgtcctttctgtttgttagttttccttctaacagtcaggaccctcagctgcaggtctgttggagcttgctggaggtccactccagaccctgtttgcctgggtatcagcagcagaggctgcagaacagcacatattgctgaacagcaaatgttgctgcctgatcgttcctctggaagcttcatctcagaggggcacctggccatgtgaggtgtcagtctgcccctactgggaggtgcctcccagttaggctactcgggggtcagggacccacttgagggggcagtctgtccgttctcagatctcaaactcctttctgggagaaccactattcacttcaaagctgtcagacagggacatttaagtctgcagaggtttctgctgccttttgttcggctatgacctgcccccagaggtggagtctacagaggcaggcaggcctccttgagctgtggtgggctccacccagttcgagcttcctggctgctttgtttacctactcaagcctcagcaatggtggatgcccctcccccagcctcgctgccatcttgcagatagatctcagaccgctgtgctagcagtgagtgagtatctgtgggcgtgggaccctccgagccaggtgtgggatataatctcctggtgtgccgtttgctaagaccattggaaaagctcagtatttgggtgggaattacctgattttccaggtgccatctgttaccacttcccttggctaggaaagggaattccctgaccccttgcacttcccggctgaggcgatgcctcaccctgctttggcttacgctcggtgggctgcacccactgtcctgcccccactgtccgacaagccccgtgagatgaacccggtacctcagttggaaatgcagaaatcacctgtcttctgcgtcactcgcgctgggagctgtagactggagctgttcctatttggctatcttggaaccgcaaacagtatgtttttcttacattttttcctttacctttttgtttgacttacaggggtttaagtattctgtattatcttgtttttattaaacctgttctagaaataaa

SEQ ID NO: 12472 - DNA, 6056 bp, Homo sapiens
tgagttttttttctttgctttctttttttttttattatactttaagttctagggtacatgtgcacattgtgcaggttagttacatatgtatacatgtgccatgctggtgcgctgcacccactaactcgtcatctagcattaggtatatctcccaatgctatccctcccccatcccccaaccccaccacagtccccagagtgtgatattctccttcctgtgtccatgtgatctcattgttcaattcccacctgtgagtgagaatatgcggtgtttggttttttgttcttgccaaagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatcccttaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgaacattttttcatgtgttttttggctgcataaatgtcttcttttgagaagtgtctgttcatatccttcgcccactttttgatggggttgtttgttttttcttgtcaatttgtttgagttcattttagattctggatattagccctttgtcagatgagtaggttgtgaaaattttctcctattttgtaggttgcctgttgactctgatggtagtttcttttgctgtgcagaagttctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaagtctttaatccatcttgaattgatttttgtataaagtgtaaggaagggatccagtttcagctttctacatatggctagccagttttcccagcaccatttattaaatagggaatcctttccccattgtttgtttttctcaggtttgtcaaagatcagatagttgtagatatgtggcgttatttctgagggctctgttctgttccattgatctatatgtctgttttggtaccagtaccatgctgttttggttactgtagccttgtagtatagtttgaagtcaggtagcgtgatgcctccagctttgttcttttggcttaggattgccttggcgatgcgggctcttttttggttccatatgaactttaaagtagttttttcgaattctgtgaagaaagtcattggtagcttgatggggatggcattgaatctgtaaattaccttgggcagtatggccattttcacgatattgattcttcctacccatgagcatggaatgttcttccatttgtttgtatcctctttgatttccttgagcagtggtttgtagttctccttgaagaggtccttcacatcccttgtaagttggattcctaggtattttattctctttgaagcaattgtgaatgggagttcactgatgatttggctctctgtttgtctgttgttggtgtataagaatgcttgtgattttgtacattgattttgtatcttgagactttgctgaagttgcttatcagcttaaggagattttgggctgagacaatggggttttctagatatacaatcatgtcgtctccaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtgtattgaaccagccttgcatcccagggatgaagcccactcgatcatggtgaataagcttttttgatgtgctgctggattcgttttgccagtattttattgagggcttttgcatcaatgttcatcaaggatattggtctaaaattctctttttttgttgtgtctctgcctggctttggtttcagaatgatgctggcctcataaaaagagttagggaggattccctctttttccattgattggaatagtttcagaaggaatggtaccagttcctccttgtacctctggtagaattcggctgtgaatccatctggtcctggactctttttggttggtaagctattgattattgccacaatttcagatcctgttattggtctgttcagagattcaacttcttcctggtttagtcttgggagagtgtatgtgtcaaggaatttatccatttcttctagattttctagtttatttgcgtagaggggtttgtagtattctctgatggtagtttgtatttctttgggatcggtggtgatatcccctttatcattttttattgcgtctatttgattcttctctcttttcttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttcttgttgatttcaaagaacatctttatttctgccttcatttcgttatgtacccagtagtcattcaggagcaggttgttcagtttccatgtatttgagcggttttgagtgagattcttaatcctgagttctagtttgattgcactgtggtctgagagatagtttgttataatttctgttcttttacatttgctgaggagagcttcacttccaagtatgtggtcaattttggaataggtgtggtgtggtgctgaaaaaaatgtatattctgttgatttggggtggagagttctgtagatgtctattaggtctgcttggtgcagagctgagtttaattcctgggtatccttgttgactttctgtctcattgatttgtctaatgttgacagtggggtgttaaagtctcccattattaatgtgtgggagtctaagtctctttgtaggtcactcaggacttgctttatgaatctgggtgctcctgtattgggtgcatatgtatttaggatagttagctcttcttgttgaattgatccctttaccattatgtaatgggcttctttgtctcttttgatctttgttggtttaaagtctgtttcatcagagactaggattgcaacccctgcctttttttgttttccatttgcttgttagatgttcctccatccttttattttgagcctatgtgtgtctctgcacgtgagatgggtttcctgaatacagcacacttatgggtcttgactctttatccaatttgccagtctgtgtcttttaattggagcatttagtccatttaatttaaagttaatattgttatttgtgaatttgatcctgtcattatgatgctagctggttattttgctcgttagttgatgcagtttcttcctagtcttgatggtctttacattttggcatgtttttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgatagatctgctgttagtctgatgggcttccctttttgggtaacccgacctttctctctggctgctcttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcgcttctcgcttcatttcattcatttcatcttccatcgctgataccctttcttccagttgatcgcatcggctcctgaggcttctgcattcttcacgtagttctcgagccttggttttcagctccgtcagctcctttaagcacttctctgtattggttattctagttatacattcttctaaatttttttcaaagttttcaacttctttgcctttggtttgaatatcctcccgtagcgcagagtaatttgatcgtctgaagccttcttctctcagctcttcaaagtcattctgcatccagctttgttccattgctggtgaggaactgcgttcctttggaggaggagaggtgctcttctttttagagtttccagtttttctgttctgttttttccccatctttgtggttttatctacttttggtctttgatgatggtgatgtacagttgggtttttggtgtggatgtcctttctgtttgttagttttccttctaacagacaggaccctcagctgcaggtctgttggaataccctgccgtgtgaggtgtcattgtgcccctgctggggggtgcctcccagttaggctgctcgggggtcaggggtcagggacccacttgaggaggcagtctgcccattctcagatctccagctgcgtgctgggagaaccactgctctcttcaaagctgtcagacagggtcacttaagtctgcaaaggttactgctgtctttttgtttgtctgtgccctgcccccagaggtggagcctacagaggcaggcaggtctccttgagctgtggtgggctccacccagttggagcttcctggctgctttgtttacctaagcaagcctgggcaatggcgggcgcccctccccagcctcactgccgccttgcagtttgatctcagactgctgtgctagcaatcagcgagactccgtgggtgtaggaccctcggagccaggtgccggatataatctcgtggtgcgccgttttttaagcccgtcggaaaagcgcagtattcgggtgggagtgactcgattttccaggtgccgtccatcacccctttctttgactgggaaagggaactccctgaccccttgcgtttcccaagtgaggcaatgcctggccctgcttcggctcgtgcacggtgcatgcacccactgtcctgcgcccactgtctggcactccctagtgagatgaacccggtacctcagatggaaatgcagaaatcacccgtcttctgcgtcgctcacgctgggagctgtagaccggagctgttcctattccgccatcttggctcctccctccagaaa

SEQ ID NO: 12473 - DNA, 5847 bp, Homo sapiens
cttttttttaaattttattttattattattatactttaagttttagggtacatgtgcgcaacgtgcaggtttgttacatatatatacatgtgccatgttggtgtgctgcacccattaactcgtcatttagcattaggtatatctcctaatgctatccctcccccctccccccaccccacaacagtccctggtgtgtgatgttccccttccggtgtccatgtgttctcatcgttcaattcccacctatgagtgagaacatgtggtgtttggttttttgcccttgcgatagtttgctgagaatggtggtttccagcttcatccatgtccctacaaaggacatgaactcatcattttttatggctgcatagtattccatggtatacatgtgccacattttcttaatccagtctatccttgttggacatttgggttggttccaggtctttcccattgtgaatagtgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttaaaccagattacagtcccaccaacagtgtaaaagtgttcctatttctccacatcctctccagcgcctgttctttcctgactttttaatgattgccattctaactggtgtgagatggtatctcattgtggttttgatttgcatttctttgatggccagtgatgatgagcattttttcatgtgttttttggatgcataaatgtcttcttttgagaagtgtctgttcatatccattgcccactttttgatggggttgtttgtttttttcttgtaaatttgtttgagttcattggtgattctggatattagccctttgtcagatgagtaggttgcaaaaattttctcccactctgtaggttgcctgttcactctgatggtagtttcttttgctgtgcagaagctctttactttaattagatcccatttgtcaattttggcttttgttgccattgcttttggtgttttagacatgaagtccttgcccatgcctatgtcctgaatggtatttcctaggttttcttctagggcttttatggttttaggtctaacatttaagtctttaatccatcttgaattaattttcgtataaggtgtaaggaagggatccagtttcagctttctacctatggctagccagtttccccagcaccatttattaaatagggaatcctttccccattgcttgtttttgtctggtttgtcaaagatcagatagttgtagatatgcggcattatttctgaggcctctgttctgttccattgatctatatctctgttttggtaccagtaccatgctgttttggttactgtagccttgtagtatagtctgaagtcaggtaacgtgatgcctccagctttgttcttttggcttaggattgacttggcgatgcgggctctttttttggttccacatgaactttaaagtagttttttccaattctgtgaagaaagtcattggtagcttgatggggatgacattgaatctataaattaccttgagcagtatggccattttcacgatattgattcttcctacccatgagcatggaatgttcttccatttgtttgtatcctcttttatttcactgagcagtggtttgtagttctccttgaagaggtccttcacatcccttgtaagctgtattcctaggtattttattctttttgaagcatttgtgaatgggagttcactcacgatttggctgtctgtttgtctgttattggtgaataggaatgcttgtgatttttgcagattgattttttattctgagactttgctgaagttgcttatcagcttaaggagatttggggctgagacaatggggttttctagatatacaatcatgtcatctgcaaacaggaccaatttgacttcctcttttcctaattgaatgccctttatttccttctcctacctgatttccctggccagaacttccaacactatgttggataggagtggtgagagatggcatccctgtcttgtgccagttttcaaaaggaatgcttccagttgttgtccattcggtatgatattggctgtgggtttgtcatagatagctcttattattttgagatacgtcccatcaatacctaatttattgagagtttttagcatgaagggattttgaattttgtcaaagacattttctgcatctattgagataatcatgtggtttttgtcattggttctgtttatacgctggattacatttattgatttgcgtatgttgaaccagccttgcatcccagggatgaagcccacttgatcatggtggataagctttttgatgtgctgctggttttggtttgccagtattttattgaggatttttgcattgacgttcatcagggatattggtctaaaattctcttttttggttgtctctgcccggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctgttaattattgcctcaatttcagagcctgttattggtttattcagggattcaacttcttcctggtttagccttgggagggtgtatgtgtcaaggaattcatccatttcttctagattttctagtttatttgcatagaggtgtttatagtattctctgatggtagtttgtatttctgtgggattggtggtgacatcccctttgtcattttttattgggtctctttgattcttctctcttttcttctttattagtcctgctagcagtctatcaattttgttgatcttttcaaaaaaccagctcctgcattcattgattttttgaagggttttttgtgtctctatttccttcagttttgctctgatcttagttatttcttgctttctgctagcttttgaatatgtttgctctttcttctctagttcttttaattgcgatgttagggtgtcaattttggatctttcctgctttctcttgtgggcatttagtgctataaatttccctctacatactgctttgaatgtgtcccagagattctggtatgttgtgtctttgttcttgttggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagtgctttacttccaactatgtggtcaattttggaataggtgtggtgtggtgctgaaaagaatgtatattctgttggtttggggtggagagttctgtagatgtctattaggtcctcttggtgcagagctgagttcaattcctggataaccttgttaactttctctctcgttgatctgtctaatgttgacagtggggtgttaaagtctcccattattattgtgtgggagtctaagtctctttgtaggtcactcaggacttgctttatgaatctgggtgctcctttattgggtgcatatatatttaggatagttagttcttcttgtcaaattgatccctttaccattatgtaatggccttctttgtctcttttgatctttgttggtttaaaatctgttttatccgagactaggattgcaacccctgctttttttttgttttccatttgcttggtagatcttcctccatccctttattttgagcctatgtgtgtctctgcacgtgagatgggtttcctgaatacagcacactgatgggtcttgactctttatccaatttgccagtctgtgccttgtacttggagcatttagcccatttacatttaaggttaatattgttatgtgtgaatttgatccgtcattatgatgttagctggttattttgcttgttagttgatgcgttttcttcctagcctcgatggtctttaccatttggcatgtttttgcagtggctggtaccaattgttcctttccatgtttagtgcttcctttaggagctcttttcgggcaggcctggtggtgacaaaatctctcagcatttgcttgtctgtaaagtattttatttttccttcacttatgaagcttagtttggctggatatgaaattctgagttgaaaattcttttctttaagagtgttgaatattggcccccaatctcttccggcttgtagagtttctgctgagagatcagctgttagtctgatgggcttccctttgtgggtaacctgacctttctctctggctgcccttaacattttgtccttcatttcaactttggtgaatctgacaattatgtgtcttggagttgctcttctcgaggagtatctttgtggcgttatctgtatttcctgaatgtgaatgttggcctgccttgctagattggggaagttctcctggataatatcctgcagtgtgttttccaatttggttgcattctccccgtcactttcaggtacaccaatcagacgtagattttgtcttttcacatagtcccatatttcttggaggctttgtttgtttctttttattcttttttgtctaaacttctcttcatgcttcatttcattcatttagtcttccatcgctgataccctttcttccagttgattgcattggttactgaggcttgtgcattcgtcacgtagttctcatgccatggttttcagctccatcaggtcctttaaggacttctctgcattggttattctagttatccattcgtctaattttttttcaaagttttaacttctttgccattggttcaaacttcctcctttagctcggagtagtttgatcttctgaagccttcgtctctcatctcgtcaaagtcattctccatccagctttgttccgttgctggtgaggagctgcgttcctttggaggaggagaggcgctctgatttttagagcttccggtttttctgctctgttttcgccccatctttgtggttttatctacctttggtctttgatgatggtgatgtacagatgggtttttggtgtggatgtcctttctgtttgttagttttccttctaaccatcaggaccctaagctgcaggtctgttggagtttgctggaggtccactccagaccctgtttgcctgggtatcagcagtggtggctgcagaacagcggatattggtgaaccgcaaatgctgctgcctgatcgttcctctggaagttttgtctcagaggagtacccggccatgtgaggtgtcattctgcccctacctggggggtgcctccaagttaggctactcaggggtcacggacccacttgaggaggcagtctgcccattctcagatcccaagctgtgtgctgggagaaccactactctcttcgaagctgtcagacagggacatttaagtctgcagaggttactgctgtctttttgtttgtctgtgccctgtccccagaggtggagcctacagagacaggcaggcttccttgagctgtggtgggctccacccagttcgagcttcccggctgctttgtttacctaagcaagcctgggcaatggcaggcgcccctcccccagcttcgctgccaccttgcagtttgatctcagactgctgtgctagcaatgagtgaggctctgtgggtgtaggaccctccgagccaggtgtgggatataatctcctggtgtgc

SEQ ID NO: 12474 - DNA, 29713 bp, Homo sapiens
ttcatctcttttttttattattatactttaagttttagggtacatgtgcacaacgtgcaggttagttacatatgtatacatgtgccatgttggtgtgctgcaccaattaactcgtcatttaacattaggtatatctcctaatggtatccctcccccctccccccacccaacaacaggccctggggtgtgatgttccccttcctgtgtccatgtgttctcattgttcaactcccacctatgagtgagaacatgcggtgtttggttttttgtccttgtgatagtttgctgagaatgatggtttccagcttcacccatgtccctacaaaggacatgaactcatccttttttatggatgcatagtattccatggtgtatatgtgccacattttcttttatttatttatttatttattttattttttatttatttatttttttattatactttaagttttagggtacatgtgcacaatgtgcaggattgttacatatgtatacatgtgccatgttggtgtcctgcacccattaactcatcatttagcattaggtatgtctcctaatgctatccctcccccctccccccacctcacaacagtccctggggtgtgatgttccccttccagtgtccatgtgttcttattgttcaattcccacctaggagggaaaacatgtggtgtttggttttttgtccttgcgatagtttgctgagaatgatggtttccagcttcatccatgtccctaccaaggacatgaactcatcattttttatggctgcatagtattccatggtgtatatgtgccacattttcttaatccagtctatcattgttggatatttgggttggtgccaagtctttgctattgtgaatagtgctgcaataaacatacatgtgcatgtctctttataacagtatgatttataatcctttgggtgtatacccagtaataggatggctgggtcaaatggtatttctagttctagaacactgaggtaatcaccacactgacttccacaatggttgaactagtttccagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcacccactttttgatggggttgtttgtttttttcttgtaaatttgtttgagttcattgcagattctggatattagccctttgtcagatgagtaggttgcaaaaattttctcccattctgtaggttgcctgtccactctgatggtagtttcttttgctgtgcagaagctcttgagtttaattagatcccatttgtcaattttggcttttgttgccattgcttttgctgttttagacatttagtccttgcccatgcctatgtcctgaacagtattgcctaggttttcttctagggtttttatggttttaggtttaacatttaagtctttcatccatcttgaattaatttttgtataaggtgtaaggaagggatccagtttcagctttctacatatggctagccagttttcccagcaccatttattaaatagggactcctttccctattgcttgtttttgtcaggtttctcaaagatcagatagttgtagatatgtggcaatatttctgagggctctattctgttccattggtctatatctctgttttggtaccagtaccatgctgttttggttactgtagccttgtagtatagtttgaagtcaggtagtgtgatgcctccagctttgttcttttggcttaggattgacttggccatgcaggctcttttttggttccatatgaactttaaagtagttttttccaatcctgtgaagaaagtcattggtagcttgatggggatggcattgaatctataaattaccttgggcagtatggccattttcaatatattgattctttctacccatgagcacggaatgttcttccatttgtttgtatcctcttttatttcattgagcagtggtttgtagttctccttgaagaggtccttcacatcccttgtaagttggattcctaggtattttattccctttgaagcaattgtgaatggcagttcactcatgatatggctctctgtttgtctgttattggtgtgtaagaatgcttgtgatttttgtacattgattttgtatcctgagactttgctgaagttgcttatcagcttaaggagattttgagctgagacaatggggttttctagatatacaatcatgtcgtctgcaaacagggacaatttgacttcctcttttcctaattgaatgccctttatttccttctcctgcctgattgccctggccagaacttccaacactatgttgaataggagtggtgagagagggcatccctgccttgtgccagttttcaaagggaatgcttccagtttttgcccattcagtatgatgttggctgtggttgtgtcatagatagctcttattattttgagatatgtcccatcaatacctaatttactgagagttttttagcatgaagggctgttgagttttgtcaaaggtctttactgcatctattgagataatcatgtggtttttgtctttcattctgtttatatgctggattacgtttattcattttcatatgttgaaccagccttgcatcccagggataaagcccacttgatcatggtggataagctttttgatgtgctgctggatttggtttgccagtattttattgaggatttttgcatcaatgttcaccagggatatttgtctaaaattctctttttttgttgtgtctctgcctggctgtggtatcaggatgatgctggcctcataaaatgagttaaggaggattccctctttttctgttgattggaatagtttcagaaggaatggtaccagctcctccttgtacctctagtagaattcggctgtgaatccatccggtcctggactttttttggttggtaagctattaattattgcctcaatttcagagcctgttattggtctattcggagattcaacttcttcctggtttagtcttgggagggtgtatgtgtccaggaatttatccatttcttctagattttctagcttatttgcatagaggtgtttatagtattctctaatggtagtttgtatttctgtgggctcggtggtgatatcccctttgtcatttgttattgcctctgttagattcttctgtcttttattctttattagtcttgctagcggtctatcaattttgttgatcttttcaaaaaaccagctcctggattcattgattttttgaagggttttttgtttctctatttccttcagttatgctctgatcttagttatttcttgccttctgctagcttttgaatgtgtttgctcttgcttttctagttcttttaattatgatgttagggtgtcaattttggatctttcctgctttctcttgtgggcatttagtgctataaattttcctctacacactgctttgaatgtgtcccagagattctggtatgttgtgtctttgttcttgttgttttcaaagaacatctttacttctgccttcatttcattatgtacccagcagtcattcaggagcaggttgttcagtttccatgtagttgagcagttttgactgagtttcttaatcctgagttgtagtttgattgcactgtggtctgagagacagtttgttataatttctgttcttttacatttgctgaggagtgctttacttccaactatgtggtcaattttggaataggtgtggtgtggtgctgaaaaaaatgtatattctgttgatttgaggtggagagttctgtagatgtctattaggtccgcttggtgcagagctgaattcaattcctggatatccttgttaactttctgtctcgttgatctgtctaatgttgacagtggggtgttaaagtctcccattattattgtgtgggagtctaagtctctttgttggtcactcaggacttgctttatgaatctgggtgctcctgtattgggtgcatatatatttaggatagttagttcttcttgttgaattgatccctttacccttatgtaatggctttctttgtatcttttgatctttgttagtttaaagtctgttttatcagagactaggattgcaacccctgcctttttcttgttttccatttgcttggtagatcttcctccatccctttattttgagccaatgtgtgtctctgcacttgagatgggtttcctgaatacagcacaatgatgggtcttgactctttatccaatttgccagtctgtgtcttttaattggagcatttagcccatttacatttaaggttcatattgttatgtgtgaatttgatcctgtcattatgatgttagctggttattttgctcgttagttgatgcagtttctttctagccttgatggtctttacaatttggcatgtttttgcattgggtggtaccggttgttcctttccatggttagtgcttccttcagtagttcttttagggcaggcctggtggtgacaagacttctcagcatttgttttctgtaaaggattttatttctccttcacttatgaagcttagtttggctggatatgaaattctgggttgaaaattcttttctttaagaatgttgaatattggcccccactctcttctggcttgtagagtttctgctgagagatctgctgttagtctgacgggctttcctttgtgggtaacccgacctttctctctggctgcctttaacattttttccttcacttcaactttggtgaatctgacaattatgtgtctttgagttgctcttctcaaggagtatctttgtgatgttctctgtatttcctgaatttgaatgttggcctgtcttgctagattggggaagttctcctggataatatcctgcaaaatgttttccaacttggttccattctccgtttcactttcaggtacaccaatcagacgtacatttggtcttttcacatagtcccatatttcttggaggctttgttcatttgtgttttttcttttttctaaacgtcttttctcacttcatttcattcatttcatcttccatcgctgataccctttcttccagttgattgcattggctactgaggcttttgcatttgtgacgtagttctcgtgctgtggtcttcagctccattaggtatttttaggacttctctgcattggttattctagttagccattcatctaattttttttcaaggtttttaacttctttgccattgattagaacttcctccttttgctcggagtagtttgatcttctgaagccttcttctctcaactcgtcaaagtcattctctgtccagctttgtcccattgctggtgaggagctgtgttcctttggaggaggagaggtgctcttatttctagagtttccggtttttctgctgtgttttttccccatctttgtggtttcctctacctttagtctttgatgatggtgatgtacagatgggtttttggtattgatgccctttctgtttgttagttttccttctaacagtcaggaccctcagctgcaggtctgttggggtttgctggaggtccactccagactctacttgcctgcgtatcagcagtggtggctgcagaacagcggatattggtgaactgcaaatgctgctgcctgcttgctcctctggaagttttgtcgcagaggagtacccggccgtgtgaggtgtcagtctgccctacttcagtgtgcctcccagttaggctactcggggatcaggggcccacttgaggaggcagtctttccattctcagatctcaagctgtgtgctgggagaaccactactttcttcaaagctgtcagacagggatatttaagtctgcagaggttactgctgtctttttgtttgtctgtgccctgcccccacaggtggagcctacagaggcaggcaggcaggcctccttgagctgtggtgggctccacccagttcgagcttcccggctgctttgtttacctactcaagccttggcaatggcaggcgactctcccccagccttgctgctgccttgcagtttgatctcagactgctgtgctagcaatgagcgaggctccatgggcgtaggaccctcggagccatgtgtgggatataatctcctggtgggccatttgttaaacccattggaaatgcacagtattagggtgggagtgacctgattttccaggtgccgtctgtcacctctttctttgactaggaaaaggaattccctgaccccttgcacttcccgggtgaggtgttgctccgccctgctttggctaacgcatggtgtgctgcacccactgtcctgcacccactgtcctgcacccactgtccggcactccccagtgagaggaacctggtacttcagttggaaatgtagaaatcacccatcttctacatcgctcacactgggagctgtagactggagcagttcctatttggccatcttggctccaccccctgtgccacattttcttcatgcagtctatcattgttggacatttggcttggttccaagtctttgctattgtgaatagtgctgcaataaacatacatgtgcatgtgtctttatagcagcaagatttataatcctttgggtatatacccagtaatgggattgctgggtcaaatggtatttctagttctagatccctgaggaattgccacactgacttccacaatggttgaactagtttacagtcccatcaacagtgtaaaagtgttcctatttctccacatcctctccagcacctggtgtttcctaactttttaatgatcactgttctaactggtgtgagatggtatctcattttggttttgatttgcatttctctgatggccagtgatgatgagcattttttcatgtgtcttttggctgcataaatgtcttcttttgagaagtgtctattcatgtccttcacccactttttgatgggattgtttgtttttttcttgtaagtttgtttgagttcatcatagattctggatattagccatttgtcagatgagtagatcgcaaaaattttctcccattctgtaggttgcctgttcactctgatggtagtttcttttgctgtgcagaagctcttgagtttaattagctcccatttgtcaattttgtcttttgttgccattgcttttggtgttttagacatgaagtccttgcccatgcctatgtcctgaattttattgcctaggttttcttctagggtttttatggttttaggtctaacatgtaagtctttcatccatcttgaattaatttttgtataaggtataaggaaaggatccagtttcagctttctacatatggctagccagttttcccagcaccgtttattaaatagggaatcctttccccattgcttgtttttctcaggtttgtcaaagatcagatggttgtagatatgcagcattatttctgaaggctctgttctgttccattggtctatatctctgttttggtaccagtaccatgctgttttgattactgtagccttgtagtttagtttgaagtcaggtagcgtgatgtctccaactttgttcttttggcttaggattgacttggcaatgcgtgctcttttttggttctgtatgaattttaaagtagttttttccaattctgtgaagaaagtcattggtagcttgatggggatggcattgaatctataaaatactttgggtaatttggccattttcacgatattgattcttcctgcccatgagcatggaatgttcttccatttgtttgtatcctcttttatttcattgagcagtggtttgcagttctctttgaagaggtccttcacatcccttgtaagttggattcctaggtgttttattctctttgaagcaattgtgaatgggagttcactccgggtttgactgtctgtttgtgtgttattggcgtataagagtgcttgtgatttttgcacattgattttgtatcctgagactttgctgaagttgcttatcagcttaaggagattttgggctgagacgatggggttttctagatataaaatcatgtcatctgcaaacagggacaatttgacttcctcttttcctaattgaatgccctttatttccttctcctgcctgattgccctggcaaaaacttccaactctgtgttgaataggagtggtgagagagagcatccctgttttgtgcccgttttcaaagggaatgcttccagtttttgcccattcagtatgatattggctgtgggtttgtcatagatagctcttattattttgagatacatcccatcaatacctaatttagtgagagtttttaacatgaagggctgttgaattttgtcaaaggccctttctgcatctattgagataatcacatggtttttgtcattggttctgtttatatgctggattatgtttattgatatgcatatgttgaactagccttgctttgcagggttgaaacccacttgatcatggtggataagctttttgatgtgctgctggattcggtttgccagtattttattgaggatctttgcatcgacattcatcagatatattggtccaaaattttctttttttgttgtgtctctgccaggttttggtagtgggatgatgctggcctcataaaatgagttagtgaggattccttctttttctactgtttggaatactttcagaaggaatggtaccagctcctctttgtacctctcgtagaattcgactataaatttgtcttgtcctggactttttttgttggtaggctattaattgttgcctcaatttcagaactttttattggtcttgtcagggatttgactttttcctcgtttaatcttgggagggtgtatgtgttgaggaatttattcacttcttctagattttctagtttatttgcatagaggtgtttatagtattctctgatggtagtttgtatttctgtgggataagtggtgatatcccctttatcattttttattgcgcctatttgattcttctcttttcttctttattattcgaacccatggcaaagaagttaaaaaccttaaaaaaattagatgaatggctgacgagaataatcactgcagagaagtccttaaaggacctgatggagctgaaaaccaaggcacaagaactacatgacgaatgcacaagcctcagtagccgattccatcaactggaagaaagtgtatcagtgatggaagatcaaatgaatgaaatgaagtgagaagtttagagaaaaaggaataaaaagaaacaaacaaagcctccaagaaacatgggactacgtgaaaagaccaaatctacatttgattggtgtacctgaaagtgacagggagaatggaaccaagttggaaaacactctgcaggatattatccaggagaacttccccaatctagcaagacaggccaacattcaagttcaggaaatacagagaatgccaaaagatactcctcaagaagagaaactccaagacacataattgtcagattcaccaaagttgaaatgaaggaaaaaatgttaagggcagccagagagaaaggtcgggttatccacaaagggaagcccatcagactaacagctgatctcttggcagaaactctacaagccagaagagagtgggggccaacattccacattcttaaagaaaagaattttcaacccagaatttcatatccagccaaactaagcttcataagtgaaggagaaataaaatcctttacagacaagcaaatgctgagaggttttgtcaccaccaggcctgccctaaaaaactactgaaggaagcactaaccatggaaaggaacaaccagtaccagccactgcaaaaccatgccaaattgtaaagaccatcaaggctaggaagaaactgcatcaactaacgagcaaaataaccagctaacatcataatgacaggatcaaattcacacataacaatatgaaacttaaatgtaaatgggctaagtgtgccaattaaaagacacagacaggcaaattggataaagagtcaagacccatcagtgtgctgtattcaggaaacccatctcaagtgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggctattacataatggtaagggatcaattcacaagaagcactaactatcctaaatatatatgcacccaatacaggagcacccaatttcataaagcaagtccttagagacctccaaggagacttggactcccacacaataataatgggagactttaacaccccactgtcaacattggacagatcaacgagacagaaagttaaaaaggatatccaggaattgaactgagctctgcaccaagtggacctaatagacatctacagaactctccacctcaaatcaacagaatatacattcttctcagcaccacactgcacttattccaaaattgaccacatagttcaaagtaaagcactcctcagcaaatgtaaaagaacagaaattataacaaactgtctctcagaccacagtgcaatcaaactagaactcaggattaagaaactcactcaattgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcacgccactgcactccaacctgggagacacagcgagactccgtctcaaaaaaaaaaaaaaaaaaaaaaaaaaaaaaaaagaaactcactcaaaactgctcacctacatggaaactgaacaacctgctcctgagtgattactgggtacataatgaaatgaaggcagaaataaagatgatctttgaaaccaatgggagcaaagacacaacataccagaatctctgggacacatttaaagcagtgtgtagagggaaatttatagtactaaatgcccacaaggaaagcaggaaggatctaaaattgacagcctaacatcacaattaaaagaactagaaaagcaagagcaaacacattcaaaagctagcagaaggcaagaaataactaagatcggagcagaactgaaggagatagagacacaaaaaacccttcaaaaaatcaatgaatccaggagttggttttttgaaaagatcaacaaaattgatagaccgctagcaagtctcttcatcttttgtttgttccctttttgtgtagaagctttctagtttgacataatcccatttgtctattttcacttttgttgtctgtgctttgtggtcatatctaaaacatcattgcccagaccaatgtcatgaagctttttctttgtattttctagtagttttataatttcaggtctaacatttaagtcattaatcaattttgaattgcttgtgtatatagtgggagacaagggtctaattttattcttctgcaagtggatatccagttttcttaacactacttattgaagagaattctggtgattaaaaagtccaagagcatggttctggcatctgctcaacttctggtgagggtcccatactgcatcacaacatggtggagtagcagaaggggaagtgggcatgtgcaaaacgaaaccaaacatgagaggcaacctcattttataacaatcctcttatggcaaccaatctagtcactcaagtgtgaaaactcacttactccctggagactgtattaatccctacgagagggcagatccttcacatctcaaatgcctcttaaaggtcccactatctctcaacaccattatattgggacctagcctttacatgaattttggtggggacacaccatagtcaaaccatagcaccatataaaagcatggtttatttttgggctatctattctttccctttgtctacgtttctgtttctgtgccagtaacatgttgttttgattactatatctttgtagtagattttgagatcaagtggtgggatgcctctaactttgttcattttgttcaataattctttggatattttaggtcttttgtggttccatatgaattttagtgttgtttttcctatttgtattaaaactgtcattggaactttgatagggattgcattgaatctgtaggtcagtttggataatgtagacatttaaacaatattaattcttacaacccaagaacacaggctactgttttatttatttttcttcattttttaaatcaatgctgtaaagttttcaagtgtacaggtatttcactttcttgattaagtttataactaagtgttttaggtataaattattttttgatgctatcatacatgggatttttaaaaatttgtttttcagagagtttgttgttagtatatagaagtgctactgatttttgtatgttgattttgtatcctgcaactttactgaatttacttatttgttttaagattttttttgtgaatactttagagtattctgtatataagatcatgttgtctgccaccagggacaatttaacttcttcctttccaacttggataccttttatttcttactctagcctagttgctatgactaggacttctggtactatgttgaataggagtggtgagggtgggcatccttattttgttcctgattttagaggcaaagctctccacttttcactattgaatatgatcttagctgtggacttgtcatatgtgacctttattgtgttgcggtgcattctttccatacctaatttattgagagttttaatcatgaaaggatgttgaattttgtaaaatgctttttctgcatctattgagatgatcatatggtttttgtctttcattctattaatgtggtatatcacatttagtgatttgcatatgctgaaccatctttgcattcttaggataaatcccatttgatcatagtgaatgattttgttaatgtgctgttgaattttgtttctagtattttcttaagaatttttccatctatgttcatcagggatattagtctgtaattttttcgtggtgtccttgtctggttttggtatcagagtaatgctgactttgcaaaatgattttggaagtatgccctcctcttcaatttttttggaagtgggaagaattattctttacatgtttgttagaattcagctgtggagccatcggatcatgggctcttctttgattggagattttttattactgattcaattgccttattattggtgtattcagatattttatttcttcttgattctgtcttgatagattgtattcgtttaggaatttatcaatttcttttaaattttccagtgtactgtcatataattatttataatagtctcataatcctttgtatttctgtggtttcagttgtaatattgtctctttcatttctgattttatttatttaacttttctttctgttttccttagtctcaccaaaggtttgtcaattttgtttatctttttcaaaaaaccaacttttagttttgttgatcttttctattgttttcttagcctctatttcatttatttctgccctgatctttattatttcctttcttctactaattttggcttagtttgttcttctttttctagtttcttgagatataattttaggttgtttatttgggttctttcttctttttttatgtagacatttattgctataaacttccttcttagaattacttttgctgcattccatttgttttggtatgttgcatgtacattttcacttgtcaagatattttaaaatttcactttaatttccctttgacatattggttgttatggagtatgttgtttaatttccatatacctgtgcattttccacaattattatcattattgatttatagtttctagtttcatattgatttctgttgtggattgaaaagttactggatatggtttcaatattcttaaatttgttaagacttttttggcctaacttgtgatttatccgggaatgttctgtttgtccttgagaggaatgtgtgtctattattgttagatggaatgttctgtatatgtctgttaggtccattttgtctaatgtttagatcaagtccaatgtttccttattggttttctgtcttgataatatgtccattgtttaaagtgaggaattgaagtcctccagtattttcttctcatcttctttgtgatattgcccctactattatagtgttgcagtctatttttccctttatatctattaatatttgctttatatatttatgtgctctgatgttgggtgtatgtgtatttaaaattgttatggcttcttgatgaattgacccctctttatcattatataactaccttgtttgtccctttttacagttttttacttaaagtttattttatctgatgtaagtgtagctacccctgttgtcttttggtctccatttgcacagaatgactttttccatcccttcactttcagtcttgtctatttttgaagctgaagtgagtctgttggaggcacacttattgggctgttgtatttcttaaaaattttcagcctctgtatatcttttggttggagcacttaacccatttacatacatgataataattgacaggtaaggacttactattgccattttgttgttttctcattgttttgtatttcctttgttcctttcatcctctcttgcgttcttcttttgtgattagttgattttctcttctagtttgctttgattctttactttttatcttttgtgtatctactatagattttcgctttgtgattaccatgaagtttgcataaaacataattataacaggctattttaagctgataaaaacttcagttcaattgcatgtgaaagctctacacttttactccataccctcacaacttatatttttgatgccatgatttacatactttcacattgtgtgtctcttaacatattattgtgctattattatttttaacacttttgtcttttaaactttatgctagagttataagtaatttactcaccaccattataatattagactggtctaaattttactgtagttacttttactagtgagttttatattttcatatgttttcatgttgctaattagcatccattctttttagcttgaagaactccctttagcatttctagtaagacaagcttggtggtgatgaacttcctcagcttttgtttgtttgggaaagtataccttatgttttgaagaacaactttactgagtacagtatttattttattattatgattattttattttttgagacagtctcactctctcacccaggctggagtgcagtggtgctatctcggctcactgcaacctccacttcccaggttcaagcaattctcctgtttcagccccccgagtagctgggactacaagcgtgcaccaccattcccggctaatttttgtatttttagtagagacagggtttcaccatgttggccaggctggtgtcgaactcctgacctcaaataatcttaacctgcctcagtctcccaatgtgctgggattacaggcataagccaccacatctagcctgagtacagtattttttattggctgatttttttacttttgctttttttatttttatttttattttattttatttttttgtggcgatagggtcatagggagctatgttgacaaggctggtgtcagatttctggccttaagtgatcctccctccttcacctcccaaagtgctggcattacaggcatgaaccactgtgcctggccaattgacaggttttgtcttttttttctgacttcagcactttgaatatatcattccactctctcctggcctgtcagctttcttcagagaaatacactgatagtgcaactgaaattctcttatatgtgatatccttttctttagctgatttcacgatgctctgtctttgatttttggctgttcaagcatatgtctttgtgcagtcttatttggattgaatctgattgcagacttttgagctttctgtacctgaatatttgtatctttcccccaattgggaatttttccactattgtttattaaaacaaacttcctatccctccctttttctcttctccttctttttaatgtccataattttaaaattagttctattgatgctgccccataaatcccataggctttctttatttgttttcattttttatttttctctatgactgggtaatttcaaataacctgtctttgagttcacagattcttttttctgcttgatcagttttgctgttgatattctctattgtagtttttattttattcattgtattcttcaactgtagaatttctgtgtttttttaaaatctgagatgattaactgattaaatctttctgttaaatttttagttttaaaatttattgttttcctggtttcattgaatttttccccctatattttccttaagttgctatgcttccttaaaacaactattttcaattttttttttcaggcagcatatagatctccatttctttatgggcagccactgggaattattgtgttcttttggtggttatatgtctcctttattttttgtgtttcttgtcagcttacactgatttttgtgcttttggtggagcagtcacctcttctagacattatgggctagtttcactgtagaaagaccttctcctatggtggggtgtatgaagccacttgttgggtgaggtacagtagttctggtattagtgaagatgtacctccatgcagtctttgtgcaactctgtaagctgaggttagtgttgacaaagctcatatggcaatggctccagtgtctgaggcatggcaggtatagtgcagggtcttcactcatcaacctccggatgtttacagtagcagtgaggactgttgagaacttcagtgacaataagttctagggtcttcttgatctcttgctcctactgtgaggttgtggctgagtgagttactcactgacactggatgcagcctgtgggcttgctcctagtagtggaagcactggtatctgatgagtagtgcttgtagagtggccatggagcctaggtctgaagcacaggcacgtatggaagggactatagctctggggtcatggtggtagtgtcagtggtgcctagggtgcagatacccttggtgagttggtaatgttatgctatatgtaggtgcttgtaaagcagtcagggagctgggaactagagcatgggcatgcatagaactacagtgacttcagggtcagggtgaggtcttgctctctatggtggctgaggtggcatctggagtgaggcacagggagtccttagctctaggacctagggtgtgagctagtttgctatactcatggctctgatttgtgacttggggttgcatgcaacatagccttggagcctgggtccaatgtgcaggctcttaatggcaactgaactggtatctatagtgcagtcacacgcagagaaactttggatctggggcctggggtgtgaagtagctttttatggccatggctccaatgtccaaggtatggcaggtacagtgcagccacagagattgtgtctggagtgtgggtacttgcagagtggctatggctcagggattagggtcctgcatggggttgggagaggtggcagctccatccctagagtgccacactggcaactgcttcttgaggagcaggagtgtgcagctatttcttcctttctgggtttcccaatggaatggccattgattacctaattgaccaaagatgctggtgttctctgtggagcgggtcactggggaaccataatggttcctgctgtgtggctgatcccaatagcctctgtcttttatctttgttcctagccaactcctttcatttcgggtatgctgatctcacctgctatcctgtgtgtgtgtgtgtgcgtgtgtgtgtgtgtgtgtgtgtatatatattctctgttttattttgctccactgtgttcctgaagatacttaaatgggcccttgaatcctgtcaggtgtatttctgttcatgggtagctgtgtatatttgatgtttttttttcgtgtgtatgatggaatgaaaactggtatctcttacttcaccttcttggtgacatccttttttaaaaattttatttatttatttattttacaccatcattctgcatttctcttattttcctttttttacaccagacatcttaaatagtaattttttaagatttcaattgtttttaatatatttccatttttccttgttagcaaatcaaaatacaactgttttttgtagattgagtttgtatctagtgactatgcaaaacttatttatttgttttaggagttttaggggtttttctttagtagtgtcttttggattttatatgtagacaattacatcattggcaaatagtggcaattttattattccttttcatctttatgcgtttcatttccttttctttccttattgcgctagcaagtacaatgttaaataggagtgctgagaatgggcatccttgctttgttatttccttagaatatatttttgaaatttattttttgagttagggatttgtccaagtctatggaagaagtattctttcagcatcaagtatgatgttactctaatgggtgtttttttggtagttgatcttcatcaaattgaagtagttttcctctattcctatttgctgaaggggtttttttttttaaatcatgactggtcaaattttgaagaataatatttctatattatattagtctttgattgctgcataataaattaccacagtcttagcatcataaaacaacacctatttattagttagccattctgtaggtcagaagtctgccacattgcagctgggttctctgctcagaatcttacaagactgcaatcaaattgttagccagctcacttttcatctgaaagttctgggggaaagttcacttccaagctctttcttgttgctggcagatttcaattccttgtggtggtaggactgagatccctattttcttgctgtccggtggctcggggttgctctcagctcctagaggccactgacatcctttccatgtgcccttgtctatcttcaagcccgcaataaagtgtcaaatcctcttatgctttgaatctctgatttctttgaccagccagagaaaatgctctgcttttaaaggactcttgtgattagatcaggcccacttgaatactcttttattagtcaactgtgccatataacataacctaagcatgggagtaaaagccatcaaattcactatttcagggaatttaccaacttgtacacttgtgatggtggtgccagaaatctttggagacatcctctgcctaccacatacatctactgagatgagcatttttttttatcattagtctgttgatatggtgaataacattattgaatttcaaacgatgaatgactctcattctcagtataaaccccaactggtcatgatgcattatccttttttatattgttaaatttgatttgctcatattctgttgagaatttgagtctttgtttatgaagaatattagcctgttttattatgcttttataattcttatgtctagttttagtatcagggtagttctggccttataagataagttggaagtggagtttccatcttactgagctagaaaagacagggagggagcagtcttggttcaaattccacagacttgacttttcttaccaaattaaaaaatgtttcttgcagtttcttcttcatttactgtattcttttacaaccattttcagggctttaaatggttgttcttaatttttttcaccagtttcagtggggaatatgtcccatggagctcttcatgctgaagttgatcccctgtccattttttttcccatttttgaaagatctattttgctgagtatggaattctgggtagttttttctttcagcacattaaaaatatccctcaattgtcctctgacttgcagagtttctaatgagaaacgtgatgtaattctttttttcctctgtatgtaaaatgtacatattttctggctgccttaaagattgttctctgtttgatttttagcagtttgatatgtataggtgatttttgtttgttttattttattttagtatttattgttctttgtgttctctgacattattggatctgtggtttggtgtcttattaattttggaaaattttcaccaattgtctttcaaatattattttctgccttattctctcccttttggaattctaatgcacacaggcacacattgtttgatattgttttttgattcttggattttttccccccactcctttctttgtgtttaagttggttaatttctattaatttgtcttcaagttcactgattctttccctggctatattatgttttcaggtgagcttgccaaaagcattatttatctctgttagcatgtttttcattcctagcatttccacttggttctttctaatagctttatcttttctgctgaaatcccctgtggaatcatgcatattgttcacatttaccaatgaagcctttaatatatttattataactacctatatttcctattggataggtccaacatctgtgccatatctgagtctgctactgattcttgctttatctcttgccagtattttttttcttgcttctttgtatgactcatacatttctgttgaaagctagacatcttgtataggataatagaggttgatgtaaacattttttatgcctggaaatgagcatacttacttttcctctaggcctttagtcagtttagttaggacttaaactgggtttgggttttgctgttgttgtagttaccctcagagcaccacaggattctatttcctctagctttaccttgtgtttaatatggggctgatttgctacaggggtttttcaatgtctgctccactctcagatttaggtttgagaaagaaataaaagggcagttcctaatattcggaaactggcctgacactcacaggtagacgatattattctcttgttagatatccacgatatcacagaatgccacctcggataagtttattctgagaccaagataaaaatgagacaaagaaaggtcacttcataattttttttctaagcatagagataagcaagttccctttgccacctgcaaaatactgaacatctttgtcccttggccaaaataactggctgctacttctttattaattaaaactttatttccattctagtatctagataagatttgttgagatagtaaataataggattgcccttactttatgacaacatccaatctagaatgaacccacccttccttagaccctttccctaaatcagccaaccaaagcccaaatcctataattctaacatccaattgttgagacattccatgattccctatgatgtgtgttctccttccttgcaatgaaaaataaaccaaagattttcagctaccaatgtgtaattggctgggtggcattgacagaattagaggttcacaaagattcagctgagaccctcactgcattggactagaatgcttaattccatgacatttgagaccccttctttctttatgtgctcaatgtgccacctacttttgattagaagatacgtttatactaaattgagctctgctcaggccactgcactccagcctgggcaacagaatgagactccgtctcaaaaataaataaataaattgagctctggtattttgttggaggtcttcaatgttgtgtttattttgttttcttaaaagtaggcccccctttgggattttggttttctgattagatttgtgttgttctttgatgacattgttctctagcatctacagcttgcttgccaaatgccttgtcttgtttgtctgcttgtctattgtcttgaatcttgtttttctacaagaagaaccatttttggggagataatgggaagagacctgataagtttatcctcaaactaggcttgggggatgagaagttcagatttctttttagactggtattttttggacaaactttgctataatcaacatttcaaaccttataaggacttttcccttattctttttttttgtctttgtgaactgcttttgtttgagtttcatctgcatgaaatcagaaggtttgtctcatccctgatgagtaatgatctttgactaagatctagatatacaaggacacgtgaccaccattcttacaggcatattgaggttctcataggatcttttcaatctaaaactgtatctcctccagaatggacagtttcctttattttttcttggtacaacacgaactcctgtgtacacctaactggcacaatttcagtttgaaattacagtggatgcttgggaaccttttgatatagacaaacttgttcatttgagaggtgcctttgaacaaaagagaattgaaatgctgactgtccaatggtttgctttctttcattggtatgaagagggatttgaataaaatttgcactaaaaattgcctttctaaaagatcatctagctaaaactaatgcaaaatataagcaacctaagaccatttgccttgtggatcaactaaaatcccatttcaattcttcctatctgtgtcccattctccctctacctcctttgccttcaccatcagaaccttatttaactttcatggagttcttccttttgtctccttctctttctaaataagttgcactacctcttcctcaaaatcccttaaaattgcaacctcaacagaagaaagatcccggcagtgagcgggacacagattttaagcctgggtcacactcactgcaatagttacatacatccctaattccaaaataaaaagagaaaattcaataaagtattcaaacttattatgggcacatacaacacgggcctcatggacctctaccaacaaattcaccttttggtggggccaggaaatacaaaaccttagttagaaaaggccaattggaaagacctagaaagtgacttcaaaaacaatcaggacaccttaagcacagcaaataggccataaccttttgaaaactataccataactctttcccactaaaataaaccagaccttgacagaatagatccataagatactcaaagacagactaataagcattcttaaaaaaattttcagggttcacccccaatgttgacatttctaatactctttccactttctttgataaattaaagccagaaattgcagatatggtacataaaaaaaattgcctggcaaaccatgtcactaattgaacttcagcatttggctaaacatttttaaatggctttaaatatcaaatgagaaagtaaaaccccaaactaaccttatacaattataagtaaagcatttaaatagatatttctcatccacaagggacaataaatattttccctttaacaaagacacttgctgatactataaataaatgggacactggaaaaaataactgtcccatcttaactaaaaagaaaaatgaactaccaaccctcttttttctaaagaattattatatgaagctgctctgcgggggattcccttaaatcacaaggagaactatctttaataatagaaaaacaaaaacaaacttttttggtagatatgggcactactctgttgactataaatcccattacaattgcaactcattttccttggagtcataaaactattctggtgacaggaatttcaaacaatcctcaaactattcccaatacctcaacctgtgactgtaactctcagcctcctcattagtcaacatgtatttcttctccctgacaccaattattgaaagagatcttttatgtaaatgtattgccaaatcaaatgctcctcaggtgaactacttctcaaaatacctcattattcttccatgcatgattctttaatggtgcagttagatatcaagttgactatccttataagcttgaccaaatctgggtttgaggatttatgtgaggttccttattctccagcagttctacagatgtgagaagaattctagggattaaacttctaatgtagaaaaggacttcttgaaattcttccctaaagttgtttgataccttctaaacctaaaactaaagaaggattgagccccttttgtggaaggttttatgaaatgatgactagttacttctcacactagtccaggtaatattccaatgttgcctgttaaaaagactcatgggagtggatattgatttgtgtaagaccttaagtctaaaaataagattgtgattctttgtttcccagtggtcagtcccaaatctaaatattttgtcctaaatactgcaagaagccacctacttcattgtagcaaagttatgttctgcctttttagcatcccactggattcagatagtttatatttatttgacttcttatgagaaaaccaatgatatagctggactgttatgctccagggatttactgacaccttcccttatttatctgaaattcctgactgggactttaaggatttgagatttacttatgattctctccttatacaatgatcttttactgtgttccaatgatgatattgtactatgcttaaaaaacaggaaaagctttaagattgattctgtgtatttattaaatctctacaatacttcccaatgctggggttgcagagatagtataaacctttttttctttttcttcatgaagggtccggacataattgagtcataattgagtatggacccaattatatgggaatcatgtataaaatatatttcaatgatagtatgcttttcaggctaaaagaagcatgtacaagtttatgtgcaaagactggcagaatattaaagattgctttttaagattctagattcaattctgtgaagaaagtcatggtagcttgatggggatggcattgaatctataaattaccttgggcagtatggccattttcacgatattgattcttcctacccatgagcatggaatgttcttccatttgtttgtagcctcttttatttcattgagcagtggtttgtagttctccttgaagaggtccttcacatcccttgtaagttggattcctaggtattttattctctttgaagcaattgtgaatgggagttcacccatgatttggctctctgtctgttattggtgtataagaatgcttgtgatttttgcacattgattttgtatcctgagactttgctgaagttgcttatcagcttaaggagattttgggctgagacgatggggttttctagatataaaatcatgtcatctgcaaacagggataatttgacttcctcttttcctaattgaatgccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggctgctgaattttgtcaaaggccttttctgcatctattgagataatcatgtggtttttgtctttggttctgtttatatgctggatgacatttattgatttgcgtatattgaaccagccttgcatcccaggaaagaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggtttccctttttttctattgattggaatagtttcagaaggaatggtaccagttcctccttgtacctctggtagaattcggctgtgaatccatctggtcctggactctttttggttggtaagctattgattattgccacaatttcagagcctgttattgttctattcagagagtcaacttcttcctgatttagtcttgggagggtgtatgtgtcgagggatttatccatttcttctagattttctagtttatttgcatagaggtgtttgtagtattctctgagggtagtttgtatttctgtgggatcggtggtgatatcccctttatcattttttattacatctatttaattcttctctcttttcttctttattagtcttgccagcagtctatcaattttgttgatcctttcaaaaaaccagctcctggattaattaattttttgaagggttttttgtgtctctatttccttcagttctgctctgattttagttatttcttgccttctgctagcttttgaatgtgtttgctcttgcttctctagttcttttaattgtgatgttagggtgtgaatttttggtctttcctcctttctcttgtgggcatttagtgctataaatttccctctacacactgctttgaatgtgtcccagagattctagtatgttgtgtctttgttctcgttgttttcaaagaacatctttatttctgccttcatttcgttatgtacccagtagtcattcaggagcaggttgctcagtttccatgtagttgagtggttttgagtgagtttcttaatctcgagttctagtttgattgcactgtggtctgagagacagtttgttataatttctgttcttttacatttgctgaggagtgctttacttccaactatgtggtcaattttggaataggtgtggtgtggtgctgaaagaaatgtatattctgttgatttggggtggagagttctgtagatgtctattaggtctgcttggtgaagagctgagttcaattcctgggtatccttgttcactttctgtctcattgatctgtctaatgttgacactggggtgttaaagtctcccattattattgtgtgggagtctaagtctctttgttggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtgtgttttatcggagactgggattgcaacccctgcctttttttgttttccatttgcttggtagatcttcctccatccttttattttgagcctatgtgtgtctctgcaggtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattatgcttgttagttgatgcagtttcttcctagccttgatggtctttaccatttggcatgattttgcagtggctggtaccagttgttcctttccatgtttagtgcttccttcaggagctcttttagggcaggcctggtggtgacaaaatctctcagcatttgcttgtctgtaaaggatgttatttctctttcacttatgaagcttagtttggctggatatgaaattctgagttgaaaattcttttctttaagaatgttgaatattggcccccactctcttctggcttgtagagtgtctgctgagagatccgctgttcatctgatgggcttcccttcatgggtaacccaacctttctctctggctgcccttaacatcttttccttcatttcaactttggtgaatctgacaattatgtttcttggagttgctcttctcgaggagtatctttgtggcattctctgtatttcctgaatctgaatgttgccctgccttgctagattggggaagttctcctggataatatcctgcagagtgttttccaacttggttccattctccccgtcactttcaggtacaccagtcagacgtagatttggtcttttcacatagtcccatatttcttggaggctttgttcatttctttttattcttttttctctaaacttcccttctcacttcatttcattcatttcatcttccatcactgatacccttcttccagtcgatcgcatcagctcctgaggcttctgcattcttcacgtagttctcgagccttggctttcagctccatcagctcctttaaggacttctctgtattggttattttagttatacattcgtctaaatttttttcaaagttttcaacttccttgcctttggtttgaatttcctcctgtagcttgaagtagtttgatcgtctgaagccttcttctctcaactcgtcaaagtcattctctgtccggctttgttccgttgctggtgaggagctgcattcctttggaggaggagaggcactctgctttttagagtttccggtttttctgctctgttttttccacatctttgtggttttctctacctttggtctttgatgatggtgacatacagatggttttctggtgtggatgtcctttctgtttgttagttttccttctaacagacaggaccctcagctgcaggtctgttggagtttgctagaggtccactccagactctgtttccctgggtaccagcagcagtggctgcagaacagcggattttcgtgaacggaatgctgctgtctgatcgttcctctggaagttttgtctcagaggagtaccccggccatgtgaggtgtcagtctggcctctactggggggtgcctcccagttaggctgctcgggggtcaggggtcagggacccacttgaggaggcagtctgcccattctcagatctccagctgcgtgctgggagaaccactgctctcttcaaagctgtcagacagggacatttaagtctgcagagtttactgctgtctttttgtttgtctgtgccctgcccccagaggtggagcctacagaggcaggcaggcctccttgagctgtggtgggctccacccagttcgagcttccaggctcctttgtttacctaagcaagcctgggcaaaggtggactcccctcccccagccttgctgctgccttgcagtttgatctcagactgctgtgctagcaatcagcaagactccgtgggcgtaggaccctccaagccatgtgcgggatataatctcccggtgtgccgttttttaagctcattggaaaagtgcagtattggggtgggagtgatctgattttccaggtgccgtctgtcacccctttctttgactaggaaagggaactccctgagcccttgcacttcccgagtgaggcagtgcctcgctcttcttcggctcatgcacggtgcactgcacccactgtcctgcacccactgtctggcactccctagtgagatgaacccagtacctcagatggaaatgcagaaatcacccatcttctgtttcactcacgctgggagctgtagaccagagctgttcctatttggccatcttggctcggtcc

SEQ ID NO: 12475 - DNA, 6651 bp, Homo sapiens
tttgtttttattattattattattattatttttaattattatactttaagttttagggtacatgtgcacattgtgcaggttagttacatacgtatacatgtgccatgctggtgtgctgcacccactaactcgtcatttagcattaggtatatctcccaatgctatccctcccccctcccccccccacaacagtccccagagtgtgatgttccccttcctgtgtccatgttatctcactgttcagttcccacctatgagtgagaatatgcggtgtttggttttttgttcttgcgatagtttactgagaatgatgatttccaatttcatccatgtccctacaaaggacacgaactcatcattttttgtggctgcatagtattccatggtgtatatgtgccacattttcttaatccagtctatcattgtaggacatttgggttggttccaagtctttgccattctgaataatgccacaataaacatacatgtgcatgtgtctttatagcagcatgatttatagccctttgggtatatacccagtaatgggatggctgggtcaaatggtatttctagttctagatccctgagcaatcgccacactgacttccacaatggttgaactagtttacagtcccaccaacagtgtaaaagtgttcctatttctccacatcctctccagcacctgttgtttcctgactttttaatgattgccattctaactggtgtcagatggtatctcattgtggttttgatttgcatttctctgatggccagtgatggtgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgtctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctacggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatgtgcggcattatttctgagggctctgttctgttccattgatctatatctctgttttggtaccagtaccatgctgttttggttcctgtagccttgtagtatagtttgaactcaggtagtgtgatgcctccagctttgttcttttggcttaggattatcttggcaatgcgggctcttttttggttccatatgaactttaaagtagttttttccaattctgtgaagaaaggcattggtagcttgatggggatggcattgaatctgtaaattaccttgggcagtatggccattttcacaatattgattcttcctacccatgagcatggaatgttcttccatttgtttgtatcctcttttatttcattgagcagcggtttgtagttctccttgaagaggtccttgacatcccttgtaagttggattcctaggtattttattctctttgaagcaattgtaaatgggagttcactcatgatttggctctctgtttgtctgttgttggtgtataggaatgcttgtgatttttgcacattgattttgtatcctgagactttgctgaagttgcttatcagcttaaggagattttgggctgagacaatggggttttctagatatacaatcatgtaatctgcaaacagggacaatttgacttcctcttttcctaattcaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagggtttttagcatgaagcgttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatatgctgctggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattgcaatagtttcagaaggaatggtaccagtttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatagtagtttgtatttctgtgggattggtggtgatatcccctttatcattttttattgcatctatttgattcttctctctctttttcttaattagtcttggtagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacgtctttatttctgccttcatttcattatgtacccagtagtcattcaggagcaggttgttcagtttccatgtagttgagtggttttgagtgagattcttaaacctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaattctcccattattaatgtgtgggagtctaagtctctttgtaggtcactcaggacttgctttatgaatctgggtgctcctgtattgggtgcatatatatttaggatagttagctcttcttgttgaattgatccctttaccattacgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatagtgttatgtgtgaatttgatcctgtcattatgatgttagctggttattttgctcgttagttgattcagtttcttcccagtctcgatggtctttacattttggcatgattttgcagcggctggtaccggttgttcctttccatgtttagcgcttccttcaggagctcttttagggcaggcctggtggtgacaaaagctctcagcatttgcttgtctgtaaagtattttatttctccttcacttatgaagcttagtttggctgggtatgaaattctgggttgaaaattcttttctttaagaatgttgaatattggcccccactctcttctggcctgtagagtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaaattctcctggataataccctgcagagtgttttccaacttggttccattctccccatcactttcaggtacaccaatcagacgtagatttggtcttttcacatagtcccatatttcttggaggctttgctcgtttctttttattcttttttctctaaactttccttctcgcttcatttcattcatttcatcttccattgctgataccctttcttccagttgatcgcatcggctcctgaggcttctgcattcttcacgtagttctcgagccttggttttcagctccgtcagctcctttaagcacttctctgtattggttattctagttatacattcttctaaattttcttcaaagttttcaacttctttgcctttggtttgaatgtcctcccgtagctcagagtaatttgattgtctgaagccttcttctctcagctcgtcaaagtcattctctgtccagctttgttcccttactggtgaggagcagcgttcctttggaggaggagagacgctctgatttttagagtttccagtttttctgttctgctttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagggtgcccctgctggagggtgcctcccagttaggctgctcggggttcagtgacccactttaggaggcagtctgcccgttctcagatctccagctgcgtactgggagaaccactgctctcttcaaagctgtcagacagggacatttaagtctgcagaggttactgctgtctttttgtttgtctgtaccctgcccccagaggtggagcctacagaggcaggcaggcctccttgagctgtggtgggctccacccagttcgagcttcccggctgctttgtttacctaagcaagcctgggcaatggtgggcgcccctaccccagcctcgctgccgccttgcagtttgatctcagactgctgtgctagcaatcagcgagactccgtggggtaggaccctccaagccaggtgcgggatataatctcgtggtgcgccgttttttaagcccgtcagaaaagtgcagtattcgggtgggagtgacctgattttccaggtgccgtccgtcacccctttctttgattaggaaagggaactccctgaccccttgcgcttcccgagtgaggcaatgcctcaccctgctttggctcgcgcacggtgcgtgcacccactgacctgcacccactgtctggcactccctagtgagatgaacccggtacctcagatggaaatgcagaaatcacccgtcttctgcgtcgctcaggctgggagctgtagaccggagctgttcctattcggccatcttggctcctccccctgttttaattattaatttgactcttttgtattgtgttcagggaatatgttcacattttgaaatttatggaaattttgttagtagtttggtaaatggtccatttttatagatattccactttttataaatactaagtactaatagatttcattaatagtgttcaaatcctttatatcttttttatttaataaatgatattaggttatttaagaaaatgtttatatgtgtgtatattttggagataaatgacatgtatggaatttggcttaaaatagcccagcaaatataaaagggagtgatggatagattaaacagatgaaccaaaatgtttgtgcttgttacagctgggttatagtagggtttgtattctctacttttgtgtagtctaaaattttataataataaaaagttttaaaactcctctctacccttatttgtttttagattgcttgatctgttgattcctgagaaaggtgtgttaaagttttccattatgttatattatttttctaatactgtttacttgatattttgaacccatgtaattcagtgcataaaattttactacagttaaatttccttttatcataataaaatctcttt

SEQ ID NO: 12476 - DNA, 8207 bp, Homo sapiens
tcttttttttattttatttttattatactttaagttttagggtacatgtgcacaatgtgcaggtttgttacatatgtatacatgtgccatgttggtgtgctgcacccattaactcgtcatttagcattaggtatatctcctaatgctatccctcccccctccccccaccccacaacagtccctggtgtgtgatgttccccttcctgtgtccatgtgttctctttgttcaattcccacctatgagtgagaacatgtggtgtttggtttttttgtccttgtgatagtttgctgagaatgatggtttccagcgtcatctatgtccctacaaaggacatgaactcatcattttttatggctgcatagtattccatggtgtatatgtgccacattttcttaatccagtctatcattgttggacatttgagttggttccaagtctttgctattgtgaatagtgccgcaataaacatacatgtgcatgtgtctttatagctgcatgatttataatcctttgtgtatatacccagaaatgggatggctgggtcaaatgatatttctagttctagatccctgaggaatcgccacactgacttccacaatggttgaactagtttacagtcccaccaacagtgcagaagtgttcctatttctccacatcctctccagcacctgttgtttcctgtctttttaatgatctccactctaactggtgtgagatggtatttcattgtggttttgatttgcatttctctgatggccagtgatgatgagcattttttcatgtgttttttggctgcataaatgtcttcttttgagaagtgtctgttcatatccttcgcccactttttgatggggttgtttgttttttttcttgtaaatttgtttgagttcattgtagattctggatattagccctttgtcagatgagtaagtatactcatttttatagacataccaagtgataacatatgaaatgagatgaaatgaacgttaactccgctgtggaaaaattgtcatttttaaagaggtgaccatcatgtaaacaacaaccactgccattattgccgctgctaatgcttagatttactaccagctaatatttatggagtaataattatatggcaggaactgtaatacattgtttaaatatagtttattatttaaccctctgagtccggtttgttactcctattttacagatgataaaattgagacttttaaaacttaagtatagtgcccacggtgacaaggttgaacagccaagattctgatatagaccatctgtctctaaaaccatgctcctaacactgccctatattgcctccctaaatatatatatatatataacatacatatatataatatatatataatatacatataattaattctaaaacttacatgtatatatgtaagttttagaattaattatatgtctaggctatactgcagtagccaattccttccagggaaaggggaaactatagaagagacaacactaccctcaagttgaacttgaaatatgagactctctctaggtaaacaaaaagacaagggcataagggcagaatatcagtatcaacactgtatgttattttctaagagcttgggaagcgtggctatctagctgaaggtaattcagatctgttggagggatagtatgggagggggaattttcataagagaaaagcctaggaagacaatcagaaggcacatcatagtcaagagatataaataattcacactcaagaaaatgggaagctgttgatgatggtgtgctatggagagtcctaatcagttttgtttttgaaataatacccaacctgcagaattaggtcactattatgacatgtttgtagagtgcatgatcattgtttaggaaactggatgaatgccagaaggatgccctgaaaaaatggatgggagtttaaatgttaccttcgtgtagtagatgtaccatcagctgcatctgacctcttactattctttaacttctcagttactgcaaatcagtgttcttaataagagactggagatatttgagaggaagatttttctataaatgcttgattggagccctttattcatttggctcaaaattaagacaatgatatctgaataaatgtagttctataattatatactttattataaaactttcacatatattttcacatatgatactcaaataaccttatgaatttagtagcatagctgttttttgctacaatttgaatatgagaaaagagagcagtagaaaggtgaaactgttgccgtaagtctactaaatggcagagccaagacctcaagtgggcctcttgtgcaaaccactgttacttttacacttgatttagccaaaaggctgagaagcgataccagtgttacttttttctatgctcacatatcaccttgatctgagacaaattatctctcattgttttgtcacaattatgtgatatacttttatttaaagaattaaactgctatataattcctattcaaattttctatatgctattatattttccttgtatatctacatactcttttattacttcacagtataaactttctcatgtatatactttttttcactagcaattgtctacatctcaaaaatttcacctgtcaagtgtataaatttcctcagtaaataaaaagctgctgaatatttttatatgagctttaaacttagcttcaccttgtttccattatgctgcaaggtgctttaaaggtagaaatgcatttctggtctgctcacaaacagatgaaaaattattttcctgccttctttgattttactttctcgtatgcactcatttgagttatatctcatctgtgttaaaatggaggtagctgtatatcagcaaagtagaaagaattcttgatactaaagtagtacatttccttgccttgttttcttttccttcatagagtttagtagtgttcattttatttatttgaatgtcaaaattctcagattactgccaaatattgtgattatagcagtttaggtgaataaaaacaagtaatggctgaatttaattatggataataaccatatgagaaagggatgaaagaacccctgaatctcctagagcttcatcatcactatttattttgcaaaataattatttagaattaatgagcttatatcagaattgatgtatgactgattttactttattttttaaaattttattattattgtactttaagttttagggtacatgtgcacaacgtgcaggtttgttacatatgtatgcatgggccatgtcggtgtgctgcacccattaactcgtcatttagcattagatatatctcctaatgctatccctcccccctccccccaccccacaacagtccctggtgtgtgatgttccccttcctatgtccatgtgttctctttgttcaattcccacctatgagtgagaacatgcggtgtttggttttttgtccttgtgatagtttgctgagaatgatggtttccagcttcatccatgtccctacaaaggacatgaactcatcattttttatggctgcatagtattccatggtgtatatgtgccacattttgttaatccagtctatcgttgttggacatttgagttggttccaagtctttgctattgtgaatagtgccgctataaacatacatatgcatgtgtctttataggcacataatttataatcctttgtgtatatacacagtaatgggatggctgggtcaaatgctatttctagttctagatccctgagaaatcgccacaccaacttccacaatggttgaaatggtttacagtcccaccaacagcataaaagtgttcctatatctctacatcctctccagcacctgttgtttcctgactttttaatgatcgccattctaactggtgtgagatggtatctcattgtgattttgatttgcatttctctgatggccagtgatgatgagcattttttcatgtgttttttggctgcataaatgtcttcttttgagaagtgtctgttcatatcctttgcccactttttgatggggttgtttttttcttgtaaatttgtttgagttcattgtagattctggatattagcccgttgtcagatgagtaggttgcaaaaattttctccgattctgtaggttgcctgttcactctaatggtagtttcttttgctgtgcagaagctctttagtttaattagatcccatttgtcaattttcgcttttgttgccattgcttttggtgttttagacatgaagtccttgcccatgcctatgtcctgaatggtattgcctaggtttttttctagggtttttatggtttgaggtctaacatttaagtctttaatccatcttgaattaatttttgtataaggtgtaaagaagggatccagtttcagctttctacatatggctagccagttttcccagcaccatttattaaatagggaatcctttccccatttcttgtttttgtcaggtttgtcaaagatcagatagttgtagatatgcagcgttatttctgagggctctgttctgttccattggtctatatctctgttttggtaccagtaccatgctgttttggttactgtagccttgtagtatagtttgaattcaggtagcatgatgcctccagctttgttcttttggcttaggattgacttggtgatgcaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaattttcttccatttgtttgtatcctcttttatttcattgagcagtggtttgtagttctccttgaagaggttcttcacatcccttgtaagttggattcctaggtattttattctctttgaggcaattgtgaatgggcgttcactcatgatttggctctctgtttgtctgttattgatgtataagaatgcttgtgatttttgcacattgattttgtatcctgagactttgctgaagttcttatcagcttgaggagattttgggctgagatgatggcgttttctagatatacaatcatgtaatctgcaaacagggacaatttgacttcctcttttcctaattgaataccctttatttccttctcctgcatgattgccctggccagaacttccaacactatgttgaataggagtggtgagagagggcatccctgtcttgtgccagttttcaaagggaatgcttccagtttttgcccattcagtatgatattggctgtgggtttgtcatagatcgctcttattattttgagatacatctcatcaatacctaattgattgagggtttttagcatgaagcgttgttgaattttgtcacaggccttttctgcatctattgagataatcatgtgttttttgtctttagttctgtttatgtgttggattacatttattgatttgcgtattttgaaccagccttgcatcccagggatgaagcccacttaatcatggtggataagctttttgatgtgctgccggattcggtttgccagtattttactgaggatttttgcatcgatgttcatcaagaatattggtctaaaattctgttttttggttgtgtctctgccagtctttggtatcaggatgatgctggcctcataaaatgagttagggaggattccctctttttctattgattggaatagtttcagaaagaatgctaccagctcctatttgtacctctggtagaaatcggctgtgaatccatctggtcctggactttttttggttggtaagctattgattattgcctcaatttcagagcctgttattggtctattcagagattcaacttcttcctggtttagtcttgggaggatatatgtgtggaggaatttatccatttcctctagattttctagtttatttgcatagaggtgtttatagtattctctgatggtagtttgtatttctgtgggattggtggtgatatcccctttatcattttttattgcgtctatttgatttttctctcttttcttctttattagtcttgccagcagtctatcaattttgttgatcttttcaaaaaaccagctcctggattcattaattttttgaagggttttttgtgtctctatttccttcggttctgctctgatcttaattatttcttgccttctgctagcttttgaatgtgtttgctcttgcttttctagttcttttaattgtgatgttagggtgtcaattttagatctttcctgctttctcttgtgggcatttagtgctataaatttccttcttcacacagctttgaatgtgtcccagagattctggtatgttgtgtctttgttctcgttggtttcaaagaacatctttatttctgccttcatttcattatttactcagtagtcattcaggaacaggttgttgagtttccatgtagttgagcagttttgagtgagtttcttaatcctgagttctagtttgattgcactgtggtctgagagacagtttgttataatttctgttcttttacatttcctgaggagtgctttactccaactatgtggtccgttttggagtaggtgtggtgtggtgccgaaaagaatgtatattctgttgatttggggtggagagttctagagatgtctattaggtccgcttggcgcagagctgagttcaattcctgggtatccttgttaactttctgtctctttgatctgtctaacgttgacaatggggtgttaaagtctcccattattaatgtgtgggagtctaagtctctttgtaggtcactaaggacttgctttatgaatctgggtgctcctgtattgggtgcatatacatataggatagttagctcttcttgttgaattgatccctttaccattatgtaatggccttctttgtctcttttgaactttgttggtttaaagtctgttttagcagagactgggattgcaaaccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaagttaatattgttatgtgtgaatttgatcctgtcattatgatgttagctggttattttgctcgttagttgatgcagtttcttcctagccttgatggtctttacaatttggcatgtttttgcagtggctggtaccagttgatcctttccatgtttagtgcttccttcaggagctcttttagggcaggcctggtggtgacaaaatctctcagcatttgcttgtctgtaaagtattttatttctccttcacttatgaagcttagtttggctagatatgaaattctgggttgaaaattcttttctttaagaatgttgaatattggtccccacactcttctggcttgtagagtttctgcggagagatcagctgttagtctgatgagcttccctttgtgggtaatccgacctttctctctggctgcccttaacattttttccttcatttcaactggtgaatctgacaattatgtgtctttgagttgctcttctcgatgagtatctttgtggcattctctgtattttctgaatctgaatgttggcctgccttgctagattggggaagttctcctggataatatcctgcagagtgttttccaacttggttccattctccccatcactttcaggtacaccaatcagacatagatttggtcttttcacatagtcccatatttcttggaggctttgttcatttctttttattcttgtttctctaaacttctcttctcgctgcatttcattaatttcgtcttccattgctgataccctttcttccagttgatcgcatcggctattgaggcttctgcatttgtcacgtagctcttatgccttggttttcagctccatcaggtcctttaaggacttctctgcattggttattctagttatctggtcgtctaattttttttcaaagcttttaacttctttgccattcattcgaatttcctcctgtagctcagagtagtttgatcatctgaagccttcttctctcaacttgtcaaagtcattttcc

SEQ ID NO: 12477 - DNA, 5974 bp, Homo sapiens
tttttattattattatactttaacttttaggatacatgtgcacaacgtgcaggtttgttacatatgtatacatgtgccatgttggtgtgctgcacccattaactcgtcatttagcattaggtatatctcctaatgctatccttctcccctcccaccaccccacaacagtccccggtgtgtgatgttccccttcctgtgtccatgtgttctcattgttcaattcccacctgtgagtgagaacatgcggtatgtggttttttgtccttgcgatactttgctgagaatgatagtttccagcttcatccatgtccctacaaaggacaggaactcatcattttttatggctgcatagtattccatggtgtatacatgccacattttctttttttttttaaacatttgaaaacctttattttttttatttttttattttttattttattttattttattttattattattatactttaagttttagggtatatgtgcacaacgtgcaggttagttacatatgtatacacgtgccatgctggtgtgctgcacccagtaactcgtcattaagcattaggtatatctcctaatgctatccctcccccatccccccaccccacaacagtccccagagtgtgatgttccccttcctgtgtccatgtgttctcattgttcaattcccacctatgagtgagaatatgcggtgtttgctttcttgttcttgcgatagtttactgagaatgatgatttccaatttcatccatgtccctacaaaggacatgaactcatcattttttatggctgcatagtattccatggtgtatatatgccacattttcttaatccagtctatcattgttggacatttgggttggttccaagtctttgctattgtgaatagtgctgcagtaaacatacgtgtgcatgtgtctttatagcagcatgatttatagtcctttgggtatatactcagtaatgggatggctgggtcaaatggtatttctagttctagatccctgaggaatcgcctcactgacttccacaatggttgaactagtttacagtcccaacaacagtgtaaaagtgttcctatttctccacatcctctccagcacctgttgtttcctgactttttaatgattgccattctaactggtgtgagatggtacctcattgtggttttgatttgcatttctctgatggccagtgatggtgagcattttttcacgtgtgttttggctgcataaatgtcttcttctgagaagtgtctgttcatgtccttcgcccactttttgatgaggttgtttgtttttttcttgtaaatttgtttgagttccttgtagattctggatattagccctttgtcagatgagtaggttgcgaagatgttttcccattttgtaggttggctgttcactctgatggtagtttcctttgctgtgcagaagctctttagtttaattagatcccatttgtcaattttggcgtttgttgccattgcttttgatgttttatacacgaagtccttgcccatgcctatgtcctgaatggtattgcctaggtttttttctagggtttttatggttttaggtctaacgtttaagtctttaatccatcttgaattaatttttgtataaggtgtaaggaagggatccagtttcagctttctacatatggctagccagttttctcagcaccatttattaaatagggaatcctttccccattgcttgtttttgtcaagtttgtcaaagatcagatagttgtagatatgcggcgttatttctgagggctctgttctgttccattgatctatatctctgttttggtaccagtaccatgctgttttggttactgtagccttgtagtatagttggaagtcaggtagcgtgatgcctccagctttgctcttttggcttaagattgacttggcaatgcgggctcttttttggtgccatatgaactttaaagtagttttctccaattctgtgaagaaagtcattggtagcttgatggggatggcattgaatctataaattaccttgggcagtatggccattttcacaataatgattcttcctatccatgagcatggaatgttcttccatttgtttgtatcctcttttatttcattgagcagtggtttctagttctccttgaagaggtccttcacatcccttgtaagttggattcctaggtattttattctctttgatgcaattgtgaatgagagttcactcatgatttggctctctgtttgtctgttattggtgtataagaatgcttgtgatttttgtaccttgattttgtatcctgagactttgctgaagttgcttatcagcttaaggagattttgggctgagacagtggggttttctagatatacaatcatgtcatctgcaaacagggacgatttgacttcctcttttcctaattgaataccatttatttccttctcctgcctgattgccctggccagaacttccagcactgtgttgaataggagtggtgagagagggcatccctgtcttgtgccagttttcaaagggaatgcttccagtttttggccattcagtatgatattggctgtgggtttgtcataaatagctcttattattttgagatacgtcccatcaatacctaatttattgagactttttagcatgaagggttgttgaattttgtcaaaggccttttctgcatctattgagataatcatgtggtttttgtctttggttctgtttatatactggattacatttattgatttgcatatattgaaccagccttgcatcccagggatgaagcccacttgatcatggtggataagcgttttgatgtgctgctggttttggtttgccattattttattgaggatttttgcatcaatgttcatcaaggatattggtctaaaattctctttttttgttttgtctctgcccggctttggtatcaggatgatgctggcctcataaaatgagttagggaggattccctctttttctattgattggaatagtttcagaaggaatggtaccagttcctccttgtatctctggtagaattccgctgtgaatccgtctggtcctggactctttttggttggtaagctattgattattgctacaatttcggagcctgttattggtctatttagatattcaacttcttcctggtttagtcttgggagggtgtatgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctctcttttctttattagtcttgctagtggtctatcaattttgttgatcctttcaaaaaaccagctcctggattcattaattttttgaagggttttttgtgtctctattaccttcagttctgctctgattttagttatttcttgccttctgctagcttttgaatatgtttgctcttgcttttctagttcttttaattgtgatgttagggtgtcaattttggatctttcctgctttctcttgtgggcatttagtgctataaatgtccctctacacactgctttgaacgtgtcccagagattatggtatgttgtgtctttgttctcattggtttcaaagaacatctttatttctgccttcattttgttatgtacccagtagtcattcaggagcaggttgttcagtttccatgtagttgtccagttttgagtgagtttcttaatcctgagttctagtttgattgcactgtggtctgagagacagtttgttataatgtctcatcttttacatttgctgaggagagctttacttccaagtatgtggtcaattttggaataggtgtggtgtggtgctgaaaaaaatgtatattctgttgatttggggtggagagttctgtagatgtctattaggtccgcttagtgcagagctgagttcaattcctgggtatccttgttaactttctgtctcgttgatctgtctaatgttgacagtggggtgttaaagtctcccaatattattgtgtgggagtctaagtctctttgtaggtcactgaggacttgctttatgaatctgggtgctcctgtattgggtgcatatatattttaggatagttagctcttcttgttgaattgatccctttaccattacgtaatggccttctttgtctcttttgatctttgttggtttaaagtctgttttatcagagaccaggattgcaacccctgcctttttttgttttccatttgcttggtagatgttcctccatccttttattttgagcctatgtgtgtctctgcacgtgaggtgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctggttagttgatgcagtttcttcctagcctcgatggtctttacagtttggcatgattttgcagtggctgctaccggttgttcctttccatgtttagtgcttccttcaggagctcttttagggcaggcctggtggtgacaaaatctgtcagcatttgcttgtctgtaaaggattttatttctccttcacttatgaagcttagtttggctggatatgaaattctgggttgaaaattcttttctttaagaatgttgaatattggcccccactctcttctgacttgtagagtttctgctgagagatcagctgttagtctgatgggcttccctttgtgggtaacctgatcttgctctctggctgcccttaacattttttccttcatttcaactttggtgaatctgacaatgatgtgtcttggagttgctcttctcggggagtatctttctggcattctctgtatttcctgaatttgaatgttggcctgccttgctagattggggaagttctcctggataatatcctgcagagtgttttccaccttggttccattctccccatgactttcaggtacaccaatcagacgtagatttggtgttttcacatagtcccatatttcttggagggtttgttcatttctttttattcttttttctctaaacttctcttcacgtttcatttgattcatttcgtcttccatcactgataccctttcttccagttgatcgcatcgactactgaggcttgtgcattcatcacgtagttctcatgccatggttttcagctccatcaggtcctttgaggacttctctgcattgattattctagttatccattcgtctaattttttttcaaagtttttaacttctttgccattggttcgaacttccttctttagctcagagcagtttgatcttctgaagccttcctctctcaactcgtcaaagtcattctccgtccagctttgttccgttgctggtgaggagctgcgtttctttggaggaggagaggcactctgatttttagagtttccagtttttctgctctgttttttccccatctttgtggtttcatctacctttggtctttgatgatggtgacatacagatgggtttttggtgtggatgtcctttctgtttgttagttttccttctaacagacaggaccctcagctgcaggtctgttggagtttactggaggtccactccagaccctgttttcctgggtatcagcagcggtggctgcagaacagcggatattggtgaaccgcaaatgctgctgcctgttcattcctctggaagttttgtctcagaggagtacccagccatgtgaggtatcagtccgccgctactggggtgtgcttcccagttaggttacttggggatcagggacccacttgaggaggcagtctgccctttctcagatctcaggctgtgtgctgggagaactactactctcttca
